United States Patent 10,858,403 (ISOLATED POLYNUCLEOTIDES AND POLYPEPTIDES, AND METHODS OF USING SAME FOR INCREASING PLANT YIELD AND/OR AGRICULTURAL CHARACTERISTICS) - sequence listing, part 3

SEQ ID NO: 2972 - DNA, 1112 bp, Trifolium pratense
aacgaacagtctaagcaccctgaatcacgcggtgatttcactatcttgctcagtcacattgttcttggctgcaaattcgtttgttctgctgttaacaaggctggtcttgctaagttaattggacttgctggagagaccaatgttcagggtgaagaacagaagaagctggatgttctttccaacgaggtgttctgcaaagctttgataagcagtggcaggacttccatcttggtctctgaagaagatgaggatgcaatatttgtgcagccttcactgcgtggaaagtattgtgttgtttttgatccattggatggctcctccaacattgattgtggtgtttccattggaactatttttgggatttatatgatgaaagatagccatgaaccagtcatagaagatgttctgcaaccagggaagaacctgttggcagctggttattgcatgtatggaagctcttgcacgcttgtgataagcactggtagtggtgttaatggttttacccttgacccttctcttggcgagttcatcctaactcaccctgatattaagattccaaagaaaggcaagatttattcagtgaatgaagggaatgccaagaattgggatggccctactgcctcttatgtggagaaatgcaaatttccaactgatggttcacccgcaaagtctctaagatatatcggaagcatggtagctgatgttcatcgtacattgctttatggaggtacatttttgtaccctgctgacaaaaaaagtccaaatggaaaacttcgtgtattgtatgaagtcttcccaatgtccttcttgatggaacaggcaggaggacaggctttcaccggcaaggaaagggcactggatttaattccaacaaagttgcatgaacgatctccaatatttcttggtagctatgatgatatcgaggaaatcaaagctctttatgctgcagaagagggcaaataagagaaacctgaaaaaagcttccttctggttttcactacttgcaagcatttatgcaattgttaggctaacaagtgcctataacaattaaaacttgtttaccttatcatgtatatgttataagaaaacttgttaatgtgcttgttttcctt

SEQ ID NO: 2973 - DNA, 1180 bp, Trifolium pratense
ttcacaacaagaaattgtgaattcattcataatggatcatgaaggggatgcaaatagaactgatttgatgacaataacaaggtttgttcttaatgagcaatcaaagtatgctgaatcacgtggtgatttcaccatcctcattagtcacattgttcttggctgcaaatttgtttgctcttccgttaacaaggcaggattggcaaaaatcctaggacttgctggagacaccaatgttcaaggtgaggagcaaaagaaattggatgtgatttctaatgaagtgtttgtgaaggccttaatcagcagtggacgcacgtgccttcttgtttctgaagagaatgaagatgctatcattgtgccaccagcacagcgtggcaaataccttgttgtgtttgatcctttggatggctcctcaaacattgactgcggtgtttcaataggaactatatttggtatttacatggtgaaggatacaaataatgtttctgttgaagatgcattgcaacctggaagcagtttagtagcagctggttactgcatgtatggaagctcttgcacgtttgtgcttagcacaggaaatggagtgaatggttttacacttgatccttcacttggagagttcatattgactcatccaaacattaagataccaaagaaaggaaagatttattcagtgaatgagggaaatgccaaaaactgggatgaaccaaccacaaaatatgtcgaaagttgcaagtttccacaagatggttcatcaccaaaatctcttagatacattggcagtatggtagctgatatacatcggacattgctatatggcggtattttcatgtatcctgctgataagaaaagcccaaatggaaagctaagggttctgtatgaagtctttccaatgtcatatttgatggagcaagccggaggtcaagctttcaccggaaaacaaagggcacttgacttggttccagagaaaatacatgatcgatcgccgatattccttggaagctacgatgaaattgagaaaatgaaagagctttatgctgaatctaaagcaaatggtgcatgaatataaactcagtttgtgtatcttttaattgtttgaggttcatttcttggcctttttgtataaatgttatttgtactattaatcatttctattgttttaaagcacaagcttgggctactt

SEQ ID NO: 2974 - DNA, 1317 bp, Medicago truncatula
cacttgttttcttatgataaatatttctttgaattaatttgtacactttgttcataatctcaaaaaaaatatggatcaccaagcagatgctaacagaactgatttgatgacaataacaaggtttgttctgaatgagcaatcaaagtatgctgaatcacgtggggatttcaccattctcatcaatcacattgttcttggctgcaaatttgtttgttcttctgttaacaaggctggattggcaaaaatcctaggacttgctggagacaccaatgttcaaggggaggagcaaaagaaattggatgtgatttctaatgaagtatttgtgaaggccttaatcagcagcggacgcacatgccttcttgtttcagaagaggttgaagatgctatcattgtgccaccagcacagcgtggcaaatacatagttgtgtttgatcctttggatggttcctcaaacattgattgtggagtttcaataggaactatctttggtatttacacagtgaaagatacagctgaagttagcgttgaagatgcattgcaacctgggagcagtttggtagcagctggttactgcatgtatggaagctcttgcacgtttgtgcttagcacaggaaatggagtgaatggtttcacacttgatccttcccttggagagttcatattgactcacccaaacatcaagataccaaagaaaggaaagatttattctgtgaatgagggaaatgctaaaaactgggatgaaccaaccgccaaatacgtagaaaattgcaagtttccacaagaaggttcagcaccaaagtctcttaggtatattggcagtatggtagctgatgtccatagaacattgctatatggtggtatattcatgtaccctgctgataagaaaagcccaaatggaaagctaagggttctgtatgaagtttttccaatgtcatatttgatggagcaagcaggaggtcaagctttcacaggaaaacaaagggcacttgacttggttcctaagaaaatacatgaccgatcgccaatattccttggaagctacgatgaaattgagcatataaaagagctatatgcagaatccaaagaaaatggtgcatgaaaatcaactcaatttctgtttcttttaattgcttaggttccaattcttggtctttttcactcttttggcaattagtaggggaggaatgctatatggtacaaagtgtcacgaatttagaatcatcatctcagggtggatgaagattcatagccttttgtataaataacatttgtactatcaatcattttaattgtttaatattaattagtagggttact

SEQ ID NO: 2975 - DNA, 1056 bp, Arnica chamissonis
atttcagtattttgctcagtaacattgttcttggttgcaagttcgtctgttctgctgttaacaaggcaggtttggcaaaactcattggacttgctggggagaccaatgtgcagggagaagagcagaagaaattggatgttttgtcaaatgaagtttttgtgaaggctttggtcagcagtggcagaacatgcatacttgtttctgaagaggacgaggaagcgataattatagaaccatccaagcgtggaaagtattgtgttgttttcgatccgttggatggatcttccaacattgactgtggtgtttccataggaactatttttgggatttacatgataaaagatggtgatgaggcccgtttggaagatgttcttcagcctggaagtaatatgctagctgctggatactgcatgtacggtagctcttgcacgcttgtgttaagcaccggctctggtgtgaatggatttactcttgatccatcattaggggagtttatactcacacaccctgacattaagatcccaaagaaaggaaagatttattctgttaatgaaggaaatgctaagaactgggatggtcctaccgcaaagtttgtggaaaaatgtaagttccccacggatggttcacctgcaaaatctctaagatatattggaagtatggttgctgatgttcatcgcaccttactttacgggggcgtgtttttgtaccctgctgataagaaaagcccgaatggaaagctaagggtcctctatgaagtgtttcctatgtcattcttgatggaacaagccggaggacagtcatttaccgggaaagaacgggctcttgatttggtccccaagaagatacatgaacgatctccaatattcttgggaagttatgatgacgtggaagaaattaaggcactgtatgcagctgaagagaaggcataaaaaagattgttcttgtgcaggtgtgtttccccttatagttctaaatccaggtttttatatgttaattttattacagtttcatgaaaatgatgtatttgatattcatatatgttaatttcacttttat

SEQ ID NO: 2976 - DNA, 987 bp, Flaveria ramosissima
tttgctcagtcatattgttcttggatgcaagtttgtttgtgctgctgttaataaggcaggtttggcaaaactcattggacttgctggagagactaatgtgcagggagaagaacagaagaaactggatgttttgtcaaatgaagtttttgtgaaggctttggtcagcagtggcagaacatgcatacttgtttctgaagaggatgaggaagcgataatcgtagaaccatctaagcgtggaaagtattgtgttgttttcgatccattggatggatcttccaacattgactgtggtgtttccataggaactatttttgggatttacatgataaaagatagtgatgcggcccgtttggaagatgttcttcagcctggaaagaatatgctggctgctggatactgcatgtatggtagctcttgcacgcttgtgttaagcactggatctggtgtgaatggatttactcttgatccatcattaggggagtttatactcacccaccctgacattaagattccaaagaaaggaaagatttattctgttaatgaaggaaatgctaagaactgggatggtcctactgcaaagtttgtggaaaaatgcaagtttcccaaggatggttcacctgcgaaatctctaagatatatcggaagtatggttgctgatgtccatcgcaccttactttacgggggggtgttcttgtaccccgctgataagaaaagcccaaatggaaaactaagggttctctatgaagtctttccaatgtcattcttgatggaacaagccggaggacaggcgtttacggggaaagaacgggctcttgatttggtgcccaagaagatccatgaacgatctccgatattcttgggaagctatgatgatgtggaagaaatcaaggcattgtatgcagctgaacaaaaggcataagagaaggttgttcttgtgcagttgtatttcccttttatccaggtcttatataagttaaattttattac

SEQ ID NO: 2977 - DNA, 1389 bp, Cajanus cajan
aatcccgaaatattgggataagtgttagactcttatcatcttctttcattctaagaaattctttgtcttaaaaaaggaacttttttctgtctttgaatttgtatattttgctggtgatcccagaagagaagaaggacaagtgggaattcatagtttctttgaacattagagagaatcacaggaagaagaatgaattacgaagctgacactaacatgactgatttgatgactatcacacgctttgttctgaatgaacagtcaaagtatcctgaatcacgtggcgatttcaccatccttctcagtcatgtcgttcttggctgcaaattcgtttgttctgctgttaacaaggcaggactggcaaaactcttaggacttgctggagacaccaatgttcaaggtgaggagcaaaagaaattggatgtgctttcaaatgaagtatttgtgaaagccttaatcagcagtggacgcacatgcctacttgtttctgaagaggttgaagaggctatatttgtgccaccatcacatcgtggcaaatacattgttgtgtttgatcctttggatggatcctcaaacattgactgcggggtttctattggaactatctttggtatttacatggtgaaggatgagactaaagttagtcttgaagatgcattgcaacctgggaacaaattgttagcagctggttactgcatgtatggaagctcttgcacgtttgtgcttagcacaggaaatggtgtgaatggttttacacttgatcctagcctgggggagttcatattgactcacccaaacatcaagataccaaggaaaggaaagatttattcggtgaatgaaggaaatgccaaaaactgggatgaaccgaccaccaaatatgtacaaaaatgcaagtttcctcaagatggtttaccacctaaatctcttaggtacatcggaagtatggttgctgatatccatcgaactttgctttatggtggtatcttcatgtaccctgctgatataaagagtccaaacggaaagctacgacttctctacgaagtctttccaatgtcatttttgatggagcaagcaggaggtcaggctttcacaggaaaacaacgggctcttgacttggttccaaaacaaatacatgaacgatcatcaatattccttggcagttacgatgacatcgagcaaatgaaagagctttatgccgcagatggtgcatgaatattctctttcaatctaattatatgtgccttttcatttgttaagatgtatatgttaaattattggcctcttggcagttaattgagcaggacaacatttgtttcggtagaacattgtgcttattcgaaggagttacagagaaaagaataaatgggtgaaggacatttttttttcctttaa

SEQ ID NO: 2978 - DNA, 1270 bp, Setaria italica
aatctcaccggctcacctcccgtgcccgtctccctccccattctcttcttcctccctcgcctccgatccgctcctcctcgcgcctgcttccgccgcctgctcctcatcctccaccgacggcgccgcgaagtgggtggagaagttcggttcttggggttgggggccgaaccggcggaggcgacgacttcggcagccggtcttccctgcaaccgcccatccctatgtgaaatgctgctcttgtctcacaggaatcccaaccaatgcactacctctgtcaattctagttaccaactgattgtctccaagctcttctgattgtccatgccactgccttccgcagagaagatgctgtcagtctatctttacattcctaacatcattgggtatttcaggatcatcataaatttcattgcatttgctgtttgctattcgaacaagcccctctttgctatcctgtacttcttcagctttgtactggacggtgtcgatggttggttcgcaaggaagtttaatcaagcatcaacatttggatctgtgctggacatggttacagatagggttagcactgcttgtttgttggcccttctctcacagtgttacaaacctggcttaattttcttgatgctgcttgggttggatatcacgagccactggtttcaaatgtatagttctttgttgtcaggtaagactagccacaaggatgtaaaacacacaaacaattggctactaaaattatattatgggtataggccattcatggccttctgttgtgtttcttgtgaggttttatatattatcctctttctctttgctgatgagaaatcgacaagcttgcttagtgtatgtagagttgttatgaagcaaagtcccctcattgtcttggtgttcatctcaactctagtgggctgggcagtgaaacaagttagcaacatcacccagatgaaaaccgctgcggacacatgcgtcgagtttgatccgaagcacagcaagtgatgcagaaaaggcaccggcttcattcggttttgtatttgaggaaaccctccttggggggcttgtacacaaagtttacatacagtggctacttatgtgcaggagatgaatgtgttgaggagaaagcggagatcgttatattgtttcagtttgtgttcacgattgttgttatccctaataggcttttgagcttagctgaataatgtttacatgttacatgtttcaaatcatgctcttctcggggatcaagttttctagaattattaaaattgatgttccc

SEQ ID NO: 2979 - DNA, 1206 bp, Setaria italica
gtctccctccccattctcttcttcctccctcgcctccgatccgctcctcctcgcgcctgcttccgccgcctgctcctcatcctccaccgacggcgccgcgaagtgggtggagaagttcggttcttggggttgggggccgaaccggcggaggcgacgacttcggcagccggtcttccctgcaaccgcccatccctatgtgaaatgctgctcttgtctcacaggaatcccaaccaatgcactacctctgtcaattctagttaccaactgattgtctccaagctcttctgattgtccatgccactgccttccgcagagaagatgctgtcagtctatctttacattcctaacatcattgggtatttcaggatcatcataaatttcattgcatttgctgtttgctattcgaacaagcccctctttgctatcctgtacttcttcagctttgtactggacggtgtcgatggttggttcgcaaggaagtttaatcaagcatcaacatttggatctgtgctggacatggttacagatagggttagcactgcttgtttgttggcccttctctcacagtgttacaaacctggcttaattttcttgatgctgcttgggttggatatcacgagccactggtttcaaatgtatagttctttgttgtcaggtaagactagccacaaggatgtaaaacacacaaacaattggctactaaaattatattatgggtataggccattcatggccttctgttgtgtttcttgtgaggttttatatattatcctctttctctttgctgatgagaaatcgacaagcttgcttagtgtatgtagagttgttatgaagcaaagtcccctcattgtcttggtgttcatctcaactctagtgggctgggcagtgaaacaagttagcaacatcacccagatgaaaaccgctgcggacacatgcgtcgagtttgatccgaagcacagcaagtgatgcagaaaaggcaccggcttcattcggttttgtatttgaggaaaccctccttggggggcttgtacacaaagtttacatacagtggctacttatgtgcaggagatgaatgtgttgaggagaaagcggagatcgttatattgtttcagtttgtgttcacgattgttgttatccctaataggcttttgagcttagctgaataatgtttacatgttacatgtttcaaatcatgctcttctcggg

SEQ ID NO: 2980 - DNA, 1672 bp, Sorghum bicolor
atgtcacgaagaattttgaaatttttttggaagcctagtttcacgtggggcaaaatctatacatcccgggcctgttgacatctctggcgagtcatctccctcgcaggccgctctcggtccctcagcgcagatcttctgctccttccccactcgcgctcaggctccgtcccaaggatcggatcttccgcgcgtcggcggctccccctcggcggcgcagcgacggaggggcagtcccaggcctggcggcggcgtcggcggctaccccaccttctctcgccagtcgcctcgcgccctcgcctgcgtcctccgcgcaccggccgacgactctgcgaatcctattaagtttactgctgctaccaatttaagggcagaactctgctggtcttcaagctcttggttactcctgatcttctgtggcacaattgtcctctggcaaaatgccatcggtttatctttacatccctaacattattgggtattttaggatcatcataaatttcattgcatttgcggtttgctattccaacaaggctctctttgctctcctatacttcttcagctttgtccttgatggtgtggatggttggttcgcacggaagttcaatcaagcatcaacatttggagctgtgttggacatggttacagatagggttagcactgcttgtttgttggcccttctctcccagttttacagacctggtttagtcttcttgatattgcttgggttggatattacgagccactggtttcaaatgtacagttctttcttgtcaggtaagactagccacaaggatgtaaaacacacaggcaattggcttctgaaattatattatggatacaggccattcatggccttctgctgtgtttcttgcgaggttttatatattatcctctttctctttgctgatgagaagtcaacaagcttgcttagtgtatgcaaaggtgtcctgaaccaaaatcctgttgttgtcttggtgtttatttccactctagttggctgggcagtgaaacaagtcaccaacgtcatccagatgaaaactgctgcggatgcatgtgttgtgtatgatctgaagcgcagcaaatgaagcttcaaagcatgaaggcacccacatttacagtttaattcagttttgtatctacacacccaaagggaaaactccgcgaggcttgtacaccaggagctacgtcttactgtgccttgacatctttctggtgatgctataagtgggacctgaggatgacatgccgtgggaagaacatatcataaatcataaagaaaaccaaagcagacggttgtttttgtgaaagcagcggcagttaagttgttgttgtcagtgtgtaactgtgtattaatctttcatacagcgatgatgcgatcgtgatctttgttatctagagtagccctttgtgttaacctgaacgaccatgttccaaactccaggaatatatgaaggttttgaatagcaaaaattacatattccctccctgaaggccagttccagttgcaaatgcccctccagagttaaatagttactcttacccgccgaaataggcactagctactattcggatgattcccctttttctgctccttaaatatgccttggttcagttttatcgataaattttcctttttacgtgatctcccatagttcaaagaataaacacacgt

SEQ ID NO: 2981 - DNA, 1292 bp, Saccharum officinarum
gcccgacaccgagggccagggaatctcgagagctacgctcgattcggtcatttccgccgggccaagtggtttcgagtttcgacgaccgtatgtctgcagcaacggggccaggcctagcgtcagcgcgaccgaacacgccggcgaccgccgccgcccttctcccagctgtccaggtcttcgtcgagccctttgcccgcgacgagcgcctaccacaccaggaatcccattaagtttactgctgctaccaatttaagggcagaactgccggtcttcaagctcttggttacaactgatcttctgtggcacaattgtcctctggcaaaatgccatcggtttatctttacatccctaacattatcgggtattttaggatcatcataaatttcattgcatttgcggtttgctattccaacaaggctctctttgctgtcctgtacttctttagctttgtccttgatggtgtggatggttggtttgcacggaagtttaatcaagcatcaacatttggagctgtgttggacatggttacagatagggttagcactgcttgtttgttggcccttctctcccagttttacagacctggtttagtcttcttgatattgcttgggttggatattacgagccactggtttcaaatgtacagttctttcttgtcaggtaagactagccacaaggatgtaaaacacacaggcaattggcttctgaaattatattatgggtacaggccattcatggccttctgctgtgtttcttgcgaggttttatatattatcctctttctctttgctgatgagaagtcaacaagcttgcttagtgtatgcaaaggtgtcctgaaccaaaatcccgttgttgtcttggtgtttatttccactctagttggctgggcagtgaaacaagtcaccaacgtcatccagatgaaaactgctgcggatgcatgtgttgtgtatgatctgaagcgcagcaaatgaagcttcaagcatgaagacccgccttgacgttttaattcagttttgtatcgacatacccaagggaaaactctcgaggcttgtacaccaggggctacgtcttacgtgccatgacatctttctgatgatgctatatttgagacctgaggatgacatgccgtgggaagaacatatcataaagaaaaccaaagcagacagttgtttttgtgaaagcacggaagttaagttgttggcagtggtattaatctgcatacagtgatgatgcgatcgtgatctttagtagccctttgtgtaacctgaacgacctttacaagccacatgttc

SEQ ID NO: 2982 - DNA, 1698 bp, Setaria italica
agaaaattccttccccccttaccaatctcagcccgtgcccagtctgtccgtctcccttcccaatcgctttcgatccgcacctcctgtctccgccgccgcttcatcccgctgcggccctccaccgccgcttcatcccgccgcggccctcctccgccgccgcccccagcgacgacgctgctaagtgggcggttcgtgcagaggcggcgacttcggctgccggtattctctgcaaccactccgtccctcggtctcaccgctctgccgccccttcctctccactgctccgctgcctcccggtggacggatctggagtcggcggatagctagtactgctcctaccctggcctccaggtggcggcaccacttccccggcgggaaccccaataagtttactgctgccatcaagctaagcgaggaattgcctgtctcctagaacttctcctgatcttccgtggcacaatcatcctctgagaaaatgccatcagtttatctttacatacctaatattattgggtattttaggatcatcataaatttcattgcttttgctgtttgctattccaacaaggcgctctttgctattctgtacttcttcagctttgttcttgatggcgtggatggttggtttgcacggaagtttaatcaagcatcaacatttggagctgtgttggacatggttacagatagggttagcactgcttgtttgttggcccttctctcccaattttacagacctggcttagtcttcttaatacttcttgggttggatattacaagccactggtttcaaatgtacagttctttcctgtcaggcaagagtagccacaaggatgtaaagcacacaggcaattggcttctgaagttatattatgggtacagaccattcatggccttctgttgtgtttcttgtgaggttttatatatcattctctttctctttgctgatgagaagtcgacaagcttgcttagtgtatccagaggtatcctgaatcaaagtcccctcattgtcttggtgtttatttccactctagttggctgggccgtgaaacaagttaccaatgtcatccagatgaaaaccgctgcagatgcatgtgttgtgtatgatctgaagcgcgggaagtgaagcatgaaggcacctgttttgtgttttgtatcaacatatccaattcgtgaggcttgtgcaccagggttcgtacgtacagtggctacttcttatatgccttgacatctttatgatgatgcttatctgttggggcgagacggcgatcttgctgtgggaagaacataaagaaaacggaggagataaatgttttgaggagaaagtggaggctgtttaaattgtttgccagtgtttaattcggttatacaatgatgatgcaatcatgatctttgttaggtagtgtagccttttgagttgacctgaaccatgtttgcaagccacatgtttcaaatttcaggaacactaggatcgtgatacataaaaattgttacgggcatgaaaattgatatcgctttaatataatatacacactgtccaattaaatttaagatgatacatgttattcaaataaaattcagaaataataggaaatatacatgtgctttgtgatgagcgaagggccaacgattgaggctttattttaacctatttaatagataatatttcaaaataaatcaaatcgaaaaggtattaagtca

SEQ ID NO: 2983 - DNA, 1749 bp, Setaria italica
agaaaattccttccccccttaccaatctcagcccgtgcccagtctgtccgtctcccttcccaatcgctttcgatccgcacctcctgtctccgccgccgcttcatcccgctgcggccctccaccgccgcttcatcccgccgcggccctcctccgccgccgcccccagcgacgacgctgctaagtgggcggttcgtgcagaggcggcgacttcggctgccggtattctctgcaaccactccgtccctcggtctcaccgctctgccgccccttcctctccactgctccgctgcctcccggtggacggatctggagtcggcggatagctagtactgctcctaccctggcctccaggtggcggcaccacttccccggcgggaaccccaataagtttactgctgccatcaagctaagcgaggaattgcctgtctcctagaacttctcctgatcttccgtggcacaatcatcctctgagaaaatgccatcagtttatctttacatacctaatattattgggtattttaggatcatcataaatttcattgcttttgctgtttgctattccaacaaggcgctctttgctattctgtacttcttcagctttgttcttgatggcgtggatggttggtttgcacggaagtttaatcaagcatcaacatttggagctgtgttggacatggttacagatagggttagcactgcttgtttgttggcccttctctcccaattttacagacctggcttagtcttcttaatacttcttgggttggatattacaagccactggtttcaaatgtacagttctttcctgtcaggcaagagtagccacaaggatgtaaagcacacaggcaattggcttctgaagttatattatgggtacagaccattcatggccttctgttgtgtttcttgtgaggttttatatatcattctctttctctttgctgatgagaagtcgacaagcttgcttagtgtatccagaggtatcctgaatcaaagtcccctcattgtcttggtgtttatttccactctagttggctgggccgtgaaacaagttaccaatgtcatccagatgaaaaccgctgcagatgcatgtgttgtgtatgatctgaagcgcgggaagtgaagcatgaaggcacctgttttgtgttttgtatcaacatatccaattcgtgaggcttgtgcaccagggttcgtacgtacagtggctacttcttatatgccttgacatctttatgatgatgcttatctgttggggcgagacggcgatcttgctgtgggaagaacataaagaaaacggaggagataaatgttttgaggagaaagtggaggctgtttaaattgtttgccagtgtttaattcggttatacaatgatgatgcaatcatgatctttgttaggtagtgtagccttttgagttgacctgaaccatgtttgcaagccacatgtttcaaatttcaggaacactaggatcgtgatacataaaaattgttacgggcatgaaaattgatatcgctttaatataatatacacactgtccaattaaatttaagatgatacatgttattcaaataaaattcagaaataataggaaatatacatgtgctttgtgatgagcgaagggccaacgattgaggctttattttaacctatttaatagataatatttcaaaataaatcaaatcgaaaaggtattaagtcatcgtgataatttgctcgcacccttctcaatctgggctgtcaaaaaccacca

SEQ ID NO: 2984 - DNA, 1227 bp, Echinochloa colona
tggagccgcggtagctgggtctcgctttcctcggcctccaggtgcggcaccacttccggaacggaaccacaatagtttactgctgccatcaagttaagtaaggaaccgcctgtctccgagaactttgattgcccctgatattctgtggcacaatcatcctccaagaaaatgccatcagtttatctttacatccccaatattattgggtatttcaggatcatcataaatttcattgcttttgctgtttgctattcgaacaaggcactctttgctatcctgtatttcatcagctttgtccttgatggcgtggatggttggtttgcacggaagtttaatcaagcatcaacatttggagctgtgctggacatggttacagatagggttagcactgcttgtctattggcccttctctcccaattttacagacctggcttagtcttcttgatactgctcgggttggatattacaagccactggtttcaaatgtacagttctttcttgtcaggtaagactagccacaaggatgtaaagcacacaggcaattggcttctgaaattatattatggctacagaccattcatggccttctgttgtgtttcttgcgaggttttatatattatcctctttctctttgctgatgagaagtcaacaagcttgcttagtgtatgcagaagtatcctgaatcaaaatcccctcattgtcttggtgtttctttccactctagttggctgggccgtgaaacaaattaccaatgtcatccagatgaaaactgctgcagacgcatgtgtcgtgtatgatctgaagcgcagcaagtgaagcatgaaggcaccggttttgttcagtttgtatcaacatatccaaggaaaaatcccgtgagggttgtacaccatgattcatcatacatacagtggctaattcttatgtgccttgacatatttctgatgatgcttatctgttgggacgagacggcaacttgctgtgggaagaacataaagaaaaccaaggagataaatatttgtcttgaggagaaagcagaagctgttaagtcgtttgtcagtgtttgtttgttatacaatgatgatccgagcatgacctttgttagctagagtagccttttgaattgatctgaacgatgtttacaagccacaaacttcaggaatatatgaagttctagatttgcaaaacttacttcctcctgaaggtcaattctactcgcaaatgccacct

SEQ ID NO: 2985 - DNA, 1527 bp, Panicum virgatum
cggcgcttgccttcgactttttcggtttttcccctccactctctcgccctttctttcctagccgcgaccgcgagccggcgacgccagaacgagcgctttgccaggtcatctttcctcgcctcactctcctccctctgtttaacattttcccttctcccggactctctcctcccttgctcttccttccctggcggcgacgactgggcgagcggcggcgccatttgtcgcgtcttcgcccagccctttgccggcgacgagcacccaccaggaaccccaataagtttactgcttccatcaagggaggacctgcctgtctccgagaacttaattactcctgatcttctgtggcacaagcatcatctgagaaaatgccatcagtttatctttacatccctaatattatcgggtatttcaggatcatcataaattttatagcttttgctgtttgctattccaacaagacactctttgctatcctttacttcatcagttttgtcctagatggcgtggatggttggtttgctcggaagtttaatcaagcatcaacatttggagctgtgttggacatggttacagatagggttagcactgcttgcttgttggcccttctctcccaattttacaggcctggcttagtcttcttgatactgcttgggttggatatcacaagccactggtttcaaatgtacagttctttcttgtcaggtaagactagccacaaggatgtaaagcacacaggcaattggcttctgaaattatattacgggtacaggccgttcatggccttctgttgtgtttcttgtgaggttttgtatattatcctctttctctttgctgatgtgaagtcgacaagcttgcttagtgtatgcagaggtatcctgaatcaaagccccctcattgtcttggtgtttgtttccactttaattggctgggcagtgaaacaacttaccaatatcattcagatgaaaactgctgcagacgcatgtgtcgtgtatgatctgaagcgcagcaagtaaagcatgaaggcaccggttttgttcagtttgtgttgatattatccaaggaaaattcccgtgaggcttgtacaccatttcatacatacagtggctacttcttgtgtgccttgacatctttctgactatgcctatctgttgggaagagacggcaacttgctgtgggaagaacatgaagaaaacagaggagacaaacgttttacggagaaagtataggctgttaagttgtttgtcagtgtttgttcactatatagttggatgcagagcatgacctttgttagctggagtggcctatgagtatctgaaccatgtttacaagctgcatttttcagagtccaggaatatatgaagttttagaattgcaaaatttatggttatcttggttagcatgcactatcagataggcacctgattttttttggttatcttgcctgtattccttacaattatcagatttttttggttatcttgccttgcattccttacaagtattgtttcgtcaagttttgctgat

SEQ ID NO: 2986 - DNA, 1940 bp, Zea mays
aaacagtctctaagccctcgttgtgtctgccctcaatgtccatataaatatgcattatttctttcgattaatataaagcattatattgtgtgcgaaatatttataaaggaccgttttataatgaaatttagacgaaaactctcaaagattgtaaaatcgcgaaggctactaggcagaattccaaatttctcgtccctgatacctcacaccgggccgccacacaaaatccccacacctgcctgcgtatcgcgctgcccacccaccgcacatccccgcctcccgccggccggccgcccgcctaacgactcgcggtcaccgcctgcgggccaccgtccgcccccagctcgcttacgatattgtacgttcgtggcgcggagcaccgtggtgttggcctagtacgtcgatttcacggtgacttcaccaccattgccgcccagtggctgcagaagctccccgccagcaacaagttcacctacaactgcgacggccacaccttcagttacctcatagagaaaggatttagaatcccattaagtttactgctgctaccatttaaagggcagaactgccggtcttcaagctctttgttactcctgatcatctgtggcacaattgtcatcgggcaaaatgccatcagtttatctctacatccctaacattatcgggtattttaggatcatcataaatttcattgcatttgcggtttgctattccaacaaggctctctttgctgtcttgtacttcttcagctttgtccttgatggtgtggatggttggtttgcacggaagtttaatcaagcatcaacatttggagcagtgttggacatggttacagatagggttagcactgcttgtttattggcccttctttcccagttttacagacctggtttagtcttcttgatattgctcgggttggatattacgagccactggtttcagatgtacagttctttcttgtcaggtaagactagccacaaggatgtaaaacacacaggcaattggcttctgaaattatattatgggtacaggccattcatggccttctgctgtgtttcttgtgaggttttgtatattatcctctttctctttgctgatgagaagtcaacaagcttgcttagtgcatgcaaaggtctcctgaaccaaagccccatcattatcttggtgtttatttccacattagttggctgggcagtgaaacaagtcaccaatgtcatccagatgaaaactgctgcggatgcatgtgttgtgtacgacctgaagcgcagcaaacgaaaagcatgaagggaaaactctacggtttaactcagtcctgtgtcgacgtatccaaagggaaaaactctgcgaggggatacgtcttacgttccttgacatctttctgatgatgccatacgtggggccagaggatgacatgccgtgggaagagcagcatgtcataaagagaaccaacgcaaacaattgttttgtgaaggcggctattgatttgttgtcaagagtgttttattatgtcatacaaatgatgaattgatgatggtacctttgttacctgggctagccctttgtgtcaacatgaaagatgcttacgagccacatgttcccttctgaaatgaaggttttgagttgcaaaaatttacatattcccttctgaaagccagcaactgcacctcgagagggtttaatggttacttttaccccccaaaataggcactagctattattcggatgatttcccttttgctccttattaaacatcctttggttcagttttattgatagttttaatttttttacatgatctcccttagttcaaaaaaataaaattaaaataaacacatgttttttaggtgacaaacacatgctttagctagattgtcaatacaagttactaggtggtaataatagtacaagttactaggtggtaatgatacacaagttcgaag

SEQ ID NO: 2987 - DNA, 1414 bp, Brachypodium distachyon
cagccgtctcctctcgagtctctgaccccaacctcgccgcctccaccgtgcttcttccgccccgccgccgccgccctgcccctcaaagcgcgccgcctcctgctcctcccaaggcaccgcctacctgctgctccttcccactccgctgtctaccggtacttctcccccctgagccgccctcccttaacgacgacatcctcaattgcggcacgaccggtggttcagcggcgggcggcggcagcgtggtccagtcgttccggtgacggcgccaccaacggtatcctaggaatccccaggaggatactactgctgccattttaagtaagagaaactgccagccttcgagcagttggtacctcctgacattcaatggcccaatcatctgcggagaaaacaccgtcggtctatctctacatccctaatatcattggatatttcaggatcatcataaacttcattgcatttgctgtgtgctattccaataggacactctttgctatcttgtactttttcagcttcttttgtgatggcttggatggttggtttgcccggaggttcaatcaagcatcaacatttggagctgtattggacatggtaacagatagggttagcactgcttgtttattggcgcttctctcccagttttacagacctggcttggttttcttgatattacttgggttggacatcacaagccactggtttcaaatgtacagttctttcttatcaggcaagactagccacaaggacgtaaaggacacaggctattggcttctgaaattatattacggatatcggccattcatggccttctgttgtgttgcttctgaggtcctgtacattatcctctttctctttgctgacgagaagtcaactagcttgcttaaagtgtgcagaggtatgctgaaggaaagtcccctcattgtcttcatcttcatttcaactctaattggatgggcactgaaacaagtgatcaatgtcatccagatgaaaacagctgcagatgcttgtgttgtgtttgatttgaagagaggcaagtgagaaaaatggtcgaggtttcgttttagtttgtgttggcatatgcgagaaaaacataccgtcaggcgggcttggttgtaaggcacatatgctagctccttgatgtatcttttaacatgttgctgatttgagggtcggcatagtgtgggaaaagcagcatgaaaagaaaggaagaaatgctttgaggaaaacacagagattgtcaagttctgtaatctgcatttcctttctacagtaattgattcgatctttctttctgtaccagcgtgatttttgtaaccaggcagcaaatgtgatggctcctacctcctgttatagtggtctacatattcaaaattttcttggttgttttgttcattgtatcagattaacgccc

SEQ ID NO: 2988 - DNA, 1457 bp, Brachypodium distachyon
gtctcgacctcagccgtctcctctcgagtctctgaccccaacctcgccgcctccaccgtgcttcttccgccccgccgccgccgccctgcccctcaaagcgcgccgcctcctgctcctcccaaggcaccgcctacctgctgctccttcccactccgctgtctaccggtacttctcccccctgagccgccctcccttaacgacgacatcctcaattgcggcacgaccggtggttcagcggcgggcggcggcagcgtggtccagtcgttccggtgacggcgccaccaacggtatcctaggaatccccaggaggatactactgctgccattttaagtaagagaaactgccagccttcgagcagttggtacctcctgacattcaatggcccaatcatctgcggagaaaacaccgtcggtctatctctacatccctaatatcattggatatttcaggatcatcataaacttcattgcatttgctgtgtgctattccaataggacactctttgctatcttgtactttttcagcttcttttgtgatggcttggatggttggtttgcccggaggttcaatcaagcatcaacatttggagctgtattggacatggtaacagatagggttagcactgcttgtttattggcgcttctctcccagttttacagacctggcttggttttcttgatattacttgggttggacatcacaagccactggtttcaaatgtacagttctttcttatcaggcaagactagccacaaggacgtaaaggacacaggctattggcttctgaaattatattacggatatcggccattcatggccttctgttgtgttgcttctgaggtcctgtacattatcctctttctctttgctgacgagaagtcaactagcttgcttaaagtgtgcagaggtatgctgaaggaaagtcccctcattgtcttcatcttcatttcaactctaattggatgggcactgaaacaagtgatcaatgtcatccagatgaaaacagctgcagatgcttgtgttgtgtttgatttgaagagaggcaagtgagaaaaatggtcgaggtttcgttttagtttgtgttggcatatgcgagaaaaacataccgtcaggcgggcttggttgtaaggcacatatgctagctccttgatgtatcttttaacatgttgctgatttgagggtcggcatagtgtgggaaaagcagcatgaaaagaaaggaagaaatgctttgaggaaaacacagagattgtcaagttctgtaatctgcatttcctttctacagtaattgattcgatctttctttctgtaccagcgtgatttttgtaaccaggcagcaaatgtgatggctcctacctcctgttatagtggtctacatattcaaaattttcttggttgttttgttcattgtatcagattaacgccctttaggctttagcgtggtgattattttttgcaa

SEQ ID NO: 2989 - DNA, 2487 bp, Pennisetum glaucum
aaaaagtttactgcttccatcaagttaagcgaggaattgcctgtctcctagaacttctcctgatcttccgtggcacaatcatcctctgagaaaatgccatcagtttatctgtacatccctaatattattgggtatttcaggatcatcataaatttcattgcttttgctgtttgctattccaacaaggcgctctttgctatcctgtacttcattagctttgttcttgatggcgtggatggttggtttgcgaggaagtttaatcaagcatcaacatttggagctgtgttggacatggttacagatagggttagcactgcttgtttgttggcccttctctcccaattttacagacctggcttagtcttcttaatacttctcgggttggatattacaagccactggtttcaaatgtacagctctttcctgtcaggcaagagtagccacaaggatgtaaagcacacaggcaattggcttctgaaattatattatgggtacagaccattcatggccttctgttgtgtttcttgtgaggttttatatattattctctttctctttgctgatgagaagtcgacaagcttgcttagtgtatccagaagtatcctgaatcaaagtcctctcattgtcttagtgtttatttccactctagttggctgggccgtgaaacaagttaccaatgtcatccagatgaaaactgctgctgatgcatgtgttatgtatgatctcaagcgtggcaagtgaagcatgaaggcacctgttttgttttttgtttgtatcaacatatccaactcgtgaggctcgtgcaccagggttcatacatacagtggctacttcttatgtggctttgacatgttgctgatgatgctcatctgttgggacttgggacgagacagcaatcttgctgtggggagaacataaatgaagaaaacgaaggagataaatgttttgaggagaaaaaggaggctgtttgaagttgtttgtcagtgtttaattggattatacaatgatgacgcaatcatgatctttgctaggtagtgtagtcttttgacctcaaagaatgtttgcaagcaagccacgtgtttcaaatttccatatgaaggttaattattgttgcaaatgcaccgccatagtcatatagtctgcttttagccctcactagcatgatcggggcagttttttttggttacgcttcctcctgttccttgccggtatcgttggtttgtcgatacatttgctttctatctactgcgttcattcaaacattggccaatttggttcataaatttgctgcaagaaactacaagttgctgggtatttgtattgcagctaagatttccctcttcagctcctctcttctgattttgcctgtactagtcagtgggaacggctgcgtccacagataatacgactttggtaccttaaatctgctcagttttttcatcctacagtggtcatgaaggatctgagaagtcacttctttagcttcgccttggcgctcagctcttgcatcaacccacttccagccacccctgatgctaacacaagcaacaactttctcaccgagacgactatccggtgtaccgattaccacaactctggctactgcagggtgctgggacagtaccagttcaacctcttcagggtacacattttcacctccagttttgatgcggcccttctgccggcccatgagccacagattacctgcttcatccatccatccagtgtcaccagtgtcaagccatccattcctgacacaatctgatgaatccaccatgttgtttgcccagtacccaaccatggtatgcaagcctcttgttaagatgttcccagtcggtgaagaactagtattattaccatccatgccgatttttaactcgacatggggtgctggtttaccgacacaaacgcctccaaaatggctgcctgcttggttcttgggttcttggagttttggtttgttgagagccatgaatgtcagagatgaacaggcctcagtcatcccataagcagagaaaatagcagcacggggaaataactgagaagctccatccatcagttcctctgacaatccaccaccaccattcagaatcttggtcactgtcatcacagggcctaatatcctctcttttcgagcataggacagtagatcagccatgatcgcagggacagtgatgaaagaagtgactccatgtttcttgatggcgtcgaaagctgatttggcatcaaatttcagtatcagcacatgacagcctccagccatcaggatggccatgcatgaggagatccctccgatatggcaaagaggcgccgtatgcaggtagacatcatcctcaccgtagccaacaatggcgatcttcgctagggattgaatgatcagagatgtatggcttatcgctacgccctttggtcgtccagtagtaccagatgtgaagcatatcaaagcaacatcccttggagccgacacgggttccatcgccgcatccc

SEQ ID NO: 2990 - DNA, 1322 bp, Oryza sativa
ggagcagcatcgaaatcgaatcgatccatctgcacaaggaaggaagcatcgaatcgaacgacaaatcgaatcaatccatcggcggcggcggcgactcggctctcgcttccacgcatccatccccgcgcccccctcctctccggcgactccccggaatcgcggcgcggcggcgcggccgccctagcgtcggcgacggctaggtcttcctccccgaccccttcgtgaggtgaggaattcctatataggactacaatttaagggagaagctttcaggcttctagcaagtaataactactgatctccaatggcacaaccttcttctaagaagacgccgtcagtctatctttacatccctaatatcattggatattttaggatcatcataaacttcattgcttttgccgtatgttattccaatagggtgctctttgctatcctatacttcttcagctttttctgcgatggcttggatggttggtttgcacgaaagtttaaccaagcatcaacatttggagctgtgctggacatggtaacagatagggttagcactgcctgtttgttggcacttctctcccagttttacagacctggcttagttttcttgatgttgcttgggttggatattacaagccattggtttcaaatgtacagttcgttcctatcaggtaagactagccacaaggatgtaaaagacacaggcaattggcttctgaagttatattatggacaccgaccattcatggccttctgttgtgttgcttcggaggttctgtacatagttctttttctgttcgccgatgagaagtcaacaagcttgcttaatgtgtgcggaaaccttctgaagcaaagtcctctcactgtctttgttttcatttcaactctagttggttgggcgttgaaacaagtgatcaatgttatccagatgaaatcagccgcagacgcgtgcgttgtgtttgatttgaagcgcggcaagtgagcagaaatgcacaacgatttcgtttagcttgtgtttggcatgtcgaagaaaatattccatgaggcttgatgtaccaaggctgtacaaacctaatgtaagattttgacatgtccttgacactgagggagggcatgctgtgcattaacagcatgaaaagaaaaggagagagatcagatgtatttgaggaaaacagggttttagtcagattttgtatgtttctttttacaacagcgatgaatcagcgcgatctttgtttctttatgagcttgatgtttgttgacagtatttttagctggttatttgtgaataccattctcacctctggaaatttggagggcatgaatcc

SEQ ID NO: 2991 - DNA, 1100 bp, Oryza sativa
ctactgatctccaatggcacaaccttcttctaagaagacgccgtcagtctatctttacatccctaatatcattggatattttaggatcatcataaacttcattgcttttgccgtatgttattccaatagggtgctctttgctatcctatacttcttcagctttttctgcgatggcttggatggttggtttgcacgaaagtttaaccaagcatcaacatttggagctgtgctggacatggtaacagatagggttagcactgcctgtttgttggcacttctctcccagttttacagacctggcttagttttcttgatgttgcttgggttggatattacaagccattggtttcaaatgtacagttcgttcctatcaggtaagactagccacaaggatgtaaaagacacaggcaattggcttctgaagttatattatggacaccgaccattcatggccttctgttgtgttgcttcggaggttctgtacatagttctttttctgttcgccgatgagaagtcaacaagcttgcttaatgtgtgcggaaaccttctgaagcaaagtcctctcactgtctttgttttcatttcaactctagttggttgggcgttgaaacaagtgatcaatgttatccagatgaaatcagccgcagacgcgtgcgttgtgtttgatttgaagcgcggcaagtgagcagaaatgcacaacgatttcgtttagcttgtgtttggcatgtcgaagaaaatattccatgaggcttgatgtaccaaggctgtacaaacctaatgtaagattttgacatgtccttgacactgagggagggcatgctgtgcattaacagcatgaaaagaaaaggagagagatcagatgtatttgaggaaaacagggttttagtcagattttgtatgtttctttttacaacagcgatgaatcagcgcgatctttgtttctttatgagcttgatgtttgttgacagtatttttagctggttatttgtgaataccattctcacctctggaaatttggagggcatgaatcccatcgtttagcatttcactccgttgtaatttgtttacactaatattactccatggaatgtattcaagta

SEQ ID NO: 2992 - DNA, 1480 bp, Panicum virgatum
agccgcgagccggcgacgacagggcgcacctttgccaggtcatctttcctagcctcagggcggggctcatctcctcccttgtttcttaaaccatttcccttctctcggaatctctcctcccttgcgcttccttccctggcgacgacgactgggcgagcggcggcgcccagccctttgccggcgaggagcatccacccaggaaccccaataagtttactgcttccatcaagtgaggacctgcctgtctccgagaacttaattgctcctgatcttccgtggcacaagcatcatccgaaaaaatgccatcagtttatctttacatccctaatattattgggtatttcaggatcatcataaatttcaaagcttttgctatttgctattccaacaaggccctctttgctatcctttacttcatcagttttgtccttgatggcgtggatggttggtttgctcggaagtttaatcaagcatcaacatttggagctgtgttggacatggttacagatagggttagcactgcttgcttgttggcccttctctcccaattttacaggcctggcttagtcttcttgatactgcttgggttggatatcacaagccactggtttcaaatgtacagttctttcttgtcaggtaagactagccacaaggatgtaaagcacacaggcaattggcttctgaaattatattacgggcacaggccgttcatggccttctgttgtgtttcttgcgaggttttgtatattatcctctttctctttgctgatgagaagtcgacaagcttgcttagtgtatgcagaggtatcctgaatcaaagccccctcattgtcttggtgtttgtttccactctaattggctgggcagtgaaacaacttaccaatatcattcagatgaaaactgctgcagacgcatgtgtcatgtatgatctgaagcgcagcaagtaaagcatgaaggcaccggttttgttcagtttgtattgatattatccaaggaaaattcccgtgaggcttgtacaccatgattcatacatacagtggctacttcttgtgtgccttgacatctttctgactatgcttatctgttgggaagagacggcaacttgctgtgggaagaacataaagaaaacagaggagacaaacgatttacggagaaagtataggctgttaagttgtttgtcagtgtttgttcactatatagttggatgcagagcatgaccttttgttagctggagtggccttttgagtcgatctgaacgatgtttacaagctgcatttttcagagtccaagaatatatgaagtttttgaattgcaaaatttattcttccctgagagggttaaatagttgcctttagcgtgcactatcaaataggcatctgacttttttgttatcttaccttgtattccttacaattatctgatttttctggttatcttgccttgtgtgccttacaattatctatcggataatttgtttttt

SEQ ID NO: 2993 - DNA, 2151 bp, Zea mays
caacttttaaaagactgacaaaaaaaaattaccactagggcaatgggaaaaaaagcttcaattgtggataaaaaagaaatgatttttatgaggcaggacttataataataaaattaggtacaagcggaataaaaaccgaaaaaaaacgtgtcatggcaaaagaatgaaaaaagaacgagagatacaaaaaagagaagtcgtgcgttcacaccctgtttgccgttttctccctttacacgctcgattccccccgccgtttccacgggggccaggtgcctgcattactgggtccgggcctagcgtcagcgcaaccgaacacgccggcgaccgctgccgcccttctcccagctgcccaggtcttcgtcgggccctttgcctgcggcgtcggcgacgagcgcctgccacaccaggaatcccgttaagtttatttatgctcaccaatttaagggcagaacttacggacctcaagctcttggttactcctgatcttctctaggcgactaggcacaattgccctctggcaaaatgccatcagtttatctttacatccctaacattatcgggtattttaggatcatcataaatttcattgcatttgcggtttgctattccaacaaggctctctttgctatcctgtacttcatcagctttgtccttgatggtgtggatggttggtttgcaaggaagttcaatcaagcatcaacctttggagctgtgttagacatggttacagatagggttagcactgcttgtttgttggcccttctctcccagttttacagacctggtttagtcttcttgatattgcttggattggatattacgagccactggtttcaaatgtacagttctttcttgtcaggtaagactagccacaaggatgtaaaacacacaggcaattggcttctgaaattatattatgggtacaggccattcatggccttctgctgtgtttcttgtgaggttttatatattttcctgtttctctttgctgatgaggagtcaacaagcttgcttagtgtatgcaaaggcatcctgaaccaaagtcccgtcgttatcttggtgtttgtttccactctagttggctgggcagtgaagcaagccaccaacgtcatccagatgaaaactgctgcggacgcatgcgtggtgtatgatctgaagcgcagcaaatgaagcatgaaggcagcttcacggtttagtatcgacatatccaagggaaaactctgcgagggggcgggctacgtcttgcgtgccttgacatctttctgatgatgcggtcatatgtgggaccaggggatgacatgccgtggccaatgcaaacaattgttttgtgaaagcagcggccgttaagttgttgtcagtgtgagagtggtgatgcgatcatgatcctttttacctagagtagctcccctttgtgttagcctgaacgatgttttgcaagccgcatgttccgaactctaggattatttggattacaaaacttacatattccatcctcaaggccagttccctcgagagttcgatagttacttatagtcgctggaataggcactagctactgttcgaatgatttcccttttgctccttaagcatcctttgggtcagctttatcgataaaatttctttttttatgtgacatccctttgcttagaaggggattgaatggaataggagaggattgaggaagaaataaactaatttatctctcaatctcttcgaatccctttctaactaaataaactgctttaaatgataaacaatacctctatcctaaaatataataattcgttttagattaattatataccaatggagtttgtatatatatctatattaattatcatttgaatgtatatgaacagaaaaaatgggctagaagtaactatattttaggagaacggaggaagtaccaagttaacattagtttgaagggatataacgcttttcctgctgtgcagctaagagcctgaggccgacggcaatactgtgttgttcatgtgctgcctgcctcgcgcgctgagaccaactatttatgctatgaggacataaaaccgtcctctctcacacagtgccaatcatcacactcgtggattgtgtggtgacgtgtagacaaatatacgtcaagttgcattctcacaactagggtcagat

SEQ ID NO: 2994 - DNA, 1205 bp, Hordeum vulgare
gattctgcaggaatctcgggaaggatacccatttagtaagaaactgccagtcttctacaagttggtacctctgaccttcgatggcgcagcctccagctaaaaagacgctgtcggtgtacctgtacatccctaacatcattggatatttcaggattatcataaacttcattgcatttgctgtgtgctataccaacagaacactctttgctatcctatacttcttcagcttcttctgtgatgggttggatggttggtttgccaggaggttcaatcaagcatcaacatttggagctgtgttggacatggtaacagatagggttagcactgcttgtttgttggcgcttctctcgcagttttacagacctggcttggttttcatactgttacttgggttggacatcacgagccactggtttcaaatgtacagttctttcttatcaggtaaaactagccacaaggatgtgaaacacacaggcaatgggcttctgaagttatattatggatatcgtccgttcatggcgttctgttgtgttgcttctgaggttctgtacattatcctgtttctctatgctgatgagaagtccacaagcttgcttaatacgtgcagaggtattctgaaggaaagtcccctagttgtcttcatgtttatttcaactctaattgggtgggcactcaaacaagtgatcaatgtcatccagatgaaaacagctgcagatgcttgtgtggcgttcgattcgaaaagaggcaagtgagcaaaaatggaccaccatggtttagttttcatttgcgttggcatatccaagaaaaacataccgtcagacgggcttggttgtaaggcacatatggtagctccttgatgtatcttaacatgtctccggtccgggggttggacattctgggggaaaagcagcatgtggaaagaaaactagaaaagggagaactgcttcttaacaaaaacacagggatcgacaagttctgtattgtgtacgtcttttctacatgatgattcgatcttgtttgcgtagcagcgtggtgatttggttactagtacttggctagaaatgataagggttcctccctcctgttgtaccggtgtacatgccaacatttacatggttgttttctttgtggtttcagattggctccatttgcgtatgttgtctgggagttatttttctcactctgcatggaagtttggttgggaa

SEQ ID NO: 2995 - DNA, 1317 bp, Secale cereale
ccgctccccacccctgccctcccgacgcgccgctccccacccctgccgctcctcccgaggcgccgccggaccgccgctcctccccgctccgccgtccaccgtaccgcccccgccgcgcggccctccctcgccgacggctctccggtggtccagcggcggcggcgacgacgacgcggtcgggcgctgctggtgaccacgacgtcgtcgagaccccgcggcatctcgagagggataagtaaggaaccaccagttctctagcagtcggcacctctgaccttcaatggcgcagcctccagctaaaaaggcgctgtcggtgtacctgtacatccctaacatcattggatatttcaggatcatcataaacttcattgcatttgctgtgtgctataccaacagaacactctttgctatcctgtacttcttcagcttcttctgtgatgggttggatggttggtttgccaggaggttcaaccaagcatcaacatttggagctgtgttggacatggtaacagatagggttagcactgcttgtttgttggcgcttctctcgcagttttacagacctggcttggttttcatactgttacttggattggacatcacaagccactggtttcaaatgtacagttctttcttatcaggtaagactagccacaaggatgtgaagcacacaggcaatgggcttctaaagctatattatggatatcggccgttcatggcgttctgttgtgttgcttctgaggttctgtacattatcctgtttctctatgctgatgagaagtccacaagcttgcttaaaacgtgcagaggtattctgaaggaaagtccccttgttgtcttcatgttcatttcgactctaattgggtgggcactcaaacaagtgatcaatgtcatccagatgaaaacagctgcagatgcttgtgtggcgttcgattcgaaaagaggcaaatgagcaaaaaaggaccatgttttagttttcatttgcgtgggaatattcaacaaaaacataccgtcaggcggggcttggttgtaaggcacatatggtagctccttgatgtatcttttaacatgtctggtccgagggtcgacattctgggggaaaagcagcgtatggaaagaaaagggggaactgctttttaacaaaaacacaggatcgacaagttctgtattgtgtatgtcttttctacatgatgattcgatctttctttgcgtagcagcatggtgctttggttacactagtactaggccagaaatgatgccggttcctccctcccattgtactggtgtacatttacttggttgtttccttcgtggttt

SEQ ID NO: 2996 - DNA, 1674 bp, Secale cereale
atagaccgagagctgcaatttgcacaagcgatggggattggggataacagcgtacgagtacttgagatttgagatctcaccaaagcgagttattcccttgatagaaaaagaaaagagaaaagcgggggtcaagaaagaaggaagaggaaaaaagaacgagccgccttgctcgcctgtcacgaccttagccgcgtcccctctcgagtcctcgcccccctgcctcgccgcttccaccgtgctcctcctcccaccgccgctccccaccctgccctcccgacgcgccgctccccactcctgccgctcctcccgaggcgccgccagaccgccgctcctccccgccccgccgaccaccgtacccgcccccgccgcgcggccctccctcgccgacggctctccggtggtccagcggcggcggcgacgacgacgcggtcgggcgctgctggtgactacgacgtcgtcgagaccccgcggcatctcgagagggataagtaaggaaccaccagttctctagcagtcggtacctctgaccttcaatggcgcagcctccagctaaaaagacgctgtcggtgtacctgtacatccctaacatcattggatatttcaggatcatcataaacttcattgcatttgctgtgtgctataccaacagaacactctttgctatcctgtacttcttcagcttcttctgtgatgggttggatggttggtttgccaggaggttcaaccaagcatcaacatttggagctgtgttggacatggtaacagatagggttagcactgcttgtttgttggcgcttctctcgcagttttacagacctggcttggttttcatactgttacttggattggacatcacaagccactggtttcaaatgtacagttctttcttatcaggtaagactagccacaaggatgtgaagcacacaggcaatgggcttctaaagctatattatggatatcggccgttcatggcgttctgttgtgttgcttctgaggttctgtacattatcctgtttctctatgctgatgagaagtccacaagcttgcttaaaacgtgcagaggtattctgaaggaaagtcccctcgttgtcttcatgttcatttcgactctaattgggtgggcactcaaacaagtgatcaatgtcatccagatgaaaacagctgcagatgcttgtgtggcgttcgattcgaaaagaggcaaatgagcaaaaaaggaccatgttttagttttcatttgcgtgggaatattcaagaaaaacataccgtcaggcggggcttggttgtaaggcacatatggtagctccttgatgtatctttaacatgtctccggtcggagggtcgacgttatggggcaaaagcagcatgtggaaagaaaacggagaactgctttttaacaaaaacacaggatcgataagctctgtattgtgtatgtcttttctacatgatgattcgatctatctttgcgtagcagcatggtgctttggttacactagtactaggccagaaatgatgacggttcctccctcccattgtactggtgtacatttacttggttgtttcctttgtggtttcggatttgctccatttgcataagctgtccgtgggtaatttatttcctcctctaattcgtgcattagttaaggttttgtttaggttaaactttttctcgtatag

SEQ ID NO: 2997 - DNA, 1340 bp, Triticum aestivum
cggcgacgacgcggtcgggcgctgctggtgaccacggcttcttcgaggccccgcggaatctcgagaaggatacattccaagtgaggaaccaccagatttttagcagttggtacctctgaccttcaatggcgcagcctccagctaaaaagacgctgtcggtgtacctgtacatccctaacatcattggatatttcaggatcatcataaacttcattgcatttgctgtgtgctataccaacagaacactctttgctatcctgtacttcttcagcttcttctgtgatggcttggatggttggtttgccaggaggttcaatcaagcatcaacatttggagctgtgttggacatggtaacagatagggttagcactgcttgtttgttggcgcttctctcacagttttacagacctggcttggttttcatactgttacttgggttggacatcacaagccactggtttcaaatgtacagttctttcctatcaggtaagactagccacaaggatgtgaagcacacaggcaatgggcttttgaagttatattatggatatcggccgttcatggcgttctgttgtgttgcttctgaggttctgtacattatcctgtttctctatgctgacgcgaagtccacaagcttgcttaatacgtgcagaggtattctgaaggaaagtcccctcgttgtcttcatgttcatttcaactctaattgggtgggcactcaaacaagtgatcaatgtcatccagatgaaaacagctgcagatgcttgtgtggcgtacgattcgaaaagaggcaagtgagcaaaaaggaccatgttttagttttcatttgcgcgggcatattcaagaaaaacataccgtcaggcgggcttggttgtaaggcacatatggtagctccttgatgtatcttttaacatgtctccggtccgagggtcgacattctggggggaaagcagcatgtggaaagaaaagggagaactgcttttttaacaaaaacacagggatcgacaagctctgtattgtgtatgtcttttctacatgatgattcgatctttctttgcgtagcagcctcgtgctttggttactagtactaggccagaaatgatgatggtgcctccctcccgttgtaccagtgtacatgccaacatttacttggttgttttctttgtggtttgtaagctgcctgggaattgtttttcctcattctgcatgaaagtttgcttggaaattttctttaaaaatcgtgggttccaaacatgccacagtcaactcaatgcatgcctagtttccatttattggtattaagtactcccttggttcactattattataatatgttctaaa

SEQ ID NO: 2998 - DNA, 1126 bp, Avena sativa
cggcttccaaggaatcccgagaaggatactcatctcatttaaggagctgccagtttactagctgttggtacctcctgacctcaatggcgacgccgtcagctaaagaggggccatcggtgtacctgtacatccctaatctaattggatatctcaggatcatcatgaatttcattgcatttgctgtgtgctattccaacaggacactctttgctattctgtacttcttcagcttcttctgtgatggcttggatgggtggtttgcccggaagtttaatcaagcatcaacatttggagctgtgttggacatggtaacagatagggttagcactgcttgtttattggcgcttctctcacagttttacagacctggcttggttttcatactgttacttgggttggacatttcaagccactggtttcaaatgtacagttctttcttatcaggtaagactagccacaaggatgtgaagcacacagggaatgggcttctgaaattatattacggatatcggccattcatggccttctgttgcgttgcttctgaggttctgtacattatcctctttctctttgctgatgagaagaacacaagcttgctcagtgtgtgcagaggtattctgaaggaaagtccccttattgtcttcatgttcatttcaactctaattgggtgggcactgaaacaagtgatcaatgtcatccagatgaaaacagctgcagatgcttgtgtcgtgtatgatttgaaaagaggcaagtgagcaaaaaaggaccgatgtttagttttttatttgtgttggcaacttggcatagccaagaaaaacataccgtcaggcgggcttggttgtaaggcacatatggtagctccttgatgtatatctttaacatgtctctcgtccgagggtcgacacgctatgggtaaagcagcatgatgaaaagaaaaagggcgaaatgcttttagggaaaagcaaggagtttggggttggcaagttctgtaatgtgcatgtctttttctacatgattcgatctttctttctgtataccagcgtgtgatgctttgtggccaggcagaaacgatgatagtgcctacctcttgtactggtccaccgacaacatttacttgcttgttttg

SEQ ID NO: 2999 - DNA, 1532 bp, Brachypodium distachyon
tggccgtcggaaggtgctccgaagaacaggcaatcagcttcgttggtcgaccacggacgtaaacacttcagtgttcttggcttctgcaggcgttaggaatcagaggagtccggagggttaatcatgtcttaaaaaaaaggagagaacaacggaagcagcacccaatgacccaagctcgttgttggcccagaaggtcccttctcccagcgtgttccttcccgcgccttcccccctcccgcctctccgggagctctcatctccggcgaccgactgccgcgccatcttccctcagatcaacgaacaactcatcgccccttgctaccataccgacggccaccccgtcctcttcgctcttcctttcgggaggcctcggcagatctacggaggcggcgacgctcttcctcggggggccagtaccctaccgccggtcttgcttttccttggcggcccactctagcgccggtttaccctggaatcttgatcaggatgctgcagctatctctgtaagtaaggaacggtcagtattctggcagtcagtacccgacctttcaatggcacggccatctgctggaaaaacgcaatcagtctatctgtacattcctaatatcatcggatatttcaggatcatcataaacttcattgcatttggtgtgtgctattccaacagaccactcttcgctgtactgtacttcttcagctttttgtgtgatggcttggatgggtggtttgcacagaaattcaatcaagcatcaacatttggagctgtgttggacatggtaaccgatagggttagtacggcttgcttattggcgcttctctcccagttttacaggcctggcttagttttcttgatgttgcttgggttagacattacaagtcactggtttcaaatgtacagttctttcttatcaggtaagagtagccacaaggatgtagaagacaaaggcaattggcttctgaaattatattacagatatcggccgttcatggctttctgctgtgttgcttctgaggttctgtacattgtcctttttctctttgctgatgagaagttcaaaagcttgctttatgtatgcagaggtattatgaagcaaagtcccctcattatcttggtgttcgttgcaagtctagttggttgggcactgaaacaagtgatcaatgtcattcagatgaaaacagctgctgatgcttgcgttatgtttgatccgaagtgaggcaagtgagcagaaaggaccgaggttccgttcttgtttttccaggcatatccaagaaaatcatactgtcaggcatagggcacatataacctgttcatgtatcttcaacatgtctaagatccaagggtctgacgtattgtggaaaagcagcatgaaaattaaaagggagaaattatttgaggaaatatgtaatctgtatgtcttttctacattgatgacgattctatgtcagcgtgctgtttacttaccagccagcaaatacaggaagtttgtgctggcccggtcaagccggatggtggctaccactctacatggtca

SEQ ID NO: 3000 - DNA, 1214 bp, Lolium multiflorum
cgggtggcgctggtgactgcggcctcaccggtacccgcggaatccagagaaggacactcatctcatttaaggaactgccagtcttctagcagctggtacctcctggcttcaatggcgcagccgtcagctaaaaaggcaccgtcggtgtacctgtacatccctaatctcattggatacctcaggatcatcatgaatttcattgcatttgctgtgtgctattccaacaggacgctctttgctatcctgtacttcttcagcttcttctgtgatggcttggatggttggtttgcccggaagttcaatcaagcatcaacatttggagctgtgttggacatggtaacagatagggttagcactgcttgtttattggcgcttctctcacagttttacagacctggcttggttttcatactgttacttgggttggacatttcaagccactggtttcaaatgcacagttctttcttatcaggcaaggctagccacaaagatgtgaagcacacagagaatgggcttctgaaattctattacggatatcggccattcatggccttctgctgtgttgcttctgaggttctgtacattatcctctttctctttgctgatgagaagaatacaagcttgctcagtgtgtgcagaggtattctgaaggaaagtccccttattatcttcgtgttcatttcaactctaatcggttgggccctaaaacaagtgatcaacgtcatccagatgaaaacagctgcagatgcttgtgttgtgtatgatttgaaaagaggcaagtgaggaagcaggaccaggtttagtttttatttgtgttggcaacttggcatgtccaagaaaaacatacggtcaggcgggcttggttgtaaggcacatatggtagctccttgatgtatctcttaacatgtctctggtctgggggttaacacgctatgggaaaagcagcgtgaaaagaaaagggagaaacgctaaaacatggagattcagattgacaggttctgtaatgtgtacatcttttctatgtggtgaattcgatctttctttctttccgtaccagcatggtgctttgtttccagtcagaaacgatgatagtgcctacctctcattgtactggtctatcgacaacgtttagttggttgttttgctggagatttgatcctgttacaaaagctgattggatttgcttttttccccttctgtaaaacccccgggct

SEQ ID NO: 3001 - DNA, 951 bp, Festuca arundinacea
ggcacgaggcacagccatcagctaaaaagggaccatcggtgtacctgtacatccctaatctcattggatacctcaggatcatcatgaatttcattgcatttgctgtgtgctattccaacaggacactctttgctatcctgtacttcttcagcttcttctgtgatggcttggatggttggtttgcccggaagttcaatcaagcatcaacatttggagctgtgttggacatggtaacagatagggttagcactgcttgtttattggcgcttctctcacagttttacagacctggcttggttttcatactgttacttgggttggacatttcaagccactggtttcaaatgcacagttctttcttatcaggtaagactagccacaaggatgtgaagcacacagagaatgggcttctgaaattatattacggatatcggccattcatggccttctgctgtgttgcttctgaggttctgtacattatcctctttctctttgctgatgagaagaatacaagcttactcagtgtgtgcagaggtattctgaaggaaagtccccttattgtcttcgtgttcatttcaactctaattgggtgggcactgaaacaagtgatcaatgtcatccagatgaaaacagctgcagatgcttctgttgcgtatgatttgaaaagaggcaagtgagcaaaaagggccccaggtttagtttttatttgtgttggcaacttggcatgtccaagaaaaacatacggtcaggcgggcttggttgtaaggcacatatggtagctccttgatgtatctcttaacatgtctctggtctgggggttaacacgctatgggaaaagcagcgtgaaaagaaaagggataaacgctaaaacatggagattcagattgacaggttctgtaatgtgtacatcttttctacgtggtgaattcgatcaaaaaaaaaaaaaaaaaa

SEQ ID NO: 3002 - DNA, 1456 bp, Setaria italica
aggaaggcagggtggagagagaaagagaaacagcgggaggaggcgcacgaggcaatttatagggaggaggggccgggcctccctgagtagcccgggccggccaatctctcgtctctgcggcggcggcgccagggatgggtgactccggcggctccgtcgtgtccgtcgacgtcgagcgcatctccttcggcggcaaggaacaccatatacagacaaatcacggacctgtatctgttgcagtctatggtgaccatgacaagcctgcccttgttacttacccagatattgctctaaatcatatgtcttgcttccaaggattattgttctgtcctgaagctgcttcgctgctgcttcacaatttttgcatttaccatattagccccccaggacatgagttaggagctgctccaatttcgccgaatgctcctataccctctgttgatgacttggcagatcaagttgcagatgtcctcgatttctttggattaggctctgtcatgtgctttggtgtcactgcaggtgcctacattcttactctgtttgcgtcaaagtatagggagcgtgtgttaggtcttatccttgtttcacctctatgtaaaggccccacttggactgagtggttatacagtaaggtgacttccaatttgctgtattattatgggatgtgcggattggtgaaggagtgcctacttcagcggtacttcagcaaggaagtgcgagggttctctgaattacccgaatcagatatagtgcaggcttgtaaaagcttgctagatcagcggcagagcatgaatgtatggcgctttgtacagacaatgaatgagagatacgacttgactgaacaactaaagcagcttcagtgtagaaccctgatttttgttggtgagaattctcagtttcacactgaggctgttcacatgacatcaaaactcgacaggagatattgtgctctagttgaggtccaagcatgcgggtcactcgtaaccgaggagcaaccgcatgcaatgcttattccgatggagtacttcttcatgggatacggcctgtacaggccgagccagctcgactgcagcccgcgcagccccctgagcccattctgtatatcgccagagctcctgtcgcccgagagcatgggagtgaagctaaagccgatcaagacacgagtcaggcttgaagtgtagaagaagtgagtaaaggcggtggtgcttagggcagacatggtaagagtttaggctaacaagaggggggggggggggggggtctgtttaaaattttggaggtaaagtgaagtgaaatacctgttatactaccatgtacatataggaaaatgctaggttggtgagcttgggtgggttgggggcggttcttgtattctttgatttgtagcctgatgaaacctgtaaatcggtatacattgtttatcaaaggaaagcaaaggaaataataatagcggaag

SEQ ID NO: 3003 - DNA, 1639 bp, Setaria italica
cttcattccgtcgtttataagcgacgccaaggtaggcgaggaaggcagggtggagagagaaagagaaacagcgggaggaggcgcacgaggcaatttatagggaggaggggccgggcctccctgagtagcccgggccggccaatctctcgtctctgcggcggcggcgccagggatgggtgactccggcggctccgtcgtgtccgtcgacgtcgagcgcatctccttcggcggcaaggaacaccatatacagacaaatcacggacctgtatctgttgcagtctatggtgaccatgacaagcctgcccttgttacttacccagatattgctctaaatcatatgtcttgcttccaaggattattgttctgtcctgaagctgcttcgctgctgcttcacaatttttgcatttaccatattagccccccaggacatgagttaggagctgctccaatttcgccgaatgctcctataccctctgttgatgacttggcagatcaagttgcagatgtcctcgatttctttggattaggctctgtcatgtgctttggtgtcactgcaggtgcctacattcttactctgtttgcgtcaaagtatagggagcgtgtgttaggtcttatccttgtttcacctctatgtaaaggccccacttggactgagtggttatacagtaaggtgacttccaatttgctgtattattatgggatgtgcggattggtgaaggagtgcctacttcagcggtacttcagcaaggaagtgcgagggttctctgaattacccgaatcagatatagtgcaggcttgtaaaagcttgctagatcagcggcagagcatgaatgtatggcgctttgtacagacaatgaatgagagatacgacttgactgaacaactaaagcagcttcagtgtagaaccctgatttttgttggtgagaattctcagtttcacactgaggctgttcacatgacatcaaaactcgacaggagatattgtgctctagttgaggtccaagcatgcgggtcactcgtaaccgaggagcaaccgcatgcaatgcttattccgatggagtacttcttcatgggatacggcctgtacaggccgagccagctcgactgcagcccgcgcagccccctgagcccattctgtatatcgccagagctcctgtcgcccgagagcatgggagtgaagctaaagccgatcaagacacgagtcaggcttgaagtgtagaagaagtgagtaaaggcggtggtgcttagggcagacatggtaagagtttaggctaacaagaggggggggggggggggggtctgtttaaaattttggaggtaaagtgaagtgaaatacctgttatactaccatgtacatataggaaaatgctaggttggtgagcttgggtgggttgggggcggttcttgtattctttgatttgtagcctgatgaaacctgtaaatcggtatacattgtttatcaaaggaaagcaaaggaaataataatagcggaaggtgaggtgttcccgatcattagctgtctcttcccctttgcctgtcttgaagggaagaagaatgttcttgtgagctggacttgtgaactcctaaaatcctcgtttatgccattattctggctgaagctattaggatatgattggcg

SEQ ID NO: 3004 - DNA, 1726 bp, Panicum virgatum
gaagagaggggagagagaaagcgacgccgaggagagagaaaccgtgcgcctactccgtcttccttccttccgtcgtttataagcgacgtcgaggcaggtgagggaggcggggtagagagagaaagctcgcacgaggcgatttatagggaggcgagagaggaggggccgggcctccctgagtagccccggccagccaatctctctcgcctgcggcgtcgagcgggggcggcgccagggatgggggactccggcggttccgtcgtgtccatcgacgtcgagcgcatctccttcggcggcaaggaacaccatatacaaacgaattacggacctgtatctgttgcggtttatggtgaccatgacaagcctgctcttgttacttacccagatattgctctaaaccatatgtcttgcttccaaggattattattctgccctgaagctgcttcactgctgcttcacaatttttgtatttaccatattagccccccaggacacgagttaggagctgctccaatttcaccaaatgctcctataccatctgttgacaatttggcagatcaggttgcagatgtccttgatttctttggattaggctctgtcatgtgctttggtgtcactgcgggtgcctatattctaactctgtttgcatcaaaatatagagagcgtatattaggtcttatccttgtttcacctctatgtaaaggccccacttggactgagtggttatacagtaaggtgatgtccaatttgctgtattattatgggatgtgtgggttggtgaaggagtgcctacttcagcgctacttcagcaaggaagtgcgagggttctctgaactacccgaatcagacatagtgcaggcttgtaaaagcttgctagatcagcggcagagcatgaacgtatggcgctttgtacagacgatgaatgagagatacgacttgactgaacagctgaagcagcttcagtgtagaaccttgatttttgttggagagaattctcagtttcacagcgaggctgttcacatgacatcaaagctcgataggagatactgtgctctagttgaggtccaagcatgcgggtcactcgtaaccgaggagcaaccgcatgcaatgcttataccaatggagtacttcttcatgggatacggcttgtacaggccgagccagctcgactgcagcccgcgcagccccctgagcccattctgtatatcgccggagctcctgtcacccgagagcatgggagtgaagctaaagccgatcaagacacgagtcaggcttgaaatgtaggaaaggtgaataagggggtggtgcttagggctgacatggtgagagtttaggctaacccgtgggtctgtcttaattttttgagctaaagtgaagtgagatacctgttatactgccatgtatatataggaatgctaggttggtgagcttgggcgggttggggcggttcttgtattctttgatttttagactgatgaaacctgtaaattggtatacattgtttatcaaaagaaagcaaaggaaataataatagcggaaggtgagttgttcccaatcatttgctgtctctttcccttccctgtcttgaaggggagaagaatgttcctgtgagctggtcttgtgaactcctagattcagtgtaaaggtttatgccatcgttctggctgaagctactagcatatggttggcttgtcgcgttgtttttcaataaagaatgtcctcttca

SEQ ID NO: 3005 - DNA, 1898 bp, Panicum virgatum
ctggctagtctagggttggactgctttacacttccggtaacatgccaaatggagcgagtaatcaaagcagaccgggggctgcgctgcaattacaggaaagtacagggtcggcgaagtgaaatatagggcagcgaaagtcctccgcccccaaaggctggaagaggagaaaagaggggagggagaaggggacgccgaggagagagaagccgtgcgcctgctccgccttcctcccttccgtcgtttataagcgacgccgaggcaggcgaggaaggtggggtagagagagaaagctcgcacgaggcgatttatagggaggcgagaggaggggccgggcctccctgagtagccccggccagccaatctctctcgcctgcggcgtcgagcgggggcggcgccagggatgggagactccggcggctccgtcgtgtccattgacgtcgagcgcatctccttcggcggcaaggagcaccatatacaaacaaattacggacctgtatctgttgcggtgtatggtgaccatgacaagcctgctcttgttacttacccagatattgctctaaaccatatgtcttgcttccaaggattattattctgccctgaagctgcttcactgctgcttcacaatttttgcatttaccatattagtcccccaggacacgagttaggagctgctccaatttcgccaaatgctcctataccatctgttgacgatttggcagagcaggttgcagaagtccttgatttctttggattaggctctgtcatgtgctttggtgtcactgctggtgcctatattctaactctgtttgcatcaaagtatagggagcgtgtattaggtcttatccttgtttcacctatatgtaaaggccccacttggaccgagtggttatacagtaaggtgatgtccaatttgctgtattattatgggatgtgtgggttggtgaaggagtgcctacttcagcgctacttcagcaaggaagttcgagggttctctgaattacctgaatcagacatagtgcaggcttgtaaaagtttgctagatcagcggcagagtatgaatgtatggcgctttgtacagacaatgaatgagagatatgacttgactgaacagctgaagcagcttcagtgtagaaccttgatttttgttggagagaattctcagttccacagcgaggctgttcacatgacatcaaagctcgataggagatactgtgctctagttgaggttcaagcatgcgggtcactcgtaaccgaggagcaaccgcatgcaatgcttataccaatggagtacttcttcatgggatacggcttgtacaggccgagccagctcgactgcagcccacgcagccccctgagcccattctgtatatcgccggagctcctgtcgcctgagagcatgggagtgaagctaaagccgatcaagacgcgagtcaggcttgaaatgtaggaaaggtgaataagggggggtggtgcttaggctgacattggtgagagtttaggctaaccggatctgtctaaatttttggaggtaaagtgaagtgagatacctgttatactgccatagtgccatgtatatataggaaatgctaggttggtgagcttgggtgggttgggggcggttcttgtattctttgatttgtagtccgatgaaacctgtaaattggtatacattgtttatcaaaggaaataataataggggaaggtgagttgttcccaatcatttgctgtctcttccccttttccctgtcttgaagggaagaagaatgttcctgtgagctggacttgtgaactcctagattcggtgtatttatgccatcgttctggctgaagctcttagcatatgtatttgcattgtttttcaataaagaatgtcctgtacagatactggttcccaaaga

SEQ ID NO: 3006 - DNA, 1618 bp, Oryza sativa
gcgaatttagcagcaaccctccctcgtcaagggaggaaagaagaagccgacgacgacgacgacgaagagagagaaattcagagaagctcgctgctcttcgtttataagcgacgccaagacaagtcgggtggtagagagagaaagtgagagtagaaagggaggacatttgtagtactattccgtaggagagagagacaagaagaagaagaagaagaagagagagagagagagagagaggaggcggcccgtccggcgtcgaggtgggcggcggcggatgggggactccggcggctccgtcgtgtcgatcgacgtggagcgcatctccttcggcggcaaggaacatcatatacataccaatcatggacccgtatctgttgcggtgtatggtgaccatgacaagccggctcttgttacttatccagatattgctttaaatcatatgtcttgcttccaaggattgctcttctgccctgaagctgcttcattgttgcttcacaatttttgcatttaccatatcagccccccaggacatgagttgggggcagctccaatttcgccaaatgctcctataccatctgttgatgatttggctgatcaggttgcagatgttctcgatttctttgggttaggttccgtaatgtgcttaggtgtcagtgcgggtgcttacattcttactctcttcgcagcgaagtatagggatcgtgtactaggtcttattcttgtttctcccctatgtaaacctcccacgtggactgagtggttttataataaggtggcatccaatttgttatattactatgggatgtgtggactggtgaaggagggcttactgcagcggtacttcagcaaggaagtgcgggggtgctctgatttacctgaatctgacatagtgcaagcttgtagaagtttgctagatcaacggcagagcatgaatgtgtggcgcttcgtacagacaatgaacatgagatatgacttgacagaagacctgaagcagcttcagtgtaggacccttatttttgtcggcgagtactctcagttccatactgaggctgttcacatgacatcaaagctggacaggagatactgtgctctagttgaggtccaagcatgtgggtcgctcataacggaggagcaaccacacgcgatgcttatacccatggagtacttcttcatgggttatggcctgtacagaccaagccagttggactgtagcccgcgcagccccctcagcccattctgtatatcacccgatctcctgtcacccgaaagcatgggagtaaaactaaagccaatcaagacaagagtcaggcttgaagtgtagcatagcacacaggtaaataagggtggtgcagaggggtgtcgcttagggctgacatggtgtgagtttaggctaacctgatggtcggtttactgagttataattttttggtgggtaaaacaagataatttttatactgtcatgtagatataggaaatgctaggttggtcaggtctggtggggtggggttgtattccattaatttgtagccataaacctgtaaattgttacacattgtttatcaaaagcaaaggaaaataatagcagaaaggtgagctgttggtgatcattagatggtgc

SEQ ID NO: 3007 - DNA, 1319 bp, Saccharum officinarum
cggacgcgtgggcacgaggcaatttatagggaggaagaggagcggccgggcctgggcagagcaggccgggccagccatctctcctctgcggcgtccgatcggggcggcgcccgagatgggggactccggcggctccgtcgtgtcggtcgacgtcgagcgcatctccttcggcggcaaggaacaccatatacaaacgagtcatggacctgtatctgttgcagtgtatggtgaccatgacaagcctgcccttgttacttatcctgatattgctttaaaccatatgtcctgcttccaaggactattgttctgtcctgaagctgcttcactgctgcttcataatttttgcatttaccatattagccctccaggacatgagttaggagctgctccaatttcgccaaatgctcctacaccatctgttgacgacttggcagatcaggttgcagatgtcctcgatttctttggattaggctctgttatgtgctttggtgtcactgcaggtgcctacattctaactctgtttgcggcaaagtatagggagcgggtactaggtcttatccttgtttcacctctatgtaaaggccccacttggactgagtggttatacagtaaggtgacatccaatctgctgtattactatgggatgtgtgggttggtgaaggagtgcctacttcagcggtacttcagcaaggaagtgcgaggattctctgaattacccgaatcagacatagttcaggcttgtaaaagcttgctagatcagcggcaaagcatgaatgtatggcgctttgtacagacgatgaatgagagatatgacttgactgaacagctaaagcagcttcagtgtagaaccctgattttgtcggcgagaactctcagtttcacaccgaggctgttcacatgacatcaaagctcgacaggagatattgtgctctagttgaggtccaagcgtgcggatcactcgttaccgaggagcaaccacacgcaatgcttataccaatggaagtactttttcattggatattgcctggacaggcctatccagctggactggagcccgcccagtcccctgagcatgtgggttgaaactaaagccgatcaagacgcaagtacgcttgaagtggtacaaaagtaataagggattggtgctttagggctccggtaaaagttagctacttccggctgtcttatatttttgaaggttaagaaaaacctttatctgcctttttttagaaatttagttgggccttgcgggtcttactcttccaaactctttcttccttactactattctgactctttgcgtcttattcatgaatcgc

SEQ ID NO: 3008 - DNA, 1470 bp, Brachypodium distachyon
cgtgctgctccttcgtttataagccacgccaacagaggagagagagagagagagaggcgaacgtggcatttataggtggaggagaggggggaagaagagagggaggagcaggcccggcgtcgagggaggcggcgcgcggggatgggggactccggcggctccgtcgtgtcgatcgacgtcgagcgcatctccttcggcggcaaggaacatcatatacaaacaaatcatgggtctgtatctgttgcagtgtatggtgatcatgacaagcctgcccttattacttatccagatattgctttaaatcatatgtcttgcttccaaggattactcttctgccctgaagctgcttcactgctgcttcacaatttttgcatttaccatatcagccccccaggacacgagctgggagctgctccgatttcactgagtacacttatgccatctgttgatgacttggcggatcaagttgcagatgttcttgatttctttggattaggttctgttatgtgcttaggtgtcactgcaggtgcttacattctcactctctttgcggcaaagtatagggagcgtgtactaggtcttatactggtttcacctctatgtaaagctcccacatggactgagtggttctataataaggtggagtcaaatttgctgtattactacgggatgtgtgggttggtcaaggagtccttcctgcagcggtacttcagcaaggaagtacggggatgccctgaattaccggaatcagacatagtgcaggcttgtagaagttttctagaccagcggcagagcatgaatgtgtggcgatttgtacagacaatgaatgggaggcatgacttgacagaagagctgaagcagcttcagtgtagaactctgatttttgtgggcgaaaattcgcagttccacaccgaggcagttcacatgacatcaaagctcgatagaagatactgtgctctagtcgaggttcaagcatgcgggtcgctcgtaacggaggagcaacctcatgcaatgctcatacctatggagtactttttcatggggtatggtctctacaggccgagccagcttgactgcagcccacgcagccccctcagtccattttgcatatcaccggagctcctttcacccgagagcatgggggtgaagctaaagccaatcaagacacgagcgaggcttgaagtgtagcacaagtgaataaggtcagcacatgtgttatttagggctgacatggtgagagtttaggctaacaggtggatcggcgtagcaaggtgtttgggttaactttttggtggtaaagtgagatacttgttctagtggtcatgtagatagggaatggtaggttgggttggtggttctattcaattgatttctagcttttaaacctgtaaatttgtatacattgttgatcaacgcaaagggaaaataataataggggaaggtgagctgttcccaatcatttatatgtgc

SEQ ID NO: 3009 - DNA, 1423 bp, Brachypodium distachyon
gagagagaggcgaacgtggcatttataggtggaggagaggggggaagaagagagggaggagcaggcccggcgtcgagggaggcggcgcgcggggatgggggactccggcggctccgtcgtgtcgatcgacgtcgagcgcatctccttcggcggcaaggaacatcatatacaaacaaatcatgggtctgtatctgttgcagtgtatggtgatcatgacaagcctgcccttattacttatccagatattgctttaaatcatatgtcttgcttccaaggattactcttctgccctgaagctgcttcactgctgcttcacaatttttgcatttaccatatcagccccccaggacacgagctgggagctgctccgatttcactgagtacacttatgccatctgttgatgacttggcggatcaagttgcagatgttcttgatttctttggattaggttctgttatgtgcttaggtgtcactgcaggtgcttacattctcactctctttgcggcaaagtatagggagcgtgtactaggtcttatactggtttcacctctatgtaaagctcccacatggactgagtggttctataataaggtggagtcaaatttgctgtattactacgggatgtgtgggttggtcaaggagtccttcctgcagcggtacttcagcaaggaagtacggggatgccctgaattaccggaatcagacatagtgcaggcttgtagaagttttctagaccagcggcagagcatgaatgtgtggcgatttgtacagacaatgaatgggaggcatgacttgacagaagagctgaagcagcttcagtgtagaactctgatttttgtgggcgaaaattcgcagttccacaccgaggcagttcacatgacatcaaagctcgatagaagatactgtgctctagtcgaggttcaagcatgcgggtcgctcgtaacggaggagcaacctcatgcaatgctcatacctatggagtactttttcatggggtatggtctctacaggccgagccagcttgactgcagcccacgcagccccctcagtccattttgcatatcaccggagctcctttcacccgagagcatgggggtgaagctaaagccaatcaagacacgagcgaggcttgaagtgtagcacaagtgaataaggtcagcacatgtgttatttagggctgacatggtgagagtttaggctaacaggtggatcggcgtagcaaggtgtttgggttaactttttggtggtaaagtgagatacttgttctagtggtcatgtagatagggaatggtaggttgggttggtggttctattcaattgatttctagcttttaaacctgtaaatttgtatacattgttgatcaacgcaaagggaaaataataataggggaaggtgagctgttcccaatcatttatatgtgc

SEQ ID NO: 3010 - DNA, 1317 bp, Triticum aestivum
cccccggcgtcgaggacggcgatgggggactccggcggctccgtggtgtcggtcgacgtcgagcgcatctccttgggcggcaaggaacatcatatacaaacaaatcatggatctgtatctgttgcagtgtatggtgatcatgacaagcctgctcttgttacttatccagatgttgctttaaattatatgtcttgtttcgaaggattactcttctgccctgaagctgcttcactgctgcttcacaatttttgcatttaccatatcagccccccaggacacgagttgggagcagctccaatttcaccgaaaacacctgtaccatctgttgatgacttggcggatcaggttgcggatgttcttgatttctttggattaggttctgttatgtgcttaggtgccactgcgggtgcttacattcttactctctttgcagcaaagtgtagggagcgtgtattaggtcttgtacttgtttcacccctatgtaaagctcccacatggactgagtggttgtatagtaaggtggagtcaaatttgttgtattactatgggatgtgtgggttggtcaaggaaagcttactgcagcggttcttcagcaaggaagtaaggggatgctctgagtcacctgaatcagatatagtgcaggcttgtagaagtttgctagatcagcggcagagcatgaacgtgtggcagtttgtacagacaatgaacgggagatatgatttgacggaagagctgaagcagcttcagtgtagaacccttatttttgttggcgagaattctcagttccacgcggaggctgttcacatgacagcaaagctcgataggagatattgtgctctagttgaggtgcaagcatgcgggtcactcgtgacggaggagcaacctcatgcaatgcttataccgatggagtacttcttcatggggtacggcctctacaagccaagccagctcgactgcagcccgcgcagccccctgagcccatcttgtatatcgccggagctcctttcgcctgagagcatgggagtaaagctaaagccaatcaagacacgagcgcggcttcaagtgtagagcaagtgaataagggcggcataggtgtttgccatttagggtgaaatttctaggctaacatgtggatcggtgagatatttgtgttactactgttatatgtagataagaaatgataggttgggtaggttggcggtattctattccattccattgatttttatcctgtaaattgttatactccacttgctacattgtcgattaaagcaaaagggaaataatagggaaaggtgaagtgttcctttttttttt

SEQ ID NO: 3011 - DNA, 3135 bp, Zea mays
aacaatgagaggagagggagggaggccgcgcgcctggctcgtcctcccccttgcttccttccgtcgtttataagcgacggcaacacaggcgaagaagacggggggagaaaggggcgcacgaggcaatttatagggaggaagaggaggggccgggcctgagcagagcaggccggaccagccatctctcctctgaggcgtcgaggggaggcggcgcccgagatgggggactccggcggctccgtcgtgtcggtcgacgtcgagcgcatctcctttggcggcaaggtccgcacaacgtcccccccccctcctcctccgctccgattctttgtttctcggctgttccagcgctcccatgcgaattttcctctctcctgttcttgctagcgttgggtctcgtcctctcggctctcgccctctcggtgggtggtatctgctggtggtttgggagggagggagaagggattgggcccttgaaatttcgtgcccccccccccccccccggtcgtaatcgtatttcgtgtgtctcgtcgcattgcgtttccgtctctgttgcggcatttggtcggttcagcttcagcacgttctttcgttcttgctcatggattcatctttttttactgtggccctataaaacaatcagacagcagcccacgacgcggaatcttggcaaggccgcccccccaccccacccccgcttgctcttgcgacccgcgattcgtgaagctgcatttcgtctgctctccgctgaagcagcagcagcagccgcctaccttttagctccgtctccgagatggtggatccctcgcttccgcgtcaccaactcaccaccaccaccacgacgcctttatcacacgattttagcgctaaaggttctggcccggcgctcttgcgtgctgattcggtgttctaaccaccacttcccttgtgtctcttgtttcagccggggttcttaaactgtctagttcttatttgtttggtagtggttcaacgtggagcggtttcttactcggcgaacgaccgacagctttggaaattggccacctactgtgtttcttaattagtggagtaatataataaacaaaagcagtgcgcggcttttgtttttgctgttgctaattttaacaaaaaaaaaatgtttacctgaaactcgtttgccgtaggaagattctattcagtttggactagtgcctgagtaaacgggtgaaaaatattaagtgtagtttacaagccccttttcgatgtggatttctctaataacttccaatggtatgcttgtgagccggcagtcaaatcattcctcagtacaatatttattgtggagcaatcatctgcagttcgaatcgtgttatgcatcactcctgtttgctgtcctggaaggcaacggctgtggaaccatcacctttaggaccacttcatcatgatgaaactattgtattctccttctcttccggcagcatcttgtcagccttttagtattatatatatacatacatacagataaaacagagatccttccatcattaagtcatcacctttgcgtcatttgggagaaacacttgcctttcaagcgtcggtgaaggactgctaagtctgctcccctgaaacaagtattggaaatagcgactcacctaatgtccttcttgaccgggtttaaaggaccatttctctttgcatggcgtttctgggctgtacgaccacagcttccaccgacagcttagttgcagtatggattttggcacggaaagcgcatgacagcctaaccgttaagcattatatggatttaaatagctttactttggttgatgcactgctgggctacggtataacctagaacccacgtcttcaaatagactgtcatatggtgcatttaccaccctcgaaccatagatgatttggcagagatgtcttctgccggcatcagcggatgcgtgcctacaactgaacaccatatacaaacgaatcatggacctgtatctgttgcagtgtatggtgaccatgacaagcctgcccttgttacttatcccgatattgctttaaactatatgtcctgcttccaaggactattgttctgtcccgaagccgcttcgctgctgcttcataatttttgcatttaccatattagccccccaggacatgagttaggagctgctccaatttcaccaaatgctcctataccgtctgttgacgatttggcagatcaggttgcggatgtcctcgatttctttggattaggctctgttatgtgcttcggtgtcactgcaggtgcctacattctaactctgttcgcggcaaagtatagggagcgggtactaggtcttatccttgtttcacctctgtgtaaaggccccacttggactgagtggttatacagtaaggtaacatccaatctgctgtattactatggcatgtgtgggttagtgaaggagtgcctacttcagcggtacttcagcaaggaagtgcgaggattctctgaactacccgaatcagacatagtgcaggcttgtaaaagcctgctagagcagcggcagagcatgaacgtgtggcgcttcgtacagacaatgaacgagagatacgacttgtctgagcatataaagcggctgcagtgcagaaccctgatttttgtgggcgacaattctcagttccacacggaggccgttcacttgacgtcgaagctggacaggagatactgcgctctagttgaggtgcaagcgtgcggttcactggtaaccgaggagcagccgcacgcgatgcttataccgatggagtacttcctgatgggatacggcctgtacaggccgcctagccaggtggtggagtgcagcccgcgcagccccctgagcccgttctgcatttcgccggatctcctgtcacctgagagcatgggggtgaagctaaagccgatcagaacgcgagtcaggcttgaggtgtagcagagggctaggctaacttttgcaggtctgtgtttagtttttggaggtatagttatactgccatgtatatataaatatataggaaacgctgttctttgatttgtagcctgaaagaaaataatagcagaagtttgggtgtacagtctctctattatgccattatacccgctggtttggttgggtggcaggattagatgtggttccc

SEQ ID NO: 3012 - DNA, 1317 bp, Echinochloa colona
tgcgcaggtggggaagcaagccagcggcggccggagcattttggagagagaaagaaggggcggttggtgaaatccgagacggcaggagtgggagcgaggagaggaggggccacgccaacttgacagcagcgcccgtgcggtcggctgcggcggcggggatgggcgactccggcggctccgtcgtgtcggtggacgtcgagcgcatctccttcggcggcaaggaacatcatatacaaacaaaccatggatctgtatctgttgccatttatggtgaccatgacaagcctgctcttattacttatccggatattgccttgaaccatatgtcttgcttccaaggactactcttctgtcctgaagcagcttcattgctgcttcataatttttgcatttaccatatcagccccccaggacatgagttaggagctgccccaattttgccaagcacaccggtggcatctgtcgatgacttagcggatcaagttgcagatgtacttgatttctttggattggattctgttatgtgtttaggtgtcactgcaggcgcatacattcttactctatttgcaacaaagtacagagagcgagtcctagggcttatccttgtttcacctctatgtaaagctccctcatggtcggagtggttttataacaaggtaatgtcaaatttgttatattattatggcatgtgcaacgtggtgaaggatattttgttgcagcgctactttggcaagggagtacgtggatgctctaatgaacctgaatcagatatcgtgcaggcttgtagaagttttctagatcaacggcagggcatgaacgtgtggcggtttattcagacgatcaatgagagaaaagacttgacagaaaacctgaagcagctgcagtgcagaactcttatttttgttggtgagaattcccagttccatgctgaggctgttcatatgactgcaaaacttgataggcgatacagtgctcttgtggaggttcaagcttgtgggtcagttgtgacggaggagcagccacatgcaatgcttataccaatggaatacttcctcatgggatacggcttgtacaggccgagccagataaactgtagccctcgcagccctctgaacccattctgcatatcgccagagctcctctcaccggagagcatgggggtgaagctaaagccaatcaagactcgacccagccacaaagcgtaggaacagatgatgataaggtgtaggagctgatgtgtatcccttgggggggggggggggggggggggggggggggggggggggggggggggggggggggggggggggggggggg

SEQ ID NO: 3013 - DNA, 1322 bp, Pennisetum glaucum
cggcgtggggatgggcgactccggcggttccgtcgtgtcggtggacgtcgagcgcatctccttcggaggcaaggaacaccatatacaaacaaaccatggatctgtatctgttgccatatatggtgatcatgataagcctgctcttattacctatccagatattgccttgaaccatatgtcttgcttccaaggactactcttctgtcctgaagcagcttcattgctgctccataatttttgcatttaccatatcagccccccaggacatgagttaggagctgctccaattttgccaagcacaccggtggcatctgttgatgacttagcagatcaagtcgcggatgtacttgatttctttggattggattctgttatgtgtttaggtgtcactgcaggcgcatacattcttactctatttgcgacaaagtacagagagcgagtattaggacttattcttgtttcacctctatgtaaagctccctcatggtcagagtggttttataataaggtaatgtcaaatttgctatattattatggcatgtgcaatgtggtgaaggatattttgttgcagcgctacttcggcaagggagtacgtggatgctctacggaacctgaatcagatattgtgcaggcttgcagaagttttctagatcaacggcagggcatgaatgtgtggcgatttattcagactatcaatgagagaaaagacttgacagaaaacctgaagcagctgcagtgcagaactctaatttttgtcggtgagaactcccagttccatgctgaggctgttcacatgactgcaaagcttgatagccgatatagtgctcttgtggaggtacaagcttgcggatcggttgtgacggaggagcagccacatgcaatgcttataccaatggaatacttcctcatgggatatggcttgtacaggccgagccagataaactgcagccctcgcagccctctgaacccattctgcatatcacctgagctcctctcgcccgagagcatggggttgaagctaaagccaatcaagacacgacccaacctgaaagcgtaggaacagatgatgagaaggtgtaggaactgatgtgtatcccattgcatttttttgtggtgaagtgacatagctgtcgttaccttgatgtacatagacaagaggttaggttggtgagggtcgagttgggggttcaattccattgatttgtagccttaaacagatgtaaattgtcatagattatttgttgaagaagcaaataataagggaagatgagctgttgccaagtaaaaaaaaaaaaaaaaaaaaaaacaaaaaaagtactact

SEQ ID NO: 3014 - DNA, 1169 bp, Festuca arundinacea
gcatctccttcggcggcaaggaacatcatatacaaacaaatcatggatctgtatctgttgcagtgtatggtgatcatgacaagcctgcccttattacttatccagatgttgctttaaatcatatgtcttgcttccaaggattactcttctgccctgaagctgcttcactgcttcttcacaatttttgcatttaccatatcagtcccccaggacacgagttgggagctgctccaatttcatcgaatacacctataccatctgttgattacttggcagatcaggttgcggatgttcttgatttctttggattaggttctgtgatgtgcttaggtgccactgcgggtgcttatattctgaccctctttgcagcaaagtacagagagcgtgtactaggtcttatacttgtttcacctttatgtaaagctcccacttgggctgagtggttctatagtaagatggagtcaaatttgttgtactactatgggatgtgtgggttggtcaaggagagcttactgcagcggtacttcagcaaggaagtacggggatgctctgaattgcccgaatcagacatagtgcaggcatgtagaagttttctagatcagcggcataacatgaacgtgtggcgatttgtgcagacaatgaatgggagatatgacttgacagaagagctgcagcagcttcagtgtagaaccctgatttttgtcggcgagaattctgagttccatgcagaagccgttcacatgacatcaaagcttgacaggagatattgtgctttagttgaggttcaaggatgcgggtcgctcgtaacggaggagcaacctcacgcgatgcttataccgctggagtacttcttcatggggtacggcctctacaggccaagccagctcgacagcaacccgcgcagcaccctcagcccattttgcatatcaccggagctcctttcacccgagagcatgggggtgaagctaaagccgatcaagacgcgagcgaggcttgaagtgtagcgcaaagtgaacaaaggtggcgcttacgtctgacatggtgagagtttaggctaacccgtggatatcactgtaccaaactggtgtgtgtgtctgttgattttttggaagtaaagctagataagcgtgttatacactgtcatgtagataggagatggtagttgatat

SEQ ID NO: 3015 - DNA, 1537 bp, Setaria italica
cctccaagatgcgcaggtggggaagcaagccagcggcggccggagcatcttggagagagaaagaaggggcggtaggtgaaatcggaggcgtcaggagtgggagggaggagaggaggagccacgtcagcttgacagcagtgcacgtgcggtcggctgcggcggcggcggcggggatgggcgactccggcggctccgtcgtgtcggtggacgtcgagcgcatctccttcggaggcaaggaacaccatatacaaacaaatcacggatctgtatctgttgccatatatggtgaccatgataagcctgctcttattacctatccagatattgccttgaaccatatgtcttgcttccaaggactgctcttctgtcctgaagcagcttcattgctgctccataatttttgcatttaccatatcagccccccaggacatgagttaggagctgctccaattttgccgagcacaccggtggcatctgttgatgacttagcagatcaagtcgcggacgtactcgatttctttggattggattctgttatgtgtttaggtgtcactgcgggcgcatacattcttactctctttgcaacaaagtacagagagcgagtattaggacttattcttgtttcacctctatgtaaagctccctcatggtcagagtggttttataataaggtaatgtcaaatttactatattattatggcatgtgcaacgtggtgaaggatattttgttgcagcgctactttggcaagggagtacgtggatgctctacagaacctgaatcagatattgtgcaggcttgcagaagttttctagatcaacggcagggcatgaacgtgtggcggtttattcagactatcaatgagagaaaagacttgacagaaaacctgaagcagctgcagtgcagaactctaatttttgttggtgagaactcccagttccatgctgaggctgttcacatgactgcaaagcttgatagccgatatagtgctctcgtggaggtacaagcttgcggatcggttgtgacagaggagcagccacatgcaatgcttataccaatggaatacttcctcatgggatatggcttgtacaggccgagccagataaactgcagccctcgcagccctctgaacccattctgcatatcacctgagctcctctcacccgagagcatggggttgaagctaaagccaatcaagacacgagccaaccagaaagcgtaggaacagatgatgagaaggcgtaggaactgatgtgtatcccttgaatttttggtgaagtgacatagctgttgttaccgtgatgtacatagacaagaggttaggttggtgagggtggggtgggggttcaattccattgatttgtagccttaaacagttgtaaattgtcacagattatttgttgaagaaagagaaaataataagggaagatgagctgttgccaatagttgggtcttctctttagtcagtgccatgacccttttcatcagcttgtgagctagacagatgaaccatcccagtctcctaaatgatgtccagac

SEQ ID NO: 3016 - DNA, 1431 bp, Setaria italica
gcgcaggtggggaagcaagccagcggcggccggagcatcttggagagagaaagaaggggcggtaggtgaaatcggaggcgtcaggagtgggagggaggagaggaggagccacgtcagcttgacagcagtgcacgtgcggtcggctgcggcggcggcggcggggatgggcgactccggcggctccgtcgtgtcggtggacgtcgagcgcatctccttcggaggcaaggaacaccatatacaaacaaatcacggatctgtatctgttgccatatatggtgaccatgataagcctgctcttattacctatccagatattgccttgaaccatatgtcttgcttccaaggactgctcttctgtcctgaagcagcttcattgctgctccataatttttgcatttaccatatcagccccccaggacatgagttaggagctgctccaattttgccgagcacaccggtggcatctgttgatgacttagcagatcaagtcgcggacgtactcgatttctttggattggattctgttatgtgtttaggtgtcactgcgggcgcatacattcttactctctttgcaacaaagtacagagagcgagtattaggacttattcttgtttcacctctatgtaaagctccctcatggtcagagtggttttataataaggtaatgtcaaatttactatattattatggcatgtgcaacgtggtgaaggatattttgttgcagcgctactttggcaagggagtacgtggatgctctacagaacctgaatcagatattgtgcaggcttgcagaagttttctagatcaacggcagggcatgaacgtgtggcggtttattcagactatcaatgagagaaaagacttgacagaaaacctgaagcagctgcagtgcagaactctaatttttgttggtgagaactcccagttccatgctgaggctgttcacatgactgcaaagcttgatagccgatatagtgctctcgtggaggtacaagcttgcggatcggttgtgacagaggagcagccacatgcaatgcttataccaatggaatacttcctcatgggatatggcttgtacaggccgagccagataaactgcagccctcgcagccctctgaacccattctgcatatcacctgagctcctctcacccgagagcatggggttgaagctaaagccaatcaagacacgagccaaccagaaagcgtaggaacagatgatgagaaggcgtaggaactgatgtgtatcccttgaatttttggtgaagtgacatagctgttgttaccgtgatgtacatagacaagaggttaggttggtgagggtggggtgggggttcaattccattgatttgtagccttaaacagttgtaaattgtcacagattatttgttgaagaaagagaaaataataagggaagatgagctgttgccaa

SEQ ID NO: 3017 - DNA, 1391 bp, Lolium multiflorum
gctgctccttcacgccaagacagagtgaaagagaggcaagaggagcatttataggaggagagagacggaggagggagcaggcccggcggcggggatgggggactccggcggctccgtcgtgtcggtcgacgtcgagcgcatctccttcggcggcaaggaacatcatatacagacaaaacatggacctgtatctgttgcggtgtatggcgaccatgataagcatgcccttattacttatccagatattgctttgaaccatatgtcttgcttccaaggactacttttctgcccagaagcagcttccctgctgcttcataatttttgcatttaccatatcagcccccctggacatgagttaggagccactcctatttcaccaagcactcctgtacaatcggttgatgagttagctgatcaggttgcagaagtacttgatttcttcggattgggttctgtaatgtgcttaggtgtcagcgctggtgcatacattcttactctcttcgcaacaaagtatagggagcgagtactaggtcttatccttgtttcacctctatataaaactccctcatggactgagtggttttataataagttgatgtcaaatttgttgtattattacgggatgtgtgacatggtgaaggattgtttgttgcagcggtattttggcaagagagtgcggggaggctctgttgtgccagaatctgatattatgcaggcgtgtagaagttttctagatcaacgacaaagcatgaatatatggcggttcatccaaacaatcaatcaaaggcatgacttgacagaaagcctgaagcagctgcagtgcagaacgctgatatttgttggtgagaactcccagttccacactgaagctgtccacatgactgcaaaacttgataagagatacagtgctctcgttgaggtgcaagcgtgcgggtcggttgtgacggaggagcaacctcatgcgatgcttataccgatggagtacttcctcatgggatatggcttgttcaggccgagccatgtaagctccagccctcgcagccctctgaacccgttctgtatatcccctgacctcctctcgcccgagagcatgggtgtgaagctgaagccgatcaagacgcgggccaatctcggagtgtaggtacaggagaagaaaatgtgggaatgttggagggcttaggttaatcggggggtcggcatattgatggtgtgtcagcctatagttttgttgttgaaaattggacagatgttgtaactgtgatgtagatagagagaagttttaggcttggtgaggctggttgttgaggggttctattccattgattcgtagtagtattaaacagttgtaaattgtcacagattattgtttgtcaaagcaaaaggaataataa

SEQ ID NO: 3018 - DNA, 1472 bp, Sorghum bicolor
gcgaaaggccaagaactccaagatgccaaggtggggaagcaagcaagcggcggccggagcatcctggagagaggaagaaggggtggtagtaggtgaaaccggaggcggcaggagagggagagggagcgacagcagaggccacgccagcttgacagcaaagcccgtgcgctcggctgctgctgcggcggcgggcatgggcgactctggcggctccgttgtgtcggtggacgtcgagcgcatctccttcggcggcaaggaacatcatatacaaaccaaccatggatctgtatctgttgccatacacggtgaccatgataagcctgctcttattacttacccagatattgctttgaaccatatgtcttgcttccaaggactactcttctgtcctgaagcagcttcattgctgcttcataatttttgcatttaccatatcagccccccaggacatgagttgggagctgctccgattttgtcgagcacacctgtggcatctgttgatgacttagcagatcaaatcgcagatgtacttgatttctttggactggattcagttatgtgcttaggtgtcactgcaggcgcatacattcttactctctttgcaacaaagtatagagagcgagtactaggacttattctcgtttcacctctatgtaaagctccctcatggtctgagtggttttataataaggtaatgtcaaatttactatattattatggcatgtgcaatgtcgtgaaggatattttgttgcagcgctactttggaaagggagtacgtggaggctcaactgaacccgaatcagatattgtgcaggcttgtagaagctttctagatcaacggcagtgcatgaatgtgtggagatttatccaaactatcaatgagagaaaagacttgacagagaacctgaagcaactacaatgcagaacactaatttttgttggtgagaattcccagttccatgctgaagctgttcacatgactgcaaagcttgataggcgatatagcgctcttgtggaggtacaagcttgtggttcggttgtgacagaggagcaacctcatgcaatgctgataccgatggagtacttcctcatgggatatggactgtacaggccaagccagataaactgtagccctcgcagccctctgaatccgttttgcatatcaccggagctcctctctcctgagagcatgggggttaaactaaagccaatcaagacacgagccaacctcaaagcatagaaacagatgatgagaaggcgtaggaactgatgtgcatcccttgattttttttgtggtgaagtgacatagctgttgtttctgcgatgtacatagacaagaggttagtagggtcagggttgggtggggggtcgattccattgatttgtagccttgaaacagttgtaaattgttacagattatttgttgaagagaagaaataataagggaagatcagttgttgccaaaagttagg

SEQ ID NO: 3019 - DNA, 1303 bp, Ananas comosus
gcaggggggacgagggagagacctcctcgatcgggaatgggcgaatcgagcggctccgtgtcggtggatgtggagaggatctcgttcgggggaaaggaacatcatatacacacaaaccatggctccgtgtccgttgctgtatatggagatatagataagcctgcccttgttacttatccggatgtagctttaaatcatatgtcttgcttccaaggattattcttttgccctgaagctgcatctctgctactccacaacttctgcatttaccacattagtcctccaggacatgagttgggagcagctccgatatcttcagatgttcccgtgccatccgtcgatgacctggcagatcaggttgcagatgttctcgatttcttcgggttaggttcagttatgtgcttgggtgtcactgccggggcttatattctcaccctctttgcaacaaaacatagagagcgcgtacttggtttgatactcgtttcacctctatgtaaaactccttcatgggccgagtggctgtacaataaggtgatgtcaaatttcctctatttttatgggatgtgtggcttgatcaaggaatgcttactgcagcgatatttcagcaaggaagtccgtggaagtgcacaagtgcctgaatcggatatagtgcaagcctgtagaagtttgctggatgagagacacagtacaaatgtttggcggtttcttcaatcaataaatgggaggcatgacttgacagaatcactgaagaaactgcagtgccgaacgctaatcttcgttggcgagaactctccgttccattccgaggccctctacatgacctcaaagctggataggagatatagcgctttggtcgaggtccaggcgtgcgggtcaatggtgacggaggagcaaccacacgcgatgctgataccgatggagtacttcctcatgggatacgggctgtacaggccgtcgcagctgggctgcagcccgcggagcccccttagcccatcgtgcatctcgccagagctgctctcacccgagagcatgggagtgaagctaaagcccatcaaaactcggatttcccttgaagtttaaaacacacaaataaggcggcgacagccggacgcagccggacgcacactacatcgccttatataaatatgttctcttttttgctgtgggctatgtagatagaaaaagaaaagaaaagaaaaaaaaaagaggggttattaggttgtgtgaggacaacgcaaccgctgagagagagcgcggtggggatttcattccatttattgttagtcacaacacctgtaaatct

SEQ ID NO: 3020 - DNA, 1423 bp, Brachypodium distachyon
cggcagcagaaattttagagggggaggtggttgagagcgaggtaggagaaagcgagagggaagggggaagggccagttcatctttccgctgacgcagaagcggtcgcccgcggccgggatgggtgactccggcggctccgtcgtgtcggtcgacgtcgagcgcatctccttcggcgggaaggaacatcatatacaaacaaaacatgggcctgtatctgttgccgtgtatggtgaccatgataagcatgcccttattacctatccagatattgctttgaaccatatgtcttgcttccaaggactgctcttctgccccgaagctgcttcactgctgctccataatttttgcatttaccatatcagcccccctggacacgagttaggagccgctccattttcaccaaatagtcctgtggcatctgttgatgaattggcagatcaggttgcagaagtacttgatttctttggattgggttctgttatgtgcttaggtgtcagcgctggtgcatacattcttactctcttcgctacgaagtatagggaaagggtactaggtcttatcctcgtttcacctctatgcaaaaccccctcatggactgagtggttctataataaggtgatgtcgaatttgttgtattattacgggatgtgtgatatggtgaaggattgtttgttgcagcggtactttggcaagaaactgcgaggaggctctgttgtaccagaatctgatattatgcaggcgtgcagaagttttttagatcaacgacaaagcatgaatatatggcggtttatccaaacaatcaatcagagacatgacttaacagaaagcctgaagcagctgcaatgcagaactctaatatttgttggcgagaactcacagttccacaatgaagctgttcacatggctgcgaaacttgataagagatacagtgccctcgtcgaggttcaagattgtgggtcggttgtgacagaggagcaaccacacgcaatgctcataccaatggagtacttcctcatgggctatggcttgttcaggccgagccatgtaagctccagccctcgcagccctttaaacccattttgtatatcgccggagctcctctcgcctgagagcatgggggtgaagctgaagccaatcaagacgcgagccaatctcggagtgtaggcatggaagaaaacagtggaagtgcgaaggcttataggctaacccggttatcagatattgattgtatctgccttaattttggttgtgaaatgagccaggtgttgttgtacctgtgatgtacatagagaaaaggttaggctggtgaggttcggtgagggggttctattccattgattcgtagtattaaacagttgtaaattgtcacagattatttgtcaaagcaaaaggaataataagggaagatgacgagctgttgtc

SEQ ID NO: 3021 - DNA, 1457 bp, Brachypodium distachyon
aggtgagttggagaagagaagcggcagcagaaattttagagggggaggtggttgagagcgaggtaggagaaagcgagagggaagggggaagggccagttcatctttccgctgacgcagaagcggtcgcccgcggccgggatgggtgactccggcggctccgtcgtgtcggtcgacgtcgagcgcatctccttcggcgggaaggaacatcatatacaaacaaaacatgggcctgtatctgttgccgtgtatggtgaccatgataagcatgcccttattacctatccagatattgctttgaaccatatgtcttgcttccaaggactgctcttctgccccgaagctgcttcactgctgctccataatttttgcatttaccatatcagcccccctggacacgagttaggagccgctccattttcaccaaatagtcctgtggcatctgttgatgaattggcagatcaggttgcagaagtacttgatttctttggattgggttctgttatgtgcttaggtgtcagcgctggtgcatacattcttactctcttcgctacgaagtatagggaaagggtactaggtcttatcctcgtttcacctctatgcaaaaccccctcatggactgagtggttctataataaggtgatgtcgaatttgttgtattattacgggatgtgtgatatggtgaaggattgtttgttgcagcggtactttggcaagaaactgcgaggaggctctgttgtaccagaatctgatattatgcaggcgtgcagaagttttttagatcaacgacaaagcatgaatatatggcggtttatccaaacaatcaatcagagacatgacttaacagaaagcctgaagcagctgcaatgcagaactctaatatttgttggcgagaactcacagttccacaatgaagctgttcacatggctgcgaaacttgataagagatacagtgccctcgtcgaggttcaagattgtgggtcggttgtgacagaggagcaaccacacgcaatgctcataccaatggagtacttcctcatgggctatggcttgttcaggccgagccatgtaagctccagccctcgcagccctttaaacccattttgtatatcgccggagctcctctcgcctgagagcatgggggtgaagctgaagccaatcaagacgcgagccaatctcggagtgtaggcatggaagaaaacagtggaagtgcgaaggcttataggctaacccggttatcagatattgattgtatctgccttaattttggttgtgaaatgagccaggtgttgttgtacctgtgatgtacatagagaaaaggttaggctggtgaggttcggtgagggggttctattccattgattcgtagtattaaacagttgtaaattgtcacagattatttgtcaaagcaaaaggaataataagggaagatgacgagctgttgtcagattaggtatgc

SEQ ID NO: 3022 - DNA, 1582 bp, Oryza sativa
agaggagcaggtggtggaggcggagcagcagcggcagcagcagcggcggctgaggcggcggttggtgagcgagcgcgaggagagcgagggaggagaggagaggtgggagggagtggccccgccgccgtcttcttggccggagatgggcgactccggcggctccgtcgtgtcggtggacgtcgagcgcatctccttcggcggcaaggaacatcatatacaaacaaaccatggttctgtatctgttgcggtgtatggcgaccatgataagccagcacttgttacttatcccgatattgcattgaatcatatgtcatgcttccaagggctactattctgccctgaagcatcttcattactgctgcataatttttgtatttaccatatcagccccccaggacatgagttaggagcagctccagtttcaccaagcagtcctgtggcatctgttgatgagttagcggatcaggtttcagatgtacttgatttttttggactgggtcctgttatgtgcttaggtgtcactgctggcgcatacatccttactctatttgcaacgaagtatagggagcgagtactaggtcttatcctagtttcccctctatgcaggaccccttcttggactgaatggtttcataataaggtgatgtcaaatttgctatattattatgggatgtgcaacatggtaaaagactgtttgctacaacgatacttcagcaagggagtgcagggatgctctgctgtacccgaatcagacattgtgcaggcgtctagaagttttctagatcaacggcaaagcatgaatgtgtggcggtttatccacacaatcaatgagagacatgatttaacagaaagcttaaaggagctgcagtgcagaactctaatatttgttggccagaactctcagttccatgctgaggctgttcatatgacctcaaagcttgatgagagatatagtgctctcgtagaggtacaaggatgtggatctgttgtgacagaggagcaaccgcatgcaatgcttatgccgctggagtacttcctcatgggatacggattgtacagaccaagccagataagctgcagccctcgtagccccttgaacccgttttgtatatcgccagaactcctctcgcccgagagcatgggggttaagctaaagccaatcaagacgcgggccaatcttgaagtttaggatcgaaagagaaaaaaaaaaaaggtgaaatgtgagaacttaggctaacccggcagtcgctgtactaatatatcttcctaagttttggaggcgagtgagttggttgttgttattgtgatgtagatattgaggaaaaaagcttaggttgaggcggggtttccattccattggttcgtagcattaaacagctgtaaattgttacagattatttgtcaaagctaaagagaaaataagggaagatgagctgttgccaattattaggtactctgatgttgtctcttctcctcttgccagtaccatcctactctgattatttgctctcatgtcatgagctagactgatgaaccaaatgttgtctccaaaagcatacctagaattttggtccatttgcac

SEQ ID NO: 3023 - DNA, 1631 bp, Triticum aestivum
ggtttatagcggcaggccaagaactccaagaagcgcaggtggggaaggagaagcagcggcggaagcgggacagtttcgagagagaaagagagggggcggtgggtgggagcgagaggttgggaagtgggggaggtccagttcctctttttcggcgggggaggtttgtctgccgccgggatgggcgactctggcggctccgtcgtgtctattgacgtcgagcgcatctccttcggcgggaaggaacatcatatacaaacaaaacatggacctgtatctgttgctgtgtatggtgaccatgataagcatgcccttattacttatccagatgttgctttgaaccatatgtcttgcttccaaggactactattctgcccagaggctgcctcactgctgctccataatttttgcatttaccatataagcccccctggacatgagttaggagccactccgattttaccaaacagtcctgtggcatcagttgatgagttagcggatcaggttgcagaagtacttgatttctttggattgggttctgttatgtgcttaggtgtcagtgctggtgcatacattcttactctcttcgcaacaaagtatagggagcgtgtgctaggtcttatcctcgtttcacctctatgtagaactccctcatggactgagtggttttataataaggtgatgtcgaatttgttgtattattacgggatgtgtgacgtggtgaaggactgtttgttgcagcgttactttggcaagagagtgcgaggaggctctgctgtaccagaatctgatattatgcaggcgtgtagaagtttcctagatcaacggcaaagcatgaatatatggcggtttatccaaacaatcaatcagagacatgacttgacagaaagcctgaagcagctgcagtgcagaactctgatatttgtcggtgagaactcgcagttccacactgaagctgttcacatgactgcaaagcttgataagagatacagtgctctcgttgaggtgcaagcgtgtgggtccgtcgtgacggaggagcagccgcacgcgatgctgataccaatggagtacttcctcatgggatacggcctgttcaggccgagccatgtaagctccagccctcgcagccctttgaacccgttctgcatatcgccggagctcctctcgcccgagagcatgggtgtgaagctgaagccgatcaagacgcgggccaatctcagagtgtaggtacatatatggaagaagaaaaggttggaggtgtgaggggctttaggctaacccggcgatcggcgatactgatggtatgtctgccttgattttggcgttgaaatggggagagatgttgtaactgtgatgtagatatagagaagagttttagggtggtgaggttggttggttggttggtgatgggttctattccattgattcgtggtagtattaaacagttgtaaatggtcacagattgtttgtcaaagcaaaaggaataatgataataataaagggaggctggtgaggtgctgtccgattaggtgctccacttcgcctgtacccttggtttccttttatgagctagactggtgaaccattgttgtctcctgaagcaaagtgttatatattcgaccatcgttgtcttc

SEQ ID NO: 3024 - DNA, 1638 bp, Panicum virgatum
cggccgtagatatccgatggactcttgacctgtcggtttcctctctccgcgtaagctggaccggatcgtaataaccggaaactcccaggggctaaagcccaaaacgctgcgccgcagaggaagtgaggaacgacgctcggtttaaagccaaggccaagaacgcctccaagatgcgcaggtggggaagcaaggcagcggcggccggagcatcctggagagagaaagaaggggtggtaggtgaaaccggaggcggcaggactggggaagagggaaggcggtgccacgccacctcgacagcagcgcccgtgcggtcggcggcggcggcggggatgggcgactccggcggctccgtcctgtcggtggatatcgagcgcatctccttcggcggcaaggaacatcatatacaaacaaatcatggatctgtatctgttgccatatatggtgaccatgataagcctgctcttattacctatccagatattgccttgaactatatgtcttgtttccaaggactgctcttctgtcctgaagcagcttcattgctgcttcataatttttgcatttaccatatcagccccccaggacatgagttaggagctgctccgattttgccaagctcaccggtggcatctgttgatgacttagcggatcaagtcgcagacgtacttgatttctttggattggactctgttatgtgtttaggtgtcactgcgggtgcatacattcttactctatttgcaacaaagtacagagaacgagtactaggacttatccttgtttcacctctatgtaaaaccccctcatggtcagagtggttttataataaggttatgtcaaatttgttatattattatggcatgtgcaacgtggtgaaggatattttgttgcagcgctacttcggcaagggagtacgtggatactctaatgaacctgaatcggatattgtgcgggcttgtagaagttttctagatcaacggcagggcatgaacgtgtggcggtttattcagactatcaatgagagaaaagacttgacagaaaatctgaagcagctgcagtgcagaactcttatttttgttggtgagaattcccagttccatgctgaggctgttcacatgactgcaaagcttgatagccgatatagtgctcttgtggaggtacaagcttgcgggtcagttgtgaccgaggaacagccacatgcaatgcttataccaatggaatacttcctcatgggatacggcttgtacaggccaagccagataaactgcagccctcgcagccctctgaacccgttctgcgtatcgccggagctcctctcgcccgagagcatgggggtgaagctaaagccaatcaagacgcgagccaacctcaaagcgtaggaacacatgaggagaagatgtaggaactgatgtgtattccttgattttttttttgtggtggagtgacatagctgttgttaccatgatgtacatagccaagagattaggtcagtgagggttgggtggggggttcaattccattgatttgtagccttgaacagttgtaaattgtcacagattattcgttgaagagaataataagggaagatgagtttgttgcaaaaagttgggtcttcgctttcatcagtttgtgagctagact

SEQ ID NO: 3025 - DNA, 1918 bp, Panicum virgatum
tttgccaaaggtaccctaaatatttatgtaaaattagggctaccatttaaatgcattgataaccctcttgtacaatacaagtatgcaattacatatcaccaaataaatatttagccacacaagaaattaaaacactgttgataaaagcaagataaagatcgggccctaaaaaaatgcagtatgtgctactcaaagcagtgtacagtgtacaccgagaattgtgctcttgaccagccgtggatatccaatggactctttgacttgtcggtttgctctttccgcgtaagctggaccggatcgtaataaccggaaactcccagggactaaaagcccaaaatgctgcaccgcagaggacgctcggtttataagcgaaggccaagaacgcctacaagatgcgctggtggggaagcaagccagcggcggccggagcatcctggagagaggaaggggtggtggtaggtgaaaccagaggcaacaggagtggggaagagggaggcggggccacgtcacctcgacagcagcgcccgtgcggtcggcggctgcggcggcggcggcggggatgggcgactccggcggctccgtcctgtcagtggacgtcgagcgcatctccttcggcggcaaggaacatcatatacaaacaaaccatggatctgtatctgttgccatatatggtgaccatgataagcctgctcttattacctatccagatcttgccctgaaccatatgtcttgtttccaaggactgctcttctgtcctgaagcagcttcattgctgcttcataatttttgcatttaccatatcagccccccaggacatgagttaggagctgcttcgattttgccaagcacaccggtggcatctgttgatgacttagcggatcaagtcgcagatgtacttgatttctttggattggattctgttatgtgtttaggtgtcactgcgggcgcatacattcttactctatttgcaaccaagtacagagagcgagtactaggacttatccttgtttcacctctatgtaaaactccctcatggtcagagtggttttataataaggttatgtcaaatttgttatattattatggcatgtgcaatgtggtgaaggatattttgttgcagcgctacttcggcaagggagtacgtggatgctctaatgaacctgaatcagatattgtgcaagcttgtagaagttttctagatcaacggcaaggcatgaacgtgtggcggtttattcagactatcaatgagagaaaagacttgacagaaaacctgaagcagctgcagtgcagaactcttatttttgttggtgagaattcccagttccatgctgaggctgttcacatgactgcaaagcttgatagccgatatagtgctcttgtggaggtacaagcttgcgggtcagttgtgaccgaggaacagccacatgcaatgcttataccaatggaatacttcctcatgggatacggcttgtacaggccaagccagataaactgtagccctcgcagccctctgaacctgttctgcgtatcgccggagctcctctcccccgagagcatgggaatgaagctaaagccaatcaagactcgagccaacctcaaatcgtaggaacatgagaagatgtaggaactgatgtgtatttcttttttttttgtggtggaatgacatagctgttgttatcatgatgtacatagccaagagttaggtcgttgagggttgggtggggggttcaattccattgattggtagccttaaacagctgtaaattttcacagattattcgttgaagaaagagaataataaggggagatgaattgttgccaaaagttgggtcttcgctttcgtcagtgccatggtttccttttcatcagcgtgtgagctagactgatgaaccatttcagcctcctaaatgatattcag

SEQ ID NO: 3026 - DNA, 1175 bp, Zea mays
gtgaaaccggaggcggcaggatagggagagggagcgagagtagaggccacgcctgcttgacagcaaggcccgtgcgctcggcggcggcggcggcggatatgggcgactctggcggctctgttgtgtcggtggacgtcgagcgcatctccttcggcggcaaggaacatcatatacaaaccaaccatggatctgtatctgttgccatatatggtgaccatgataagcctgctcttattacctacccagatattgctttgaaccatatgtcttgcttccaagggctactcttctgtcctgaagcagcttcattgctgcttcataatttttgcatttaccatatcagccccccaggacatgagttaggagctgctccgattttgccgagcacacctgtggcatctcctgatgacttagcagatcaaatcgcagacatacttgatttttttggactggattcggttatgtgcttaggtgtcactgcgggcgcatacattcttactctgtttgcaacgaagtatagggagcgagtactaggacttattctcgtttcacctctatgtaaagctccctcatggtctgagtggttttataataaggtaatgtcaaatttactgtattattatggcatgtgtaatgtcgtgaaggatattttgttgcagcgctactttggaaagggagtacgtggaggctcagctgaacctgaatcagatattgtgcaggcttgcagaagttttctagatcaacggcagtgtgtgaacgtgtggcgatttatccaaactatcaacgagagaaaagacttgacagagaacctgaagcagctacagtgcaggacactaatttttgttggtgagaattcccagttccatgctgaagctgttcacatgactgcaaagcttgataggcgatatagcgctcttgtggaggtacaagcttgtggctcggttgtgacagaggagcaacctcatgcaatgctgataccaatggagtactttctcatgggatatggactgtacaggccaagccagataaactgtagccctcgtagccctctgaatccgttttgtatatcaccagagctcctctctcctgagagcatgggggttaagctaaagccaatcaagaacgcgaggctaaccttaatgcattaggaaacagtgtgatgagaaatggcgtaa

SEQ ID NO: 3027 - DNA, 1704 bp, Hordeum vulgare
gggaagctccagggtgcggagcatagtacaggtagaactgcgccgcttggtttatagcggcaggccaagaactccaagaagcgcaggtgggagggagaagcagcagcggcggcagcggggcagtttcgagagagaaagagaggggggcggtgggtgggagaaagaggttgggaagcgggggagggccagttcgtctttttcggcgggggcggtttgtctgcagccgggatgggcgactccggcggctccgtcgtgtctattgacgtcgagcgcatctccttcggcgggaaggaacatcatatacaaacaaaacatggacctgtatctgttgcggtgtatggtgaccctgataagaatgcccttattacttatccagatgttgctttgaaccatatgtcttgcttccaaggactactcttctgcccggaggctgcttcactgctgctccataatttttgcatttaccatataagcccccctggacatgagttaggagccactccgattttaccaaacagtcctgtggcatcggttgatgagttagcggatcaggttgcagaagtacttgatttctttggattgggttctgttatgtgcttaggtgtcagtgctggtgcatacattcttgctctcttcgcaacaaagtatagggagcgtgtactaggtcttatcctcgtttcacctctatgtagaactccctcatggactgaatggttttataataaggttatgtcgaatttgttgtattattacgggatgtgtgatgtggtgaaagactgtttgttgcagcggtattttggcaagagagtgcgaggaggctctgctgtaccagaatctgatattatgcaggcatgtagaagtttcctagatcaacggcaaagcatgaatatatggcggtttatccaaacaatcaatcagagacatgacttgacagaaagcctgaaacagctgaagtgcagaactctgatatttgttggtgagaactcgcagttccacactgaagctgttcacatgaccgcaaagcttgataagagatacagtgctctcgtcgaggtgcaggcgtgtgggtctgtcgtgacggaggagcagccgcatgcgatgctgataccaatggagtacttccttatgggatacggcttgttcaggccgagccatgtaagctccagccctcgcagccctttgaacccattctgtatatcgccggagctcctctcgcctgagagcatgggcgtgaagctgaagccgatcaagacgcgggccagtctcagagcgtaggtgcatatatggaaaaagaagaaaaggttggaggtgtgaggagctttaggctaacccggcgatcggcgatactgatggtatgtctgccttaattttggtgttgaaatggggcgagatgttgtaactgcgatgtagatatagagaagagttttagggtgatgaggttggttggttggtggtgggttctattccattgattcgtggtagtattaaacatttgtaaatggtcacagattgtttgtcaaagcaaaaggaataatgatgatgatgataataataaagggaggctgatgagctgctgtccgattaggtgcgcacactagtgtctgttctccacctcgcctgtacccttggtttcccttttatgagctagactggtgaaccattgttgtctcctgaagcaaagtgttattatatattcaaccatcg

SEQ ID NO: 3028 - DNA, 1429 bp, Avena sativa
ggagaaggcagcggcagcagcaaggggacatttttgaggaagaaagagaggggacggctggtgggcgcgagcgaggtgggagaaggagagagagggaagcgaggagggccagttagttcgtccttttttggcggaggcggttgccggcccgccgggatgggcgactccggcggctccgtcgtgtccgtggacatcgaccgcatctccttcggcgggaaggaacatcatatacagacaaaacatggacctgtatctgtggcggtgtatggtgaccatgataagcatgcccttattacttatccagatattgctttgaaccatatgtcttgcttccaaggactactcttctgcccagaagctgcttccctgctgcttcataatttttgcatttaccatatcagcccccctggacatgagttaggagccactcctatttcaccaagcagtcctgtacaatcggtcgatgagttagctgatcaggttgcagaagtacttgatttttttggattgggttctgttatgtgcttaggtgtcagtgctggtgcatacattcttactctcttcgcaacgaagtatagggagcgtgtactaggtcttatccttgtttcacctctatataaaactccctcatggactgagtggttttataacaaggtgatgtcaaatttgttgtattattacggtatgtgtgacatggtgaaggactgtttgttgcagcggtattttggcaagagagtgcggggaggctctgtggtgccagaatctgatactatgcaggcgtgtagaagttttctagatcaacggcaaagcatgaatatatggcggtttatccaaacaatcaatcaaagacatgacttgacagaaagcctgaagcagctgcagtgcagaactctgatatttgtgggtgagaactccctgttccatgctgaagctgttcacatggctgcaaaacttgataagagatacagcgctctcattgaggtacaagcgtgtgggtctgtcgtgacggaggagcaaccgcacgcgatgctcataccgatggagtacttcctcatggggtacggcttgttcaggcctagccatgtaagctccagccctcgcagccctctgaacccgttctgtatatcgccggacctcctctcgcccgagagcatgggcgtgaagctgaagccgatcaagacgcgggccagtctcggggcttaggtacagggagaagaaaagttggaatattcgaggcgggcttaggctaacctgggggacagatgttgtaactgtgatgttgatgtagatagagagaaaagtttttaggcttggtgaggctggttgttggcgggttctattccattgattcgtgatagaagtgtgctaaacatttgtaaattgtgacagattgtttgtcaaggcaaaaggaataatgataaccagggca

SEQ ID NO: 3029 - DNA, 1468 bp, Musa acuminata
ggaaagcctcggaggtatatttatatgccaaaccgtccgtgaacgagaggaggaggttagattgatcgagagggaagaggaggaggaagaggggattggttcttctagtaatgggagaatcaagcggatcggtctcggtggacgtggagaggatctcctttggagggaaggagcatcatgtgttaacaagccatggtcctatttcagttgctgtttatggggatctggaaaagcctgcacttgttacttatccagatgttgctttaaaccatatgtcatgctttcaagggctgtttttttgtccggaagctgcttctttgctgcttcataatttctgcatataccatattagtcctccaggtcatgagttgggtgctgctccaatttcttcagatgaaccagtgctttctttagatcagttagctgatcaggtggcagaagttcttgatttctttgggttggaaactgtcatgtgctttggggtcacagctggtgcttatattcttaccctttttgctactaaatatagggagcatgtcctaggactgatactcgtctcacctctttgtaaggctccctcatggtcagagtggttatatatgaaggtagtatcaaatttcctctatttttatggaatgtgtggcttagtcaaggagtacttactccaacgatacttcagtaaggaagtacgaggaagttcacaggttcccgagtcagatatagtacaagcctgtagaagtttgctggatgagaagcagagtgcaaatgtctggtggtttcttcagtcaattaatgggagacatgacttgactgaagcattgaagaaacttcagtgtcggactctaatttttgtgggtgaggactccccatttcactcggaggccctccacatgtccgcaaagctggacaagagatacagtgcattggttgaggttcagggatgtgggtcggtggtgacggaagagcagccccacgccatgctgataccaatggagtacttcctcatggggtatggattgtaccgtccaagccaactgagctacagcccgcgaagtcccctcagtccattgtgcatctctccggagttgctttccccagagagcatgggagtgaagctaaagcccatcaagactcgaatacccgctgaagtttgaggagctcaaattcaacatttgagttgtgactacacgggggctcatgcaagctgcaatgccaacatcagttttgcgaaccatgtaaactctgacatgtacttcctatacatatagagtgtttctttttgtgttcttttagtgtaagaccaggttactggactgtacatattattatcaagggttggctggaatccgtagacagtaatctggtaacatcttactctattcttttgtactccatgtaaagttattgtttatgatgacagaataaggaatgagagagatgggctgtactccatcattagtagctttgt

SEQ ID NO: 3030 - DNA, 1477 bp, Musa acuminata
ggaaagcctcggaggtatatttatatgccaaaccgtccgtgaacgagaggaggaggttagattgatcgagagggaagaagaggaggaagaggggattggttcttctagtaatgggagaatcaagcggatcggtctcggtggacgtggagaggatctcctttggagggaaggagcatcatgtgttaacaagccatggtccgatttcagttgctgtttatggggatctggaaaagcctgcacttgttacttatccagatgttgctttaaaccatatgtcatgctttcaagggctgtttttttgtccggaagctgcttctttgctgcttcataatttctgcatataccatattagtcctccaggtcatgagttgggtgctgctccaatttcttcagatgaaccagtgctttctttagatcagttagctgatcaggtggcagaagttcttgatttctttgggttggaaactgtcatgtgctttggggtcacagctggtgcttatattcttaccctttttgctactaaatatagggagcatgtcctaggactgatactcgtctcacctctttgtaaggctccctcatggtcagagtggttatatatgaaggtagtgtcaaatttcctctatttttatggaatgtgtggcttagtcaaggagtacttactccaacgatacttcagtaaggaagtacgaggaagttcacaggttcccgagtcagatatagtacaagcctgtagaagtttgctggatgagaagcagagtgcaaatgtctggtggtttcttcagtcaattaatgggagacatgacttgactgaagcattgaagaaacttcagtgtcggactctaatttttgtgggtgaggactccccatttcactcggaggccctccacatgtccgcaaagctggacaagagatacagtgcattggttgaggttcagggatgtgggtcggtggtgacggaagagcagccccacgccatgctgataccaatggagtacttcctcatggggtatggattgtaccgtccaagccaactgagctacagcccgcgaagtcccctcagtccattgtgcatctctccggagttgctttccccagagagcatgggagtgaagctaaagcccatcaagactcgaatacccgctgaagtttgaggagctcaaattcaacatttgagttgtgactacacgggggctcatgcaagctgcaatgccaacatcagttttgcaaaccatgtaaactctgacatgtacttcctatacatatagagtgtttctttttgtgttcttttagtgtaagaccaggttactggactgtacatattattatcaagggttggctggaatccgtagacagtaatctggtaacatcttactctattcttttgtactccttgtaaagttattgtttatgatgacagaataaggaatgagagagatgggctgtactccatcattagtagctttgtgccctttcc

SEQ ID NO: 3031 - DNA, 1538 bp, Elaeis guineensis
gcttggtataagagagcgaggaaagagctgttcatcggaggactggggagagagagagaggaaagagaggtgagaaggctggaggaggagttagggggggttttcttggcccgatgggagaatcgagcagttcggtgtccattgatgtggagaggatttcgttcggcggaaaggaacatcatatacaaacgagtcatggcccagtatcagttgctgtatttggagatcttgaaaagcctgcactagtcacctatccagatgtagctttaaatcatatgtcctgttttcaaggattatttttttgtccggaggcttcttcattgctgcttcacaatttctgcatataccatataagccctccaggacatgagttgggagctgctccaatttcatcagatgttccggtgctctctgttgatcagttagcggatcaggtggcagaaactcttgattactttgggttaggttcagtgatgtgtttgggggtcacggctggtgcttacattcttacccattttgctacaaaatacagggagcgtgtgcttggtttgatgcttgtctcacctctgtgtaaggctccctcatggactgagtggttctataacaaggttatatcgaatttgctatacttttatgggatgtgtggtttgatcaaggaatgcttgcttcaacgatacttcagcagggaagttcgtggaagttcactcgttcctgaatctgatatcgtacaagcctgtagaagtttgctggatgagaggcagagcacaaacgtgtggagatttctccagtcgataaatgtgagacatgacttgacggaatcattgaagaaactgcagtgcaggacactaatttttgtgggtgagaattctcccttccattccgaggccctccacatggccacaaatctggacagaagatacagcgcattggtcgaggtgcaggcgtgtgggtcggttgtgacagaagagcagccccatgccatgctgatacccatggagtacttccttatggggtacggtctgtacaggccatgccagatgagctgcagcccacggagcccactcagtccgtcatgcatctctcctgagctgctttcacctgagagcatgggagtaaagctgaagcccatcaagacaagggtctcgctacaagtttgagaggataggatagggcgaaggcagtatgatatactcacaactaggggtaggcccagggatggtgatgatggataacacgaacgctgtagcatttgggatgtactagctctatagatatgttttcgtggcagtttttgatgcggataacggatttactggtctgtagacatgcaaaagataaaagaaagttgaggggaggggggatggtggtatatagaaggacaggtgcagaggattgcgtgagattcttctattccattcattcgtagttacaacccttgtaaatcttttcattatttatgattgcaaataacaataaggaaggcgcgctgtcctcaatcattatagatgtgtgctgtattctcttcttcctttcccaaa

SEQ ID NO: 3032 - DNA, 1254 bp, Musa acuminata
atgggggaatcgagcgggacggtctcggtggatgtggagaggatctcgttcggagggaaggaacatcatgtattaacaagccatggccctatttcagttgctgtttatggggatctagaaaagcctgcacttgtgacatatccagatgttgctttaaatcatatgtcatgctttcaaggattacttttttgtccggaagcttcttctttgctgcttcataatttctgcatataccatattagtcctccaggacatgagttaggtgctgctccaatttctgcagatgaaccaacactctctgttgaccagctagcagatcaggtggcagaggttcttgattatttcgggttaggctctgccatgtgctttggggttacggctggtgcttatattcttactctatttgctactaaatatagggagcgtgtccttggactaatacttgtctcacctctctgtaaggctccttcatggacggaatggttgtatactaaggtagtatcaaatttactatatttttatggaatgtgtggcttggtcaaggaatacttactccaacgatacttcagtaaggaagtacgaggaagttcacaagttcctgagtcagacattgtactagcctgtagaagtttgcttgatgagaagcagagtgaaaatgtttggcgatttcttcagtcaattaatgggagacatgacttgatggaagatttgaagaaactgcagtgtcggactctaatttttgtaggtgagaactctccgtttcactcagaagccctgaacatgaccaaagaactagacaagagatacagcgcattggtagaggttcaagcatgtggctcggtcgtgacagaagagcagccccatgccatgctgatccccttggagtacttcctcatggggtacggcttgtacagaccgaccaagctgagctacagcccgcggagtcctctcagtccgttatgcatctctcccgaactgctgtcgcccgaaagcatgggactgaagctaaagcccatcaagactcggatctcccttaaagtctgagaagattagtatcaagaaacatacgacttgtcgataggcagaggcacaattttgccaaacaatgtaaagcatcatgtacctcctatacagacacagtttcttggctcattagtgtaggattgtagatatcatcgagaataaacgagcttattaagggctgttatcgaaattcatttgtcctcaaataacttgtgtaaatcgattttttat

SEQ ID NO: 3033 - DNA, 1261 bp, Musa acuminata
cgcaagaaaagcaaaagaggtaggaggaggaggaggagaaagattggattttgcagccatgggggaatcgagcgggacggtctcggtggatgtggagaggatctcgttcggagggaaggaacatcatgtattaacaagccatggccctatttcagttgctgtttatggggatctagaaaagcctgcacttgtgacatatccagatgttgctttaaatcatatgtcatgctttcaaggattacttttttgtccggaagcttcttctttgctgcttcataatttctgcatataccatattagtcctccaggacatgagttaggtgctgctccaatttctgcagatgaaccaacactctctgttgaccagctagcagatcaggtggcagaggttcttgattatttcgggttaggctctgccatgtgctttggggttacggctggtgcttatattcttactctatttgctactaaatatagggagcgtgtccttggactaatacttgtctcacctctctgtaaggctccttcatggacggaatggttgtatactaaggtagtatcaaatttactatatttttatggaatgtgtggcttggtcaaggaatacttactccaacgatacttcagtaaggaagtacgaggaagttcacaagttcctgagtcagacattgtactagcctgtagaagtttgcttgatgagaagcagagtgaaaatgtttggcgatttcttcagtcaattaatgggagacatgacttgatggaagatttgaagaaactgcggtgtcggactctaatttttgtaggtgagaactctccgtttcactcagaagccctgaacatgaccaaagaactagacaagagatacagcgcattggtagaggttcaagcatgtggctcggtcgtgacagaagagcagccccatgccatgctgatccccttggagtacttcctcatggggtacggcttgtacagaccgaccaagctgagctacagcccgcggagtcctctcagtccgttatgcatctctcccgaactgctgtcgcccgaaagcatgggactgaagctaaagcccatcaagactcggatctcccttaaagtctgagaagattagtatcaagaaacatacgacttgtcgataggcagaggcacaattttgccaaacaatgtaaagcatcatgtacctcctatacagacacagtttcttggctcattagtgtaggattgtagatatcatcgagaataagcgagcttatcaagggct

SEQ ID NO: 3034 - DNA, 1331 bp, Musa acuminata
gttcaaaagggagaacgggaaaggaaacgatatacaaggagaggggagggaggagggatgggagaatcgagcgggtcgatcccggtggatgttgagaggatctcctttggagggaaggaacatcatctgttaacaagccatggccctatttcagttgctgtatatggggatctggaaaagcctgcacttattacttatccggatgttgctttaaatcatttgtcgtgctttcaaggattatttttttgcccagaagctgcttctttgcttcttcataatttctgcatataccatattagtcctccaggacatgagttgggtgctgctccattttcctcagatgagccagtgctttctgtagatcagttagctgatcaggtggccgacgttcttgatttctttgggttagtgtctgccatgtgctttggggtcacagctggtgcttatattcttaccctttttgctagtaagtatagggagcgtgtcctaggtctcatacttgtctcacctctttgtaaggctccctcgtggtccgagtggttgtatactaaggtagtgtcaaatttactatatttttatggaatgtgtggattagtcaaggaatacttactccagcggtacttcagtaaggaagttcgaggaagttcacaggttcctgagtcggacatagtgcaagcctgtaaaagtttgttggatgagaagcagagtgcaaatgtttggcgttttcttcagtcgttgaacgggagacatgatttaacgggagcactgaagaaactccggtgtcggactctaatttttgtgggtgaggactctccgtttcactcagaggccctccacatgaccacaaaactggataggagatacagcgcattggttgaggttcaggcatgtgggtcagtggtgacagaagagcaaccccaagccatgctgataccaatggagtacttcctcatggggtacggtttgtaccgaccaagccagctgagctacagcccaccaagtcctcttaatccattgtgcatctctccagaattgctctcgccagagagcatgggactgaagctaaagcccatcaagactcgaatatcccttgaagtctgagaagttcattcaatttcatcgccgatgaatgttgcaatgccaaaatcaattttgcgtgtaaaacttcgagatatactccttacatgtaaattttttctttctttggagattttagtgcaacagcaggttaatgatctgtagatattatcacgaagtgggataaactaagtgctggattgtgctacattcttttgtactcaaataacttatataaattcaattttttgtgg

SEQ ID NO: 3035 - DNA, 1354 bp, Musa acuminata
gagaggttcaaaagggagaacgggaaaggaaacgatatacaaggagaggggagggaggagggatgggagaatcgagcgggtcgatcccggtggatgttgagaggatttcctttggagggaaggaacatcatctgttaacaagccatggccctatttcagttgctgtatatggggatctggaaaagcctgcacttattacttatccggatgttgctttaaatcatttgtcgtgctttcaaggattatttttttgcccagaagctgcttctttgcttcttcataatttctgcatataccatattagtcctccaggacatgagttgggtgctgctccattttcctcagatgagccagtgctttctgtagatcagttagctgatcaggtggccgacgttcttgatttctttgggttagtgtctgccatgtgctttggggtcacagctggtgcttatattcttaccctttttgctagtaagtatagggagcgtgtcctaggtctcatacttgtctcacctctttgtaaggctccctcgtggtccgagtggttgtatactaaggtagtgtcaaatttactatatttttatggaatgtgtggattagtcaaggaatacttactccagcggtacttcagtaaggaagttcgaggaagttcacaggttcctgagtcggacatagtgcaagcctgtaaaagtttgttggatgagaagcagagtgcaaatgtttggcgttttcttcagtcgttgaacgggagacatgatttaacgggagcactgaagaaactccggtgtcggactctaatttttgtgggtgaggactctccgtttcactcagaggccctccacatgaccacaaaactggataggagatacagcgcattggttgaggttcaggcatgtgggtcagtggtgacagaagagcaaccccaagccatgctgataccaatggagtacttcctcatggggtacggtttgtaccgaccaagccagctgagctacagcccaccaagtcctcttaatccattgtgcatctctccagaattgctctcgccagagagcatgggactgaagctaaagcccatcaagactcgaatatcccttgaagtctgagaagttcattcaatttcatcgccgatgaatgttgcaatgccaaaatcaattttgcgtgtaaaacttcgagatatactccttacatgtaaattttttctttctttggagattttagtgcaacagcaggttaatgatctgtagatattatcacgaagtgggataaactaagtgctggattgtgctacattcttttgtactcaaataacttatataaattcaattttttgtggtgatgaaataacgatgag

SEQ ID NO: 3036 - DNA, 1480 bp, Oryza sativa
aggcagcgaggagagagagagagagagaagaggagaggttggtggcagaggaggaggaggaggaggaggaggagaagcttctagaaggggagcggggcggcatgggggactcgagcgggtcggtgtccatcgacgtggagcggatctccttcggcggcaaggaacaccgagtgcgaaccagatatggctctgtatctgtttctgtatttggagatgaagacaagccggcgctcataacatacccggatgtagctctaaattatatgtcttgctttcaaggattgttcttctgcccagaggccgcgtcgctgttgcttcacaatttttgtatttaccacatcactcctcaaggtcatgagttgggagcggctccaatttcatccgatgtgcccgtgccatctgttgatgagcttgtggatcaagtcgcggatgttcttgatttcttcggattaggatctgtgatgtgtttgggtgtcactgccggtgcctacattctcaccctctttgcaacaaaataccgggatagagtgattggccttatgctagtttcgccgctatgcaaagccccttcttggagcgagtggttgtacaataaggtattattaaacttgctttactattatgggagtcgtgggctagtcaaggaatgcttgcttcagcggtattttagcacggaagttcgtgggaatggacaagaccctgaatcagagattgtgcaagcctgtagaagtttacttcatgagcgacagggatctaatgtatggcgattccttcaggcgataaacgagagacatgacctgacggaagcgttgaagaagcttcagtgtcggacactgatttttgtgggagagaactcacagttccacgacgacgcagtccatatgaccacaaagctagaccggagatattgcgccctagtcgaggttcaggcatgcgggtcactcgtcaccgaggagcaaccgcacgcgatgttgatccccatggagtacttcctcatgggatatgggctctacagaccttcccagctggatagcagcccccggagcacactgaacccattctgtatatcgcctgaacttctgtcaccggagagcatgggagtgaagctgaagcccatcaagactcggatctcgctcaaagtttagcaattggcaaatgaatgaatccttgatggcctgacaatacaagctcatgaaggtggaacactgcatgggctagtctgaattcagatggtcactgccagcaagttttggtacctccagtgatgcagctaatggcagttttttttttcttttcattgtggttaactgatataatctgtatcgatgtgttattaggcagaggtgggagtgagtttgtaggggagaagggtgggtctgtttgttcatatgtttgtagtcagaaacacatgtatatctcatcacatcgttccatacgagaaaaagaagagagaaaatgatagaagcagaattttgttgtg

SEQ ID NO: 3037 - DNA, 1615 bp, Cocos nucifera
ggggagtaacggacaggcggggaggcgaggaggggaagggttcggggagtggaggagctccattcttggccgtggaacctcctcgaccaatgggggaatcgagcgggtcggtttcggtcgatgtggagaggatttcccttggtggaaaggaacattttataaaaacaagacatggcacagtgtctgttgctgtttttggagagcaggaaaagcctgcacttgtaacctatccagatgtggctttaaactatgaatcatgcttccaaggattacttttttgccctgaagctgcatctttgcttctccacaacttctgcatatatcatattagtcctcctggacatgagttaggtgctgctccagtttcttcccatgttcctatcccttctgtggatgatttggcagatcagattgctgacgttcttgacatttttgggttaggttcggtaatgtgcttgggggtgacggctggtgcttacatccttaccctttttgctataaagtatagggagcgtgttgcaggtctgatacttgtctctcctctgtgtaaagctccctgttggacagagtggttgtataataaggtaatatcgaatctgttatatttctatgggatgtgtggcttggtcaaggattgcttgcttcagcggtacttcagtaaggaagtccgtggcggtgcacaggtccctgagtcagatattgtgcaagcctgcagaagtttgttgaatgagaggcaaagtaaaaatgtctggtgttttcttcagtcgattaatgggagatacgacatcacagaagaattacatcggctacagtgtcggacacttgtattcgttggtgaagactctccgttctattctgatgccctccacatgacatcaaaactggacagaagatgcagcgccttggtcgaggtccaggcatgtggatcattggtgacagaggagcaaccccatgccatgctgattccaatggagtatttcttcataggctatgggctttacaggccgagccagtttacaggcagtcctcgcagcccgctcagtccatcatgcatctccccggagctgctgtcaccagaaagcatgggcgtgaagctaaagcctatcaagacgagggtgtcgcttgacatttgatagtggtgggcataggcagccagccagaggtttagaaagagtaaagatatgtccagcattttgtgatgttgaagttgtagctgatatgtaaaaatgtgaacaagcgctttttgacacctgggatggaattctttggggtgtagatacaaaagaaaaagaatgcagtgggtggcaggggggccgataggggagtgattctgttccattcgttgtaggcagcttgcccacctgtacatctttcattattcatgataatctaataacaataagatatggtggtgtcctcatcatcggcttctgctttctgatttcatattcatgtgaagtccacctaggggtatattttaaccttttatttaattaaagaaagggtttgtaatcattaggttgtgatatttctagtcacatcctcattattactagattcatagatttattggcatatacttatatttaattgttgttgtttgctttcaaaagcc

SEQ ID NO: 3038 - DNA, 1352 bp, Echinochloa colona
gggaggcgtccgccatgggggactccagcggctcggtgtcggtcgacgtcgagcggatcttcttcggcggcaaggagcatcgagtaagaacgaggcacggccatctttcggtttctgtgtatggagacgaagacaagcccgccctcgtgacttatccggatgtagctttaaatcacatgtcttgcttccaaggattgttcttctgcccggaggctacgtcgctgttgcttcacaacttctgtgtgtaccacatcacccctcaaggacacgagttaggagcggctccaatttcatcagatgtgcctgtgccttctgtcgatgaccttgcagatcaggttgccgatgtccttgactttttcagtttaggggccgtaatgtgcttgggtgtcactgctggtgcctatgttctcaccctctttgcgacaaagtatcgggagagggttcttggcctcatgttggtttcacctctatgcaaagccccttcatggagcgagtggttgtacaataaggtattattaaacttgctttattattatgggacacgtgggttagtcaaggaaagcttgcttcagcgttatttcagcatggaagttcgtggcagcggacaagatcctgaatcagagattgtccaagcctgcagaagtttacttgatgagaggcagggagctaatgtctggcggttccttcaagcaattaacaggcggcacgacttaacggaatcattgaagaagctccagtgccggacgctgatttttgtgggagagaactcacaattccatgacgaggcagtccacatgaccacaaaactagaccggagatactgtgctctagtcgaggttcaggcttgtggttcacttgtcacggaagagcagccacatgccatggtgattccgatggagtacttccttatgggatacgggctctacagacctccgcagcaggaaactagcccccggagtacactgagcccgttctgcatatcgcctgagctactatctcccgagagcatgggagtaaagttgaagcccatcaagacgcggatctccctaaatgtttagcatgggcagatctcggattctggccatggcctgacagccacagctagggaagtgaagagtgcttgggctgggctgcgcaaccacaaagttttgatgccttgcagtgcctggcgtacgaagaggattctacaggctgaaggcaatttttgctgatggtgggaggttgtaggagagggggatgggttgtttgttcatatgtttgtagtcagtacacatgtatatctccacacgagatcgctttatacagaaaatgaaaatggtaaactaaattcctgtccaattcttacatgaaac

SEQ ID NO: 3039 - DNA, 1518 bp, Setaria italica
ggaaggatttagggggaagccagccaagccaagccaagccagcggaggagagagagacaggaggtgggagggagagggaggctgggaagcggtggaggttggtggcacaacaggaggaggaggaggaggaggagcttctggagaggagggttaagggaggcgtctgtccgccatgggggactccagcggctcggtgtcgatcgacgtcgagcggatcttcttcggcggcaaggaacatcgagtgagaacgagacatggccctctttcggtttctgtgtacggagacgaagacaagcccgcgctcgtgacttatccggatgtggctttaaatcacatgtcttgcttccaaggattgttcttctgtccagaggctgcgtcgctcttgcttcacaatttctgcgtctaccacatcacgcctcaaggacacgagttaggagcggctccgatttcatctgacgtgcccgtgccatctgtcgatgaccttgcagatcaggttgccgatgtcctcgattttttcagtttaggtgctgtaatgtgcttgggtgtcactgctggtgcctatgttcttaccctctttgcgacaaagtatcgagagagggttcttggcctcatgttggtttcacctctgtgcaaaggcccttcatggagcgaatggttgtacaataaggtattattaaacttgctttattattatgggacacgtgggttagtcaaggaaagcttgcttcagcgttatttcagcatggaagttcgcggcaatgggcaagatcctgaatcagagattgtccaagcctgcagaagtttacttgatgagaggcagggatctaatgtctggcggttccttcaagcaattaacaggcggcatgacttaacagaatcattgatgaagcttcagtgccggacgctaatttttgttggagaaaactcacaattccatgccgacgcggtccacatgaccacaaaactagaccggagatactgtgctcttgttgaggttcaggcttgtggttcactagtgactgaagagcagccccatgcgatgctcattccgatggaatacttcctgatgggatacggtctttacagacctccgcagcaggaaactagccccaggagtacactgaacccgttctgcatatcgcctgagcttctatcacccgagagtatgggagtgaagctgaagcccatcaagacgcggatatcccttaatgtttagcatgggcagatctcggatagcggccattgcctgacacccgcagctcatgaaagtgaagactgcttgggctgagttgcgcaaccgcaaagttttgatgcctttctgcgcctggtgggcgaagaagattctacaggctgaaggcagttttgttgatagggagcagaggttgttgtggtcttgggaaggggggaatggctgtttgttcatatatttgtagtcagtacacatgtatatctccacacgacatcctttcatacagaaaatgaaaatggtaaagctgaattccagtacgactcacatac

SEQ ID NO: 3040 - DNA, 1467 bp, Setaria italica
cggaggagagagagacaggaggtgggagggagagggaggctgggaagcggtggaggttggtggcacaacaggaggaggaggaggaggaggagcttctggagaggagggttaagggaggcgtctgtccgccatgggggactccagcggctcggtgtcgatcgacgtcgagcggatcttcttcggcggcaaggaacatcgagtgagaacgagacatggccctctttcggtttctgtgtacggagacgaagacaagcccgcgctcgtgacttatccggatgtggctttaaatcacatgtcttgcttccaaggattgttcttctgtccagaggctgcgtcgctcttgcttcacaatttctgcgtctaccacatcacgcctcaaggacacgagttaggagcggctccgatttcatctgacgtgcccgtgccatctgtcgatgaccttgcagatcaggttgccgatgtcctcgattttttcagtttaggtgctgtaatgtgcttgggtgtcactgctggtgcctatgttcttaccctctttgcgacaaagtatcgagagagggttcttggcctcatgttggtttcacctctgtgcaaaggcccttcatggagcgaatggttgtacaataaggtattattaaacttgctttattattatgggacacgtgggttagtcaaggaaagcttgcttcagcgttatttcagcatggaagttcgcggcaatgggcaagatcctgaatcagagattgtccaagcctgcagaagtttacttgatgagaggcagggatctaatgtctggcggttccttcaagcaattaacaggcggcatgacttaacagaatcattgatgaagcttcagtgccggacgctaatttttgttggagaaaactcacaattccatgccgacgcggtccacatgaccacaaaactagaccggagatactgtgctcttgttgaggttcaggcttgtggttcactagtgactgaagagcagccccatgcgatgctcattccgatggaatacttcctgatgggatacggtctttacagacctccgcagcaggaaactagccccaggagtacactgaacccgttctgcatatcgcctgagcttctatcacccgagagtatgggagtgaagctgaagcccatcaagacgcggatatcccttaatgtttagcatgggcagatctcggatagcggccattgcctgacacccgcagctcatgaaagtgaagactgcttgggctgagttgcgcaaccgcaaagttttgatgcctttctgcgcctggtgggcgaagaagattctacaggctgaaggcagttttgttgatagggagcagaggttgttgtggtcttgggaaggggggaatggctgtttgttcatatatttgtagtcagtacacatgtatatctccacacgacatcctttcatacagaaaatgaaaatggtaaagctgaattccagtacga

SEQ ID NO: 3041 - DNA, 3749 bp, Brachypodium distachyon
aaaagggaaggtagggagagagaaagcgagagcgagagagaggccgccgagaccggaaggggaaggggaaggaaggaggaggacgaggaggttggtggtggcttgtggagaagcttctagaagccgccatgggggactctagcggctctgtgtcggtcgacgtggagcggatctacttcggcggcaaggcgcatcctgtgagaacgagatacggctctgtatccgtttctgtatatggagatgaagacaagcccgccctcattacatacccagatgtagctttaaattatatgtcttgcttccaaggattgttcttctgcccagaggctgcgtccctgttgcttcacaatttttgtatttaccatattactcctcaaggacatgagttgggagcagctccaatttcatctgatgtgcctgtgctgtctgttgatgacctcgctgatcaggttgcggatgttcttgatttcttcggtttagggtctgtcatgtgcctgggtgtcacagccggtgcctacgttctcaccctctttgcaacaaagtaccgggaaagggttcttggcctaatgttggtttcacctctatgcaaagccccctcctggaccgagtggttgtataataaggtattgttgaacttgctttattattgtgggacacgtggactagtgaacgaatgcctccttcagcgatactttagcgcggaagttcgcggggatggacaagatccggaatcagaaattgtgcaagcatgtagaagtttacttgacgagagaaagggtgttaatgtattccgattccttaaatcagtaaacgagcgacgcgacttaactgaagcattgaagaagcttcagtgccggacgctgatttttgtgggagaaaactcacagttccatgatgatgctgtccacatgaccacaaaattagaccggagatactgtgccctagttgaggttcaggcatgcgggtcgcttgtcaccgaggagcagccacatgcaatgcttattccgatggagtacttcttaattggatacgggctgtacagaccgtcccagcttgacagcagccccaggagcactctaaacccgttctgcatatcgcctgagctactatcgccggagagcatgggagtgaagctgaagcccatcaagactcggatctccctcaatgtttaatatgggcaagaaaatcttggttgtccgacaatatagttcacgagaacaaatactgctaggggcgttgggccagtcagagcacaagttttgatacctacaagtacctcgcaagttctcatagatcgatctgttaaatggcagttttggccgtggattgctgcaatctgcgtcgatgggatagggggggaaactagtctgaggctgtaggggaggaatacggttgtttgttcatatgcttgtagttcacatgtgtatatatacgtcatcacatcgttccacacagagaagaatatatatggtaaatcagaatcctgtccagaaactttgctttgctgaaagtttagcctgactggttctagctctgtgtcctgttggtgtcgcttcagacgagctattgctgtgtcatggatcgagtgatcgctgggtggtctggttaaatgaatgtgggtgagtggtggctctaccgtcgatggtttagacttgagaatctccctgtcatgtatggttggctccttgtcactttctgtttgttgtaccaacatgaaacacatgcaaagcattgtacagcatagccggtacacatctcgattactcctgcagtcggcatgaacaactacaacagatacaaggggagatttggggacaggaataggtgaattaaggtaaagaagaacttgggagataattcagagattctaacttctgcgaagatgataaatcaggattccatcaagcgacctgtcttccaagccaaattgccggtgaatcagtttggatgtttggggagcaggatccatggggatgggttaatgggttacgtgacggagggagtactagatttcagggctctcgcgtcgcccagctcgggcgactcgggggcgacccccgccgccagccaccgccaccctccctcccttcctctcccctcgccgccgccggaaatcgtgcggccgacgaggatgctggcggcggggctgttgctgctccatctcccgtgcgagccgcccaaaatctccactccacctcgggctcctccaagatccgggacctcctcgccccgtgcgtgtgtgtaccggcccaggtcgcgcgtcccgcgggctcctcggccctgctccggccaaccgccgccgtcggcctcgccgcctgcacccgcttcccctcgccgtccatcccgtgctcggtccctgccaaatccgggcctcaccctcgccatcccttgtccggccgcctccactccatgcatggccgccgccgccaatttctggctccgccaccaacctctgttgcatccctcaggtctgcaccagcctcatccccatcccaccatcaccagccccttcccttgcacctcacagttcaaaaacatcttgaggttcacgctgattagtgatgtttcgcgctccttttttctctcatcgtccctccctccgttggctatggcattgtcatgccttcggtaaccatggcttgcagttggcagttgtggtggcggcatcgcttaacggctggtgtcgtggttttgaccttgagatctctatacaacctgtgctattgagctctgggatccgtggttatgcagatggcagccatggaggcggcatcctcccgtcggagatggccgtgatagagggcgtgtgtgctgtatgcggcttttgatttgtgaaaccaaccttccaccttccacaatgctcccgtggtcccacttagctcctcgccaccgtgttcaagcttagtacatatccccactgcgccacagcttcatcgccattcttgtctccaatgggccgtcgcatgtgatcttcatttacactcctcatgggctatgcccttccatctcgtggagatgttttcacttgctgcactctttttgatcgcgttcttccattgtggatgtaccccccatccatcgtgtgtgatcgacgagcttgactcttctcctctctcctacgtactcaccaaccatccccggaatttccggcggtgtgtgcgtggtggttgagggttgctgattgtgttgctgtccattggagagagtttcggttgttttgcctgctggccgttggagttgttcggaacggctcaacgcatggttcaaagttcatttctgtgctgtcttcaggcatttgcgcggccattgacagtcccctttctctgctcgtcgcccggtgtcggctacaacatgacctctgctgtaattggagtctcctagtcgcagatgtttaggagttttcctctttcgtgtgtgtactgggttttggtatttttcatgtgttccttgctccggcaaggtgtattgcccgtcgggtttccttttggaaatatattcaggtggaattttcaaccccccgtgatctctcaaaaaaactatctcaacattttcaacttgactgttcgagaagcagaaggaaaacatgttcaaccagacttcacataccagtgcagccagcacaattttgcaatgcagttgctacaggggacagcttgcgtgcctttcctgatgcatctgtcattgcttgaagcaaagtatgtgtttcttcagttcacgactgatattagctttttttcatgtatatttgt

SEQ ID NO: 3042 - DNA, 1640 bp, Cocos nucifera
ggaggagtgagggacaggcggaggcgagcttctcggtcgtgaaacgtcctcggccgcctaatgggggaatcgagcgggtcggtttcgatcgatgtggagaggatctctctcggcggaaaggagcattttataaaaacaagacatggcacagtgtctgttgctgtgtttggagatcaggaaaagcctgcacttgtaacctatccagatgtggctttaaactatgaatcatgcttccaaggattacttttttgccctgaagctgcatctttgcttctccacaacttctgcatatatcatattagtcctccaggacatgagttaggagctgctccaatttcttccgatgttcccatcccctctgtcaatgatttggcagatcagattgctgatgttcttgatatttttagattaggtccagtaatgtgcttgggggtcacggctggtgcttatatccttaccctttttgctacaaaatataaggagcgtgttgcaggtctgatacttgtctctcctctatgtaaagctccctcatggacggagtggttgtataataaggtaatctccaatttgctctatttctatggcatgtgtggcttggttaaggattgcttgcttcagcggtactttagtaaggaggtccgtggcagtgcacaggtcccggagtcagatattgtacaagcctgcagaagtttgttggatgagaggcaaggtgaaaatgtctggcggtttcttcaatcaattaatgggagatatgacatcaccggagaattacatcagctacagtgtcggacacttatatttgttggtgaagattctccatactactctgatgccctccacatgacatcaaaactagacagaagatacagcgccttggtcgaggtccaggcttgtggctcagtggtgacagaggagcaaccccatgccatgctgatacccatggagtacttcttcatagggtatgggctctacaggccaagtcagtttactggcagcccacgcagcccgctcagtccatggtgcatctctccagatttgctgtcacctgaaagcatgggtgtgaagctaaagcctatcaagacaaggatgtcacttgacatttgatggtgatgggcatattctgcaattgaggtttagaaagagtaaagatatctccaacattttgtaacattgaatttgtagctgataatataaaaatgtatacaagctcttttgacatgtagcatggatttcttcgggagtgtagatacaagaggaaaagagtctggagggtagcgtggggaatgcatggacagcgaagagcatttgtacgcatcatgctcgccgtaaatcttcattattcatgatgagctaataacaataagaggtattggcctcctcaataatgacttgtgtcgtgtggtttcatattcaatggaaacgtccgcctgtaattattttattcttttgtttaaagaaagaaaagtgttggcaatcataaaattgtcgtgatccttctggtcattctcatgatcaccagaatcatacctttattcacacaccttctatttaattattattgtttgctttcactaactgactctatgtttcttataagggcttgagggtggaactgttttcagtggggaatttgtattgct

SEQ ID NO: 3043 - DNA, 3597 bp, Brachypodium distachyon
gggaaggtagggagagagaaagcgagagcgagagagaggccgccgagaccggaaggggaaggggaaggaaggaggaggacgaggaggttggtggtggcttgtggagaagcttctagaagccgccatgggggactctagcggctctgtgtcggtcgacgtggagcggatctacttcggcggcaaggcgcatcctgtgagaacgagatacggctctgtatccgtttctgtatatggagatgaagacaagcccgccctcattacatacccagatgtagctttaaattatatgtcttgcttccaaggattgttcttctgcccagaggctgcgtccctgttgcttcacaatttttgtatttaccatattactcctcaaggacatgagttgggagcagctccaatttcatctgatgtgcctgtgctgtctgttgatgacctcgctgatcaggttgcggatgttcttgatttcttcggtttagggtctgtcatgtgcctgggtgtcacagccggtgcctacgttctcaccctctttgcaacaaagtaccgggaaagggttcttggcctaatgttggtttcacctctatgcaaagccccctcctggaccgagtggttgtataataaggtattgttgaacttgctttattattgtgggacacgtggactagtgaacgaatgcctccttcagcgatactttagcgcggaagttcgcggggatggacaagatccggaatcagaaattgtgcaagcatgtagaagtttacttgacgagagaaagggtgttaatgtattccgattccttaaatcagtaaacgagcgacgcgacttaactgaagcattgaagaagcttcagtgccggacgctgatttttgtgggagaaaactcacagttccatgatgatgctgtccacatgaccacaaaattagaccggagatactgtgccctagttgaggttcaggcatgcgggtcgcttgtcaccgaggagcagccacatgcaatgcttattccgatggagtacttcttaattggatacgggctgtacagaccgtcccagcttgacagcagccccaggagcactctaaacccgttctgcatatcgcctgagctactatcgccggagagcatgggagtgaagctgaagcccatcaagactcggatctccctcaatgtttaatatgggcaagaaaatcttggttgtccgacaatatagttcacgagaacaaatactgctaggggcgttgggccagtcagagcacaagttttgatacctacaagtacctcgcaagttctcatagatcgatctgttaaatggcagttttggccgtggattgctgcaatctgcgtcgatgggatagggggggaaactagtctgaggctgtaggggaggaatacggttgtttgttcatatgcttgtagttcacatgtgtatatatacgtcatcacatcgttccacacagagaagaatatatatggtaaatcagaatcctgtccagaaactttgctttgctgaaagtttagcctgactggttctagctctgtgtcctgttggtgtcgcttcagacgagctattgctgtgtcatggatcgagtgatcgctgggtggtctggttaaatgaatgtgggtgagtggtggctctaccgtcgatggtttagacttgagaatctccctgtcatgtatggttggctccttgtcactttctgtttgttgtaccaacatgaaacacatgcaaagcattgtacagcatagccggtacacatctcgattactcctgcagtcggcatgaacaactacaacagatacaaggggagatttggggacaggaataggtgaattaaggtaaagaagaacttgggagataattcagagattctaacttctgcgaagatgataaatcaggattccatcaagcgacctgtcttccaagccaaattgccggtgaatcagtttggatgtttggggagcaggatccatggggatgggttaatgggttacgtgacggagggagtactagatttcaggtaagcaccatgcctgttactctcatggtcgcataatccccagttctctcgattcattattactgaacttgaaggaatcatatctaaacattttgatcttgcgatttttcatttggagggctctcgcgtcgcccagctcgggcgactcgggggcgacccccgccgccagccaccgccaccctccctcccttcctctcccctcgccgccgccggaaatcgtgcggccgacgaggatgctggcggcggggctgttgctgctccatctcccgtgcgagccgcccaaaatctccactccacctcgggctcctccaagatccgggacctcctcgccccgtgcgtgtgtgtaccggcccaggtcgcgcgtcccgcgggctcctcggccctgctccggccaaccgccgccgtcggcctcgccgcctgcacccgcttcccctcgccgtccatcccgtgctcggtccctgccaaatccgggcctcaccctcgccatcccttgtccggccgcctccactccatgcatggccgccgccgccaatttctggctccgccaccaacctctgttgcatccctcaggtctgcaccagcctcatccccatcccaccatcaccagccccttcccttgcacctcacagttcaaaaacatcttgaggttcacgctgattagtgatgtttcgcgctccttttttctctcatcgtccctccctccgttggctatggcattgtcatgccttcggtaaccatggcttgcagttggcagttgtggtggcggcatcgcttaacggctggtgtcgtggttttgaccttgagatctctatacaacctgtgctattgagctctgggatccgtggttatgcagatggcagccatggaggcggcatcctcccgtcggagatggccgtgatagagggcgtgtgtgctgtatgcggcttttgatttgtgaaaccaaccttccaccttccacaatgctcccgtggtcccacttagctcctcgccaccgtgttcaagcttagtacatatccccactgcgccacagcttcatcgccattcttgtctccaatgggccgtcgcatgtgatcttcatttacactcctcatgggctatgcccttccatctcgtggagatgttttcacttgctgcactctttttgatcgcgttcttccattgtggatgtaccccccatccatcgtgtgtgatcgacgagcttgactcttctcctctctcctacgtactcaccaaccatccccggaatttccggcggtgtgtgcgtggtggttgagggttgctgattgtgttgctgtccattggagagagtttcggttgttttgcctgctggccgttggagttgttcggaacggctcaacgcatggttcaaagttcatttctgtgctgtcttcaggcatttgcgcggccattgacagtcccctttctctgctcgtcgcccggtgtcggctacaacatgacctctgctgtaattggagtctcctagtcgcagatgtttaggagttttcctctttcgtgtgtgtactgggttttggtatttttcatgtgttccttgctccggcaaggtgtattgcccgtcgggtttcct

SEQ ID NO: 3044 - DNA, 1612 bp, Festuca arundinacea
aggcaagggagagagagagagagagagagagagagagaggccgcccagaaccagaaagaagcaggaggtgaggaggaagaggttggtgtccgtggagaagcttctagaagccgccagccatgggggactcgagcgggtcggtgtccatcgacgtggagcggatctacttcggcggcaaggagcatcctgtgaggacgagatacggctctgtatctgtttctgtgtacggagacgaagacaagccggctctcataacatacccggatgtagctctaaattacatgtcttgcttccaaggattgttcttctgtccagaggctgcgtcactgttgcttcacaatttctgtatttaccatattactcctcaaggccatgagttgggagcagctccaattccatcaaatgaacctgagctatctgttgataagcttgcggatcaggtcgcggatgttcttgatttcttcggtttagggtctgtgatgtgtctgggtgtcaccgctggtgcctacgtgcttaccctctttgcgacaaagtaccgggaaagggttcttggccttatgttggtttcacctctatgcaaagccccatcttggagtgagtggttgtacaataaggtattgttaaacctgctctattattgtgggaccagtgggctggtgaatgaatgcctgcttcagcggtattttagctcggaagttcgagggagtggacaggagcctgaatcagagattgtgcaagcgtgtcgaagtttgcttgatcagaggcagggagttaatgtatgtcgattccttaaagcaataaacgagaggcatgacttgactgaagcactgaagaaacttcagtgcaggacactgatttttgttggagagaactcgcaattccatgccgacgctgtccacatgaccacgaaattagaccggagatattgtgctctagttgaggttcaggcatgcggctcacttgtcaccgaggagcagccacacgcaatgctgataccaatggaatacttcttgatgggatatggcctctacagaccttccccgctcgacagcagccctcggagcactctaaacccattctgcatatcgccggagctcctgtcacccgagagcatgggggtgaagctgaagcccatcaagactcggacctccctcaatgtttaacataggggggaagatcttgcatggcctagctcacaaaagcaaagagtgtttgagctagagcatggtcattttcacagaagttttgatgcattccagcacccggcacgtgatgcttagatcaacacgctagcgtcagttttcgctgtagattgctgtaagcctgtaatctacgtttctcgaataggccccataatctacgtctctgggataggcaagggggagagagactagggtaaggttagaagggaggaatacgtacagttttttttttgttcatatgctttgttttagtccacatgtgtatatgtcaccacatcacatttcacacagaaaaggtatatatataatatatatggtaaagcaggaccctgttatggagtctcagacgttggctttgcctttgctggaaagtttagcatgactggctgtcgaaaaaaaaaaaaaaaaaa

SEQ ID NO: 3045 - DNA, 1487 bp, Festuca arundinacea
gagagagagagagaggtcgcccagaaccaggaggaagcaggaggcgaggaggaagaggttggtgtccgtggagaagcttctagaagccgccagccatgggggactcgagcgggtcggtgtccatcgacgtggagcggatctacttcggcggcaaggagcatcctgtgaggacgagatacggctctgtatctgtttctgtgtacggagacgaagacaagccggctctcataacatacccggatgtagctctaaattacatgtcttgcttccaaggattgttcttctgtccagaggctgcgtcactgttgcttcacaatttctgtatttaccatattactcctcaaggccatgagttgggagcagctccaattccatcaaatgaacctgagctatctgttgataagcttgcggatcaggtcgcggatgttcttgatttcttcggtttagggtctgtgatgtgtctgggtgtcaccgctggtgcttacgtgcttaccctctttgcgacaaagtaccgggaaagggttcttggccttatgttggtttcacctctatgcaaggccccatcttggagcgagtggttgtacaataaggtattgttaaacctgctctattattgtgggaccagtgggctggtgaatgaatgcctgcttcagcggtattttagctcggaagttcgagggagtggacaggagcctgaatcagagattgtgcaagcgtgtcgaagtttgcttgatcagaggcagggagttaatgtatgtcgattccttaaagcaataaacgagaggcatgacttgactgaagcactgaagaaacttcagtgcaggacactgatttttgttggagagaactcgcaattccatgccgacgctgtccacatgaccacgaaattagaccggagatattgtgctctagttgaggttcaggcatgcggctcacttgtcaccgaggagcagccacacgcaatgctgataccaatggaatacttcttgatgggatacggcctctacagaccttccccgctcgacagcagccctcggagcactctgaacccattctgcatatcgccggagctcctgtcaccagagagcatgggggtgaagcttaagcccatcaagactcggacctccctcaatgtttaaacataggggggaagatcttgcatggcctagctcacaaaagcaaagagtatttgagctagagcatggtcattttcacagaagttttgatgcattccagcacccggcacgtgatgcttagatcaacacgctagcgtcagttttcgctgtagattgctgtaagcctgtaatctacgtttctcgaataggccctgtaatctacgtctctgggataggcaaggggagagagagactagggtaaggttagaagggaggaatacgtacggtttttttttttgttcatatgctttgttttagtccacatgtgtatatgtcaccacatcacatttcacacagaaaaggtatatatat

SEQ ID NO: 3046 - DNA, 1492 bp, Lolium multiflorum
taaggcaagggagggagagagagaggccgcccagagccaggaagaagcaggaggcgaggaggaagaggttggtgtccgtggagaagcttctagaagccgccagccagccatgggggactcgagcgggtcggtgtccatcgacgtggagcggatctacttcggcggcaaggagcatcctgtgaggacgagatacggctctgtatctgtgtctgtgtacggggacgaagacaagccggccctcataacatacccggatgtagctctaaattacatgtcttgcttccaaggattgttcttctgcccagaggctgcgtcactgttgcttcacaatttctgtatttaccatattactcctcaaggccatgagttgggagcagctccaattccatcaaatgaacctgagctatctgttgataagcttgcggatcaggtcgcggatgttcttgatttcttcggtttagggtctgtgatgtgtctgggtgtcaccgccggtgcctacgtgcttaccctctttgcgacaaagtaccgggaaagggttcttggccttatgttggtttcacctctatgcaaagccccatcttggagtgagtggttgtacaataaggtattgttaaacctgctctattattgtgggaccagtgggctggtgaatgaatgcctgcttcagcggtattttagctcggaagttcgagggagtggacaggagcctgaatcagagattgtgcaagcgtgtcgaagtttgcttgatcagaggcagggagttaatgtatgtcgattccttaaagcaataaacgagaggcatgacttgactgaagcactgaagaaacttcagtgcaggacactgatttttgttggagagaactcgcaattccatgccgacgctgtccacatgaccacgaaattagaccggagatattgtgctctagttgaggttcaggcatgcggctcacttgtcaccgaggagcagccacacgcaatgctgataccaatggaatacttcttgatgggatacggcctctacagaccttccccgctcgacagcagccctcggagcactctaaacccattctgcatatcgccggagctcctgtcaccagagagcatgggggtgaagctgaagcccatcaagactcggacctccctcaatgtttaacataggggggaagatcttgcatggcctagctcacaaaagcaaagagtgtttgagctagagcatggtcattttcacagaagttttgatgcattccagcacccggcacgtgatgcttagatcaacacgctagcgtcagttttcgctgtagattgctgtaagcctgtaatctacgtttctcgaataggccctataatctacgtctctgggataggcaagggggagagagactagggtaaggttagaagggaggaatacgtacggtttttctgttttgttcatatgctttgttttagtccacatgtgtatatgtcaccacatcacatttcacacagaaaaggt

SEQ ID NO: 3047 - DNA, 1740 bp, Elaeis guineensis
gcgaaaaggggaggctcggttctcggtcgtgaacgtcctcggccgtctaatgggggaatcgagcgggtcggtttcgatcgatgtggagaggatctctctcggcggaaaggagcattttataaaaacaagacatggcagagtgtctgttgctgtttttggagatcaggaaaagccagcacttgtaacctatccagatgtggctttaaaccatgtatcatgcttccaaggattattcttttgccctgaagctgcatctttgcttctccacaacttctgcatatatcatattagtcctccaggacatgagttaggagctgctccaatttcttctgatgttcccatcccctctgtcaatgatttggcagatcagatagctgatgttcttgatattttcaggttaggtccagtaatgtgcttgggggtcacggctggtgcttatatccttaccctttttgctataaagtataaggagcgtgttgcaggtctgatacttgtctctcctctatgtaaagccccctcctggatggagtggttgtataataaggtaatctccaatttgctttatttctatggcatgtgtggcttggttaaggattgcttgcttcagcggtactttagtaaggaagtccgtggcagcgcacaggtcccggagtcagatattgtacaagcctgcagaagtttgttggatgaaaggcaaagtgaaaatgtctggcggtttcttcaatcaattaatgggagatacgacatcacagaagaattacatcggctacagtgtcggacacttatatttgttggtgaagattctccatactattctgatgctgtccacatgacatcaaaactagacagaagatacagtgccctggtcgaggtccaggcatgtggatcagtggtgacagaggagcaaccccatgccatgctgatacccatggagtacttcttcatagggtatgggctctacaggccaagccagtttactggcagcccacgcagcccgctcagtccatggtgcatctctccggatctgctgtcacctgaaagcatgggtgtgaagctaaagcctatcaagacaagggtgtcaatggacatttgatagtggtgggcatagaccgcaagtgaggtttacaaagagtcaagatatctccaacattttgtcatgctgaagttgtagctgataatataaaaatgtatacaagctcttgtgacatgtaggatggatttctttgggagtgtagatacaagaggaaaagagtctgggggaagcggggggaaagcatggacagcaaagagaatctattcctttcatttgtaggcatcatgctcgcctgtaaattttcattattcatgatgagctaataacaataagaggtagtggcatcctcaatcatgacttgtgttgtgtggtttcatattcaatggaattgtccgcgtagtaattattttattcttttgtttaaagaaagaaaagtgtttgtaatcataattgttgtgatctttctggtcattctcatgatcactagaatcatacctttattgacaccacctatttaattgttaatatttccttttcgaagtaaactgtaactttattgttttacttaagtaagggtcttagagtaggttacggtaaacgtttgtttttacgtaaggttgggtaggttaaatttttaggttaatttcgtcgttcggtcccttactagtttaggagtactttatttggtggtcgtgggtaatttacgg

SEQ ID NO: 3048 - DNA, 1700 bp, Panicum virgatum
agggggaagccagccaagccgagccaagccagcggaggggagagagagacaggagggagggggagaggctcggaagcgggggaggttggtggcgcagcaggtggaggaggagcttctagaggagggttaagggaggcgggcgcgccatgggggactccagcggctcggtgtcgatcgacgtcgagcggatcttcttcggcggcaaggaacatcgagtaagaacgagacatggccctctttcggtttctgtatatggagacgaagacaagcccgcgctcataacttatccagatgtagccttgaaccacatgtcttgcttccaaggattgtttttctgtccagaggctgcgtcgctgttgcttcacaatttctgtgtctaccacatcacccctcaaggacacgagttaggagccgctccgatttcatctgatgtgcccgtgccatctgtcgatgaccttgcagaccaggttgccgatgtccttgatttttttagtttaggtgctgtaatgtgcttgggtgtcaccgctggtgcctatgttctcactctctttgcgacaaagtatcgggagagggttcttggcctcatgttggtttcacctctatgcaaagccccttcatggagcgagtggttgtataataaggtattattaaacttgctttattattatggaacacgtggcttagtcaaggaaagcttgcttcagcgttatttcagcatggaagttcgtggcaacaggcaagatcctgaatcagatattgtccaagcctgcagaagtttacttgaagaaaggcagggagctaatgtctggcggttccttcaagcaattaacaggcggcatgacttaacagaatcactgatgaagcttcagtgccggacgctaatttttgtgggagaaaactcacaattccatgccgacgcagtccacatgaccacaaaactagaccagagatactgcgctctagtcgaggttcaggcttgtggttcactagtgaccgaagagcagccccatgcgatgctcattccgatggaatacttccttatgggatacgggctttacagacctccacagcaggacactagcccccggagtacactgaacccgttctgcatatcgcccgaacttctgtctcccgagagcatgggggtaaagctgaagcccatcaagacgcggatctcactaaatgtttagcatgggcagatcttggatggccatggcctgacaagtaacaaccacagctcatgaaagtgaagactgcttgggctgagttttgcaaccacaagttttgcgcctggtatgcgaagaaaattctacaggctgaaggcagattttgttgatgcggggaggttgtagtattgtaggggagggcagaatggcagatggctgtttgttaatatgtttgtagtcagtacacatgtatatgtcacgatatcgtgtcatacaaaaatataaatggtaaaggtgaattccacttcgattctcgcatcaactcttgcaaaccttagccggtggaaacatacggcagctggagcgtcaatccatgttcaaaagcgataaaactacgattttaacagacttatgataaactcgtgccactattacctcaaggagccactggtcagcgtccattcacagccggagtacagtagaacaaaaggctaagagctaattccctcaatgccattaaaattttagccaatc

SEQ ID NO: 3049 - DNA, 1447 bp, Zea mays
gagttcaggggggagccagcgaaagacaagacaagacaagccaggccagcggcggaggagagggagagagagagagagagcacgcgacaggaggcaggagggcgaggaggagcttgtagagggttaaggaaggcgaccgccatgggggactccagcggctccgtgtcggtcgacgtcgagcggatcttcttcggcggcaaggagcatcgagtaagaacgaggcatggctctctttcggtttctgtgtatggagacgaggacaagcccgcgctcgtaacttatccggatgtagccttaaatcacatgtcttgcttccaaggattgttcttctgtccggaggctgcgtccctgttgcttcacagtttctgcgtgtaccacatcacacctcaaggacacgagttgggagcagctccgatttcagctgatgtgcctgtgccatctgtcgacgaccttgcagatcaggttgctgatgtcctcgattttttcagtttagggtctgtcatgtgcttgggtgtcactgctggtgcctatgttctcaccctctttgcaactaagtatcgggagagggttcttggcctcatgttggtttcacctgtatgcaaagccccctcctggagcgagtggctgtataataaggtattatcaaacttgctttattactacgggacacgtgggttagtcaaggaaagtttgcttcagcggtacttcagcatggacgttcgtggtaacgggcaagatcctgagtcagagattgtccaagcctgcagaagtttacttgacgagaggcagggagctaacgtctggcggttccttcaggcaattagcaggcggcatgacttaacggaatcgctgaagaagctcaagtgccggacgctgatctttgttggagaaaactcacagttccatgcggacgctgtccacatgaccacaaagctggaccggagatactgcgctctagtcgaggttcaggcttgtggttcacttgtcacagaagagcagccccatgcgatggtgatcccgatggaatacttcctcatggggtacgggctctacaggccatcgcagcaggaaagcagcccccggagcacactgagcccgttctgcatatcacccgagcttctgtcaccggagagcatgggggtgaagctgaagcccatcaagacgcgcatctcgcttaacgtttagcatgggtggatctcggatggccatggcttgacaaccacagctcagctcatgaaagtgaagactccttgggctgagttgtgcagacacagttttgatgcctttcggcacctagcgttcgaagatctacaggtagaaggcagatttgttgttaatggctgtttttgttcatatatataatatatgatatgtaacttagtacacatgtatatctcaacacgtcatcgtttcatacagtacagaaaaacaaaatgtgaaagctgaa

SEQ ID NO: 3050 - DNA, 1502 bp, Pennisetum glaucum
tgaaagccatgaagactaataaagctatcacatcgtgtcgaatgagagagagaggcttggaagcggtggaggacggttggtgggcagggcacacgcaacagggaggaacaggaggaggaagaggaggagcttctcgagggagagggttaagggagagaggcgtccgctgtccgccatgggggactccagcggctcggtgtcgatcgacgtcgagcggatcttcttcggcggcaaggaacatcgagtgaggacgagacacggccttctttcggtttctgtgtacggagacgaagacaagcccgccctcgtgacttatccggatgtggctttaaatcacatgtcttgcttccaaggattgttcttctgtccagaggctgcgtcgctgttgcttcacaatttctgcgtctaccacatcacccctcaagggcacgagttaggagcggctccaatttcatctgatgtgcctgtgccatctgtcgatgaccttgcagatcaagttgccgacgtcctcgattttttcagtttaggtgctgtaatgtgcttgggtgtcacagctggggcctacgttcttaccctctttgcgacaaaatatcgagagagggttcttggtctcatgttggtttcacctctatgcaaagccccttcatggagcgaatggttgtataataaggtattattaaacttgctttattattatgggacacgtgggttagtcaaggaaagcttgcttcagcgttatttcagcatggaagttcgtggcaacgggcacgatcctgagtcagagattgtccaagcctgcagaagtctacttgatgagaggcagggatctaacgtctggcggttccttcaagcaattaacaggcggcacgacttaacggaatcattgatgaagctccagtgccggacgctaatttttgtgggagaaaactcccaattccatgccgacgcagtccacatgaccacaaaactagaccggagatactgtgctctggtagaggttcaggcttgtggttcactagtgaccgaagaacaacctcacgcgatgctcattccgatggagtacttcctgatgggatacggtctctacagacctccgcagcaggaaacaagccccaggagtacactgaacccgttctgcatatcgcctgagctcctgtcgcccgagagtatgggagtgaagctgaagcccatcaagacgcggatatcccttaacgtttagcatgggcagatctgggtgggatgacggccattgcctgacacccgtcagctcatgaaagtgaagactgcttgggctgagttgcgcaaccacaaagttttgaacttttgatgcctttctgcgcctggtgtgggcgaaggctgaaggcagtttttttgttgatagggggaggtggttggggttttggggaggggagatggctgtttgtccatatatttgtagtcagtacacatgtatatctctacacgatatccttttatacagaaatgaaaatggttaagctgaa

SEQ ID NO: 3051 - DNA, 1526 bp, Sorghum bicolor
gggggaggagccagcgaagccaaggcaagccagagccaggccacagcggcggaggcgagagagagagagagagagaaagaggaggcggaaggagagggagggaggaggagcttctagagggttaagggaggcgaccgccatgggggactccagtggctccgtgtcggtcgacgtcgagcggctcttcttcggcggcaaggagcatcgagtaagaacgaggcatggccctctatcggtttctgtgtatggagatgaggacaagcccgcgctcgtaacttatccggatgtagccttaaatcacatgtcttgcttccaaggattgttcttctgtccagaggctgtgtcgctgttgcttcacaatttctgtgtgtatcacatcacacctcaaggacacgagttaggagcggctccgatttcagctgatgtgcctctgccatccgtcgatgaccttgcagatcaggttgctgatgtccttgattttttcagtttagggtctgtaatgtgcttgggtgtcactgctggtgcctatgtcctcaccctctttgcaacgaagtatcgggagagggttcttggcctaatgttggtttcacctgtatgcaaagccccctcttggagcgagtggttgtataataaggtattattaaacttgctttattactatgggacacgtgggttagtcaaggaaagtttgcttcagcgatatttcagcatggacgttcgtggtaacgggcaagatcctgaatcagagattgtccaagcctgcagaagtttacttgatgagaggcagggaactaacgtctggcggttccttcaggcaattaacaggcggcatgatttaacagaatcattgaagaagcttcagtgccggaccctgatttttgttggggacaactcacagttccatgctgacgctgtccacatgaccacaaagctggaccggagatactgcgctctagtcgaggttcaggcctgtggttcgcttgtcacagaagagcagccccatgcgatggtgatcccgatggaatacttcctaatgggatacgggctttacaggccatcccagcaggaaagcagcccccggagcacactgagcccgttctgcatatcgcccgagcttctatcgccggagagcatgggagtgaagctgaagcccatcaagacacgcatctcgcttaacgtttagcatgggtgatgggtgaagacttctcggatggccatggcctgacaaccacacagctcatgaaagtgaagactccttgggctgagttgtgcagccacaaagttttgatgccttaaggcacctggcgtggttgaaggcactttttgttgatgcagagaggttgtaggcgagggagtaatgggctaatggctgtttgttcatatatataatataatctgtatgtagtcagtacacatgtatatctcaacacggcatcatttcatacggtacagagaaagaaaatgggaaagctaaactatcacgtgaactctcaggccctaggattgtgtcaacatacagattttgg

SEQ ID NO: 3052 - DNA, 1528 bp, Musa acuminata
gggaagtcgagaaagggaagattggtatttaagccgagaccatcggaggaaagacgcagctcctcgagggagaggactgaggagaagacagcggggtgggggcgggggttggtgatgggagaatcgagcgcgtcggtctcgctggatgtggagcggatctcgtttggaggaaaggaacatcatgttttaacaagccatggtcccatatcagttgccgtgtatggggatctcgagaagcctggacttattacttacccagatgttgctttaaattatatgtcctgctttcaaggattattcttttgtcctgaagctgcttctttgcttcttcacaatttctgcatctaccatatcagtcctccaggacatgagttaggtgctgctccaatttctccaaatgatccagttctctctgttgatcaattagcagatcaagtggcagatgttcttgatttctttgagttgggtcccgtaatgtgcttgggggtcacagcaggtgcttacgtactcactctgtttgctacaaaatatagggaacgcgttctaggtttgatacttgtatcacccctatgtaaagctccctcatggacagaatggttgtatagtaaggtgatgttaaattttctctatttttatggaatttgtggcttgattaaggaatccttacttcatcgatatttcagtaagggagtacgaggaagttcacaggttcctgaatcagatattgtgcaagcatgtagaagtttgttggatcaaaggcatggtgtaaacgtgtggcgatttcttcagtcaataaatgagagatatgacttggcagaggcatcgaagaaacttcagtgtaggacactaatttttgttggtgagaattctcccttccgtttggaggccattaacatggtgacaaaactggacagaagattcagtgccctggtcgaggttcaggcgtgtggatcagttgtgactgaagagcagccttacgcaatgctgataccgatcgaatacttcctcatgggctatggtttgtaccgaccaagccaggtaagctgcagcccacggagtccactcagtccatcgtgcatctcgccggagctactctctccggagagtatgggagtgaagctgaagccgatcaagactcggatctcactccacgtttgaaaatcaagaaggtggcggtacctagctggcagatcggcgacagcttgtgcaaatttgaatgatcggtcttcaagaactgtaaattaaagatgtatttataaacatagatacaaatttttggtcgtttggactgtagatacgagaagtgataaacagaagcatgtgtcgaggacaagctaccgaggaggtgggggatcgcggatcggtggggttccatctgattcactttgtagatgtgcgatgtgtatatcttttatttcttgtgaggacaagaagacaataaaagggggtgactgattgtcctcgatctattagatcattttgtatctgttgtagctcttttattctgctacttaatatttgggatgat

SEQ ID NO: 3053 - DNA, 1591 bp, Musa acuminata
gaaagggaagattggtatttaagccgagaccatcggaggaaagacgcagctcctcgagggagaggactgaggagaagacagcggggcgggggcgggggttggtgatgggagaatcgagcgcgtcggtctcgctggatgtggagcggatctcgtttggaggaaaggaacatcatgttttaacaagccatggtcccatatcagttgccgtgtatggggatctcgagaagcctggacttattacttacccagatgttgctttaaattatatgtcctgctttcaaggattattcttttgtcctgaagctgcttctttgcttcttcacaatttctgcatctaccatatcagtcctccaggacatgagttaggtgctgctccaatttctccaaatgatccagttctctctgttgatcaattagcagatcaagtggcagatgttcttgatttctttgagttgggtcccgtaatgtgcttgggggtcacagcaggtgcttacgtactcactctgtttgctacaaaatatagggaacgcgttctaggtttgatacttgtatcacccctttgtaaagctccctcatggacagaatggttgtatagtaaggtgatgttaaattttctttatttttatggaatttgtggcttgattaaggaatccttacttcatcgatatttcagtaagggagtacgaggaagttcacaggttcctgaatcagatattgtgcaagcatgtagaagtttgttggatcaaaggcatggtgtaaacgtgtggcgatttcttcagtcaataaatgagagatatgacttggcagaggcatcgaagaaacttcagtgtaggacactaatttttgttggtgagaattctcccttccgtttggaggccattaacatggtgacaaaactggacagaagattcagtgccctggtcgaggttcaggcgtgtggatcagttgtgactgaagagcagccttacgcaatgctgataccgatcgaatacttcctcatgggctatggtttgtaccgaccaagccaggtaagctgcagcccacggagtccactcagtccatcgtgcatctcgccggagctactctctccggagagtatgggagtgaagctgaagccgatcaagactcggatctcactccacgtttgaaaatcaagaaggtggcggtacctagctggcagatcggcgacagcttgtgcaaattagaatgatcggtcttcaagaactgtaaattaaagatgtatttataaacatagatacaaatttttggtcgtttggactgtagataggagaagtgataaacagaagcatgtgtcgatgacaagctaccgaggaggtgggggatcgcggatcggtggggttccatctgattcactttgtagatgtgcgatgtgtatatcttttatttcttgtgaggacaagaagacaataaaagggggtgactgattgtcctcgatctattagatcattttgtatctgttgtagctcttttattcagctacttaatatttgggatgatattatttcggaggtccttgttgtttgaggtacccacctgtcaatatgacacagaataatatatgctatttatt

SEQ ID NO: 3054 - DNA, 1641 bp, Hordeum vulgare
cggtaagctcaccgccgtcggtggcgagtttatttctgggccgcgacgccctcgcgtatatatgcacgcgatagacgccaagggtggggggaaggaggagacagagcgagagagccggaagaggaagaggaagaggcgagcgacgacgacgacgaggaggaggaggacggggttgttggtgggctgttgagaggaagcttctggaagccgccatgggggactcgagcgggtcggtgtccatcgacgtggagcggatctacttcggcggcaaggagcatcctgtgagaacaagatacggccctgtatctgtatccgtgtacggagacgaagacaagccagcgctcataacgtacccggatgtagctctgaattacatgtcctgcttccaaggattgttcttctgcccagaggctgcgtccctgttgcttcacaatttttgtatctaccatattactcctcaaggccatgagttgggagcagctccgattccatcggatgtacctgagctatctgttgataatctcgcggatcaggtcgcggacgttcttgatttcttcggtttagggtctgtgatgtgcatgggtgtcaccgccggtgcctacgtgcttaccctctttgcagcaaagtacagggaaagggttcttggcctgatgttggtttcacctctatgcaaagccccatcttggagtgagtggttgtataacaaggtattgctaaacttactttattattgtggtactagtggactagtgaacgaatgcctccttcagcggtattttagcacggaagttcgtggtagtggacaagaacctgaatcggaaattgtccaggcctgtagaagtttacttgatcagaggcagagtgttaatgtatgtcgattccttaaagcaataaacgagaggcatgacataactgaagcactgaagaagctccggtgccggacgctgattttcgtgggagagaactcacagtttcatgccgacgctgtccacatgaccacgaaactagatcggagatactgcgccctagtcgaggttcaggcatgcgggtcgctggtcaccgaggagcagccacacgcaatgctgatcccgatggagtacttcttgatgggatacgggctctacagaccgtcccagctcgagagcagcccccgcagcaccctgaacccgttctgcatatcgccggagctgctgtcgcccgagagcatgggggtgaagctgaagcccatcaagactcggacctccctcaatgtttaaacaacatgtggtgggagatgttggatggcctgacgatgcagctcgcaaaggagcaaagattgctttggtcgagctgatcggagcacggtcaccatcgcgagacaagttttgataccttccggtaccttggcacgcacgcacgcatgcatagattgatacgttaatggcagcatttgctgtagattgctgtaagcctgtaatctacgtcgtctgggataggcaaggggaatagggttgaggttgtagtggaggaatacggctgtttgtttctttgttgatatgctttgtagtatcccacatcacatgtgtatatgtcatcaggtcatttcacacaggaaagcaatatataatatatatatggtaaagcagaatcctgtctgttgtc

SEQ ID NO: 3055 - DNA, 1374 bp, Cenchrus ciliaris
gttggtgggcagggcacacaacaagaacaggaggagggagggttaaggccttaagggaggcgtccgccgtccgccatgggggactccagcggctcggtgtcgatcgacgtcgagcggatcttcttcggcggccaggaacatcgcgtgagaacgagacatggccttctttcggtttctgtgtacggagacgaagacaagcccgcgctcgtgacttatccggatgtagctttaaatcacatgtcttgcttccaaggattgttcttctgtccagaggccgcgtcgctgttgcttcacaatttctgcgtctaccacatcacccctcaaggacacgagttaggagcggctccgatttcatctgatgtgcctgtgccatctgtcgatgaccttgcagatcaggttgccgacgtcctcgattttttcagtttaggtgctgtaatgtgcttgggtgtcactgctggtgcctatgttctcaccctctttgcgacaaagtatcgggagagggttcttggcctcatgttagtttcacctctatgcaaagcctcttcatggagcgaatggttgtacaataaggtattattaaacttgctttattattacgggacacgtgggttggtcaaggaaagcttgcttcagcgttatttcagcacggaagttcgcggcaacgggcaagatcctgagtcagagattgtccaagcctgcagaagtttacttgatgagaggcagggagctaatgtctggcggttccttcaagcaattaacaggcggcacgacttaacggaatcattgatgaagcttcagtgccggacgctaattttcgtgggagaaaactcccaattccatgctgaagcagtccacatgaccacaaaactagacaggagatactgcgctctggtggaggttcaggcttgtggttcactagtgaccgaagagcagcctcacgcgatgctcattccgatggaatacttcctgatgggatacggtctctacagacctccgcagcaggaaactagccccaggagtacactgaacccgttctgcatatcgcctgagctcctgtcgccagagagtatgggagtgaagctgaagcccatcaagacgcggatatccctcaacgtttagcacgggcagatctctgatggtggccattgcctggcacccgcaggccgcagctcatgaaagtgaagactgcttgggctgaattgcgcaaccgcaaagttttgtttgatgcctttctgcgcctggtgggcgaaggctgacggcagtttttgttgatggggcggggagatggctgtttgtccatatatttgtagtcagtacacatgtatatctccacacggcatccttttatacagaaaatgaaaatggttaaagctg

SEQ ID NO: 3056 - DNA, 1479 bp, Secale cereale
gtcgtcgctctcgctcgctcccttacgttcccccttcgtcgttcggccctttcggcctacgtcctcacgttcctaccctcctccaaacttcgcccaacaccttcggaaccccaatggcgagctttaacgccgccggcgccggcgccgccaaccccaaccctaacaaatccctcgaggtgaatccggcgcccggagactcggtttccagcctcagcttcagccccaaggcgaatcacctaattgccacctcctgggacaaccaggttcggtgctgggaggttcagcctggcggccaatgccaggccaaggcgtctatttcgcacgatcagccagtcttgtgctctgcctggaaggatgacgggactactgttttttcgggaggttgtgacaaagtggtcaagatgtggccgctgctgtctggcgggcaggccacggccttctcagggcatgaggcgcctgtcaaagaactcgcctggataccacagatgagccttctcgtcagtgggggttgggataagactctgaggtactgggacattcgacaacctaatccagcgcacgtgcagcaacttccggagcgctgttatgcactctcacttagttatcctctaatggcggtcggtactgctgatcgcaacgtagttatcttcaatctgcagaatccacaggctgaattcaagaggatcgtgtcacctttgaaatttcagacaaggtgtatcgccgccttccctgatcaacaaggattcttggttggatcaatagagggacgtgttggtgttcaccatgtggatgattctaatcaaagcaagaatttcacattcaaatgtcaccgcgagggcactgatatattctctgttaactcgctgaactttcatcctgtgcaccatacatttgctactgcaggctctgatggaggtttcaacttttgggacaaggacagtaaacaaagactgaaggcttttagtaagtgcccatcacccatcacatgcagcacattcaatcaggatggctcaatctttgcttatgcggtatgctatgattggagcaagggagccgagaagcataatccttctactgcaaagacaaatatctttctgcatagcgtgcaggaatctgatgtcaaaggaaagccccgtactggaaaaaagtagagacttggaaatgacaagctgcagatctgtgctctgaacctgatgagttcggcactgcctgatgctaattacctgcatgagtgttttagatcttgactctgtagggcatttcttcatctatgagactgcaagcatatcttctataaaaagcacttgcatttctccccatgtatatggcaggtcgtaatttgttgctgcagttcagctgtttttctgtaagttggacgtcgtagtattaggaacaaagagttgaagagctactgggctttaagtccgttttgcggacatgggagttaaggggcgaatgggaggacaggaatttttggaa

SEQ ID NO: 3057 - DNA, 1516 bp, Setaria italica
gaaatcccggcctctcccctcccctctccttccctgtctccgctcccgaattcggcgaacgcctccccaccgcaatggcgagcttcagccccgccggcgccaccgccgccaatcagaaccctaacaaatccgtcgaggtgactccggcgcccgaagactcggtctccagtctcagcttcagccccaaggcgaaccatctcgtagctacctcatgggataaacaggttcggtgctgggaggtcctgcctggtgggggatgccaagctaaggcctcgatttcgcacgatcagccggtgctgtgctcggcatggaaggatgatgggatgaccgttttctcgggaggatgtgataagcagattaaaatgtggccgctgctgtctggtgggcagcccacaaccttatcaggccatgaggcgcctgtcaaagagctcgcctgggtgccacagatgaatcttcttgtcagtggaagctgggacaagactttgaggtactgggacattaggcaacctcaaccagtgcatgttcagcaacttcctgagcgatgttatgctctatctctttgttatcctctcatggtggttggcactgctgatcgcaatgtaatagtcttcaatctgcagaatccacaggctgaattcaagagaattgtatcacctttgaagctccagacgaggtgtcttgccgcatttcctgatcaacaagggtttttggttggatctatagaaggaagagttggtgttcatcatgtggatgactctcagcaaagcaaaaactttacattcaaatgtcaccgtgatggcaatgatatatactctgttaactcactgaacttccatcctgtgcacggtacatttgctactacaggatctgatggaggtttcaatttttgggataaggacagtaagcaaaggctgaaggcatttagtaagtgtccagcgcccatcacatgcagtacattcaatcaggacggctctatatttgcttatgcggtatgttatgattggagcaagggcgctgagaagcataatccttctactgcaaagacaaatatctttatacatagcgtgcaggaatctgatgtcaaaggaaagccccgtactggaaagaagtagtcatgccaatggcaaattgaagattggtgctcgtagactgataaaaaaagatgagctcactgctgctggtcactcacatgagtggtccgctcctgattgttagggtatttcttcgtacatgagactgaaagcaaattcaatatcacaacaattgctgtatgtgcgacatgttagctggaagtagccttggatattgttctgacggtagcttatctctagaatggatcttactattagtaggtggcatgaaatgcactcctatatgcaacgtgagacgctggttaccatttttgtcagatccattctggtactgcatcaaaatttgttcccgtctggttcagaatttaggggcaggcgaaaacttgcctgccaaattctgtgctagtcatgccaaattttgcctg

SEQ ID NO: 3058 - DNA, 1433 bp, Oryza sativa
tcctcctccgcttccctctcctcccctcccctcgctccccaaaatttcccaaactccccgccgcccaacacaatggcgagctttaccgccggcggcggcggcgccaacaacaaccccaacaagtccctcgaggtgaatccggcgcccggggactcggtttccagcctcagcttcagtcccaaggcgaaccacctcgtcgccacatcatgggacaaccaggttcgttgctgggagatccagcctggaggccaatgccaagcgaaggcctcgatctcgcacgatcagccggtgctgtgctcggcatggaaggatgatgggactactgttttttcgggaggttgtgataaacagattaagatgtggccgctgctctccggtgggcagcccatggttttatcagggcatgaagcaccggtcaaagagcttgcctggataccacagatgaaccttcttgttagtgggagctgggacaagactctgaggtactgggatgttcgacaacctcagccagcacatgttcagcaactacctgagcgctgttatgctctctcacttagttatcctctcatggtggttggcactgctgatcgaaatgtaatagtcttcaatatgcagaatccacaggctgaattcaagaggattgtgtcacctttaaaactccagacaaggtgtcttgctgcatttcctgatcagcaagggtttctggttggatcgatagaaggacgagttggtgttcatcatgttgatgatggtcaacaagggaaaaactttacatttaaatgtcaccgtgatggcaatgacatatacgctgttaacgcattgaactttcaccctgtgcaccatacttttgccacttcgggctctgatggaggtttcaacttttgggacaaggacagtaagcaaaggcttaaggctttcaataagtgtccgtcacccatcacatgcagtacattcaatcaggatggctcaatatttgcttatgcggtatgctatgattggagcaagggtgccgagaagcacaatccttctactgcaaaaacaaatatctttctccatagtgtccaggaatctgaggtcaaaggaaagccccgtgttaataagaagtagacctgacaacaagaagttgaggattggttatcataatcataacatcatctcgctgatgctaatttcctgcatgagtatcctccttccgaactctttatgccatctcttcgtctatgagacggtaacttgtaaacacatacttttctggtcgtcattgttgtgaattgcaatagtggacaatggtagttatatgcaatctttacaccaaatgcgttcagatcaatcctggtattggatccaactttgttctcccaggtccagattttctggggcctgcgaagtacaaacctaatacagtcattcaacagcattaaacgtcatcacag

SEQ ID NO: 3059 - DNA, 1412 bp, Setaria italica
gaaatcccggcctctcccctcccctctccttccctgtctccgctcccgaattcggcgaacgcctccccaccgcaatggcgagcttcagccccgccgccgccaccgccgccaatcagaaccctaacaaatccgtcgaggtgactccggcgcccgaagactcggtctccagtctcagcttcagccccaaggcgaaccatctcgtagctacctcatgggataaacaggttcggtgctgggaggtcctgcctggtgggggatgccaagctaaggcctcgatttcgcacgatcagccggtgctgtgctcggcatggaaggatgatgggatgaccgttttctcgggaggatgtgataagcagattaaaatgtggccgctgctgtctggtgggcagcccacaaccttatcaggccatgaggcgcctgtcaaagagctcgcctgggtgccacagatgaatcttcttgtcagtggaagctgggacaagactttgaggtactgggacattaggcaacctcaaccagtgcatgttcagcaacttcctgagcgatgttatgctctatctctttgttatcctctcatggtggttggcactgctgatcgcaatgtaatagtcttcaatctgcagaatccacaggctgaattcaagagaattgtatcacctttgaagctccagacgaggtgtcttgccgcatttcctgatcaacaagggtttttggttggatctatagaaggaagagttggtgttcatcatgtggatgactctcagcaaagcaaaaactttacattcaaatgtcaccgtgatggcaatgatatatactctgttaactcactgaacttccatcctgtgcacggtacatttgctactacaggatctgatggaggtttcaatttttgggataaggacagtaagcaaaggctgaaggcatttagtaagtgtccagcgcccatcacatgcagtacattcaatcaggacggctctatatttgcttatgcggtatgttatgattggagcaagggcgctgagaagcataatccttctactgcaaagacaaatatctttatacatagcgtgcaggaatctgatgtcaaaggaaagccccgtactggaaagaagtagtcatgccaatggcaaattgaagattggtgctcgtagactgataaaaaaagatgagctcactgctgctggtcactcacatgagtggtccgctcctgattgttagggtatttcttcgtacatgagactgaaagcaaattcaatatcacaacaattgctgtatgtgcgacatgttagctggaagtagccttggatattgttctgacggtagcttatctctagaatggatcttactattagtaggtggcatgaaatgcactcctatatgcaacgtgagacgctggttaccatttttgtcagatc

SEQ ID NO: 3060 - DNA, 1909 bp, Sorghum bicolor
gcgactccgccccaaaaccctctcccaaaacctcccaaatccccgcctcccctctccactccctccctcgctccctcctcccgcctctccgctcccaaattcgtcgaacgccaccccaccctaccccaccccacctgccgaccgcaatggcgaccttcggtaccgccggcgccagcgccgccaaccagaaccccaacaaatccgtcgaggtgactccggcgcccggggactcggtgtccagcctcagcttcagccccaaggcgaaccacctcgtttcaacctcatgggacaaccaggttctgtgctgggaggtcatggctggtggggcatgccaagcgaaggcctccatttcgcacgatcaaccggtgctgtgctcggcttggaaggatgatgggatgactgttttctcaggaggctgtgataagcaggttaaaatgtggcctctgctctcaggtggccagcccacggttttctcagggcatgaggcacctattaaagagctcgcttgggtgccacagatgaatcttcttgtcagtgggagctgggacaagactttgaggtactgggacattaggcaaccccaaccagtgcatgttcagcaacttcctgaccgctgctatgctctatcgctttcttatcctctcatggtggttggcactgctgatcgcaacgtagtagtcttcaatctgcagaatccacaggctgaattcaagaggattacatcacctttgaagctccagacaaggtgtcttgctgcatttcctgatcaacaaggttttttgattgggtcgatagaaggacgagttggtgttcatcacgtggatgactctcagcaaggaaaaaacttcacattcaagtgtcaccgtgatggcaatgatatatactctgttaactcattgaacttccatcctgtgcatggtacattcgctactacaggctctgatggaggtttcaacttttgggacaaggacagtaagcaaaggctgaaggcttttaataagtgtccagcacccatcacatgcagtacattcaatcatgatggctctatatttgcttatgcggtatgctatgattggagcaagggtgctgagaagcataatccttctgctgcaaagacaaatatctttctacatagtgtacaggaatctgatgtgaaaggaaagcctcgtggaaagaagtagacatagcaatgataagttggtgactggtgatcgtagacagatagcaaatcagctcgctgctgctggttacttgcatgagtggttcttctgatagttagggtatttcttgatacactagatcaaaagcatgtcctttatcacaacaactacatttgcgtcgtttggctgtaagtaatttcggtggcagtgcactaacggcgggttatttctaaaatggttcttttagtaggtttgtgaaagttatacgtaacaatgttgttcctgtctggtccaaatctttttggtcctttggtaaaccacctgagctaaactgggcatcttctgcactaggacctgtttgcttctaagttctaaccctcgtgcctgggccaggcagctctcggctggatcaaccttcctgggtgagcgctaccacgccacgctgtgaaccataacctgggctgggggcattgctgctctttggagccgagtcgcctgattgttgatctacccgtcgcttttgaagctttggttagtcaatttctcgtcgtgctctcttgttgcttgactatccgtcgaaacctcctttgattgtggtgcaaggtcatgtccctccatgtataatgtattggtgatttggcgtctccttgcgcttcgaggccctcatcgaggttgcgtcgttgtactgttgctgcttgcaacaatcatttgtctttcctcttaataaaatataaaatatatgctcgggc

SEQ ID NO: 3061 - DNA, 1102 bp, Hordeum vulgare
cgcaagcccaaactcttctccccgaagcgtcaacctcacgcgaccacctgctggtttgggactttgggcgtccatccgacgcgattttgccctgccttaaaagcaaaaccctccccacaaaccgcaaaccccgccccttccctccctcccccaaattcgcccaacaccttcggaatcgcaatggcgagctttaacgccgccggcgccgccccagccaaccctaaccctaacaaatccctcgaggtgaatccggcgcccggggactcggtttccagcctcagcttcagccccaaggcgaaccacctgattgccacctcctgggacaaccaggttcggtgctgggaggttcagcctggcggccaatgccaggcgaaggcgtctatttcgcacgatcagccagtcttgtgctctgcgtggaaggatgatgggactactgttttttcgggaggttgtgacaaaatggtgaagatgtggccgctgctgtccggcgggcaggccacgaccttctcaggccatgaggcgtcggtcaaagaactcgcttggattccacagatgagtcttcttgtcagtgggagctgggataagactctgaggtactgggacattcgacaacctaatccagcccatgttcagcaacttccagagcgctgctatgctctctcacttagttatcctctaatggcggtcggtactgctgatcgcaacgttgttatcttcaatctgcagaatccacaggctgaattcaagaggatcgtgtcacctttgaaattccagacaaggtgtattgccgcgttccctgatcaacaaggattcttggttggatcaatagaaggacgcgttggtgttcatcatgtggatgactctaatcaaagcaagaatttcacattcaaatgtcaccgtgagggcactgatatatactctgttaactcgctgaactttcatcctgtgcaccatacatttgctactgcaggctctgatggaggtttcaacttttgggacaaggacagtaaacaaagactgaaggcttttagcaagtgcccatcacccgtcacgtgcagcacattcaatcaggatggctcaatctttgcttatgcggtaggcc

SEQ ID NO: 3062 - DNA, 1387 bp, Zea mays
cgaaatccccgcgacctcccctccccgtctcccctctccgctcccaaattcgtcgaacgccaccccacccgcccactgcaatggcgagcttcaatcccgccggcgccagcgccgccaaccataatcccaacaaatccttcgaggtgactccggcgcctggggactcggtgtccagcctcagcttcagccccaaggcgaaccacctcgttgccacctcatgggacaaccaggttcggtgctgggaggtcatggctggtggggcctgccaagcgaaggcctccatttcgcacgatcaaccggtgctgtgctcggcttggaaggatgatgggttgactgttttctcaggaggctgtgataagcaggttaaaatgtggcccctgctctcaggtgcccagcccacggttttctcaggccatgaggcacctattaaagaactcgcttgggtgccacagatgaatcttcttgtcagtgggagctgggacaagactttgaggtactgggacattaggcaaccccaaccagtgcatgttcagcaacttcctgagcgttgctatgctctatcgctttgttatcctctcatggtggttggcactgctgatcgcaacgtaatagtcttcaatctgcagaatccacaggctgaattcaagaggattacgtcacctttgaagctccagacaaggtgtcttgctgcatttcctgatcaacaaggttttttgattgggtctatagaaggacgagttggtgttcatcacgtggaagagtctcagcaaggaaaaaactttacattcaagtgtcaccgcgatggcaatgatatatacgctattagctcattgaactttcatcctgtgcatggtacattcgctactacaggctctgatggaagtttcaacttttgggataaggacagtaagcaaaggctgaaggcttataataggtgtccatcccccatcacatgcagcgcattcaatcatgatggctctatatttgcttacgcggtatgttatgattggagcaaaggtgctgagaagcataatccttctactgcaaagacaaatatatttctacatagtgcacaggattctgacgtgaaaggaaaaccccgcgctggaaagaagtaggcgtagcaatgataagtcagtgactggtgatcgtaggacagcaaatcagctctcttctcctgatagttagggtatttcttgacagtacactagactaaaagcatgtccttttatcacaaccattgcatttgcctcttttggctaagtaatttcggtggcagtgcactgacggcgggttatttctaaaatggaccatctgctgggcgggggcattgttgttctttggacgtctggttgttggtctactggtcgcttttgaagcttggtta

SEQ ID NO: 3063 - DNA, 1547 bp, Echinochloa colona
cggcggcgctgcgaccggcgaggtcaccaatcgaccggccgagaaagcccctcgacgacggagcctctctccactccggaccctccccgccgaagcacacacccacgcggcgccgcagctcctcctcgtcgactcggatcaaggcgtagagagagatggcgagtctaaccggcctcactgcgaacgctaacccaaacaagtcattcgagatcctgcccaacccgggtgactccgtctcgagcctcagcttcagccccaagagcaatctgctggtggcaacctcctgggataaccaggtgaggtgctgggagattgttggcgggaacagtcagccgaaggcgtccatatcgcatgatcagccagtcctctgctcggcttggaaggacgatggaactaccgtcttctctggaggctgtgacaagcaggtcaaaatgtggcctttgctgtcaggtgggcagcctcagacggttgcaatgcatgacgcgcctgtcaaggagatcgcatggattcctcagatgaatcttcttgtctctggaagctgggataagactctaaggtactgggacacaaggcaagcaaatcctgcacatatccagcaacttccagagcgttgctatgctcttacagtgaattaccctcttatgattgtgggaactgctgatcgtaatcttgttgtcttcaacttgcagaatcctcaggcggagttcaagcgaattcagtcaccactaaaataccagacacggtgccttgctgcatttccagatcaacaaggatttctggttggttcgatcgaaggaagagttggtgttcatcatatcgatgattcacaacaaagcaagaacttcactttcaaatgtcacagggaaggaaatgatatattctctgtcaattcactgaacttccatcctgtgcatcacacatttgcaactgctggatctgatggtgctttcaacttctgggataaggacagcaagcagaggctaaaggcttttagtagatgtcctcttcccattccttgcagcaccttcaacagtgatggttccatatttgcttatgcggtctgctatgattggagccgtggggccgaaaaccacaaccctgcagctgcaaagacatccatctacctccacagtccacaggaatctgaggtcaaaggaaagccgcggattgcgacaggcaggaagtgattacattccaacttgcgggatctgttcgtcttaaggccagtcaccagttttgttatgctccccatcctgtcttggaaatctggtagatgtaaatttaagcctgtaggcactgatgataggtgcaagtcttaacatgtagtaatacatggtgtttgcagtgtctagtcctcttaaggaattgtgtattgaggtggtttgaggtgctgtaaatttcgtgcatatgggattatgggtcgatggaattatcaccatcttttatgagatatcctatattagttgctaccatggttaaaaagaaacccatgtgcttactggcaggtcgcagtatttaatagcagatctccactctctttagaggcc

SEQ ID NO: 3064 - DNA, 1603 bp, Setaria italica
ctcacatctcacatctcacgcagaactttgtcccatccagtccaggaaacctcgagaacctccccattccccttcctcggcggcgcggcaaccggcgaggcgaccaatcgaccgagacgcccctccgcgttgccgacggatcctccctccactccgtacctccacgccgagcacgcggctctgccttgtcgactcggaacaaggcgtagagagagatggctagtctaaccggcctcgccgcgaaccctaatccgaacaagtcattcgagatcctgcccaacccgggtgactcagtctcgagcctcagcttcagccccaagagcaacctgctggtggcaacctcctgggataaccaggtgaggtgctgggagattgttggcgggaacagtcagccgaaggcgtccatatcgcatgatcagccggtcctctgctccgcttggaaggatgatggaactactgtcttctctggaggttgtgacaagcaggtcaaaatgtggcctctgctgtcaggtggtcagcctcagacagttgcgatgcatgatgcgcccgtcaaggagatcgcatggattcctcagatgaatcttcttgtctctggaagctgggataagactctaaggtactgggacacgagacaagcaaatcctgtgcatatccagcaacttccagagcgttgctatgctcttacagtgaattacccccttatgattgtgggaactgctgatcgtaaccttgtagtcttcaacttgcagaatcctcagacggagttcaagcgtattcagtcaccactaaaataccagacacggtgccttgctgcattccctgatcaacaaggatttctggttggttcgatagaaggaagagttggtgttcatcatatcgatgattcacaacaaagcaagaatttcactttcaaatgtcacagggaaggaaatgatatattctctgtcaattcactgaacttccatcctgtccatcacacatttgcaactgctggatctgatggtgctttcaacttctgggataaggacagcaagcagaggctgaaggcttttagtagatgcccacttcccattccttgcagcaccttcaacagcgatggttccatatttgcttatgcggtctgctatgattggagccgtggggccgaaaaccacaaccctgcagctgcaaagacatccatctacctccacagtccacaggaatctgaggtcaaaggaaagccgcggatcgcgacaggccggaagtgatttcgttccaacttgcgggatctgtgtctttaggccagtcaccagttttgttatgctgcctcctatagtcctggaagtctggttgatgtaaatttcatcgtacctgtaggcactgatgatagggtttctgttgcaagtctcgacatggtagtaatacctggtgtttgcagtgtctagccttcgaggaattgtgtatcgaggtggttttcagtgatgtaaattatcgtgcatatgtttctataatctatatcgatggaattgtcagtatcttttgcaaggtaaccctatcatggttaaaaagaaaccctatgcttactggcaggtttatgtgaaagattatgtataatgtgtgtgat

SEQ ID NO: 3065 - DNA, 1526 bp, Setaria italica
cacgcagaactttgtcccatccagtccaggaaacctcgagaacctccccattccccttcctcggcggcgcggcaaccggcgaggcgaccaatcgaccgagacgcccctccgcgttgccgacggatcctccctccactccgtacctccacgccgagcacgcggctctgccttgtcgactcggaacaaggcgtagagagagatggctagtctaaccggcctcgccgcgaaccctaatccgaacaagtcattcgagatcctgcccaacccgggtgactcagtctcgagcctcagcttcagccccaagagcaacctgctggtggcaacctcctgggataaccaggtgaggtgctgggagattgttggcgggaacagtcagccgaaggcgtccatatcgcatgatcagccggtcctctgctccgcttggaaggatgatggaactactgtcttctctggaggttgtgacaagcaggtcaaaatgtggcctctgctgtcaggtggtcagcctcagacagttgcgatgcatgatgcgcccgtcaaggagatcgcatggattcctcagatgaatcttcttgtctctggaagctgggataagactctaaggtactgggacacgagacaagcaaatcctgtgcatatccagcaacttccagagcgttgctatgctcttacagtgaattacccccttatgattgtgggaactgctgatcgtaaccttgtagtcttcaacttgcagaatcctcagacggagttcaagcgtattcagtcaccactaaaataccagacacggtgccttgctgcattccctgatcaacaaggatttctggttggttcgatagaaggaagagttggtgttcatcatatcgatgattcacaacaaagcaagaatttcactttcaaatgtcacagggaaggaaatgatatattctctgtcaattcactgaacttccatcctgtccatcacacatttgcaactgctggatctgatggtgctttcaacttctgggataaggacagcaagcagaggctgaaggcttttagtagatgcccacttcccattccttgcagcaccttcaacagcgatggttccatatttgcttatgcggtctgctatgattggagccgtggggccgaaaaccacaaccctgcagctgcaaagacatccatctacctccacagtccacaggaatctgaggtcaaaggaaagccgcggatcgcgacaggccggaagtgatttcgttccaacttgcgggatctgtgtctttaggccagtcaccagttttgttatgctgcctcctatagtcctggaagtctggttgatgtaaatttcatcgtacctgtaggcactgatgatagggtttctgttgcaagtctcgacatggtagtaatacctggtgtttgcagtgtctagccttcgaggaattgtgtatcgaggtggttttcagtgatgtaaattatcgtgcatatgtttctataatctatatcgatggaattgtcagtatcttttgcaaggtaaccctatcatggtt

SEQ ID NO: 3066 - DNA, 1708 bp, Panicum virgatum
atggcgagcttcagccccgccggcgccgccaaccataaccctaacaaatccgtcgaggtctccagtctcagcttcagccccaaggcgaaccaactcgtagccacctcatgggataagcaggttcggtgctgggaggtcctgcctggtggggtctgccaagcgaaggcctcgatttcgcatgatcagccggtgctgtgcacggcatggaaggatgatgggatgactgttttctcaggaggttgtgataagcatattaaaatgtggccgctgctgtctgatgggcagcccacaaccttatcagggcatgaggcgcctatcaaagaactcgcttgggtgccacagatgaaccttcttgtcagtggaagctgggacaagactttgaggtactgggacattaggcaacctcaaccggtgcatgttcagcaacttcctgagcgttgctatgctctgtcactttgttatcctctcatggtggttggcactgctgatcgcaacgtaatagtcttcaatctgcagaatcgacaagctgaattcaagagaactgtatctccattgaagctacagacaaggtgtcttgccgcatttcctgatcaacaagggtttttggttggatctatagaaggaagagttggtgttcatcatgtggatgactctcaacaaagcaaaaactttacattcaaatgtcaccacgatggcaatgatatattctctgttaactcactgaacttccatccggtgcacaacacatttgctactacaggctctgatggaggtttcaatttttgggataaggacagtaagcaaaggctgaaggcttttagtaagtgtccagcacccatcacatgcagtacattcaaccaggacggatctatatttgcttatgcggtatgttgcgattggagcaagggtgctgagaagcataatccttctactgcaaagacaaatatctttatacatagcgtacaagtttgtacttttcactagatgccttcttctgtattaacatttttgtgtggttcatttgattttgtaaatgatactacagacaaggtaagctcagattgtagctctgtgctcttttcttatcaaacattttgaactgttaatattgaccgactgcagttggttaatttaagcttttatatgttaattcaacatgaatgtgaatgatctcatccaaacgcctgttttccttggatgatggtagctatctttgtttatcctagtctgatagtttcttctttgatcattgttgtttttggttgtaggaatctgatgtgaaagaaaagccccgtgctgggaagaagtaggcatggcaataacaagttgaagattggtgcttgggactggtagaaagattagcttactgctgctagtcactcacatgacatgagtggaccactcctgattgtttgggtatttcttcatacatgagactctgatcacaagaattgctgcataggcgacatgttagcaggaagtaacgttggataatgtattgatggaagattagtaagtggcattaaaagtttatgcaatgtgagatgctggttacttttttttgtcagatccattctgatagtgcatcaaaattagttctcgtttggtcaagattttgggccaacagggtattgttcaaattttcatagcgcacagctgcacacgcagatttcatgtagattatcatgcttgctgagtcaggcggcac

SEQ ID NO: 3067 - DNA, 1748 bp, Oryza sativa
ggttgaagtgaaccaaaatccgtaggtcgtatcgtagggagggcctgcgccgatccccatccgtcccgcgactcgaactcgagcgagcagaggcggcgccggcgctcgtcctgccgccaccgccgcggccgcctgagccgatcccatccatcccgcgagcgagcgagcgcttccgccgcatcctggtcctggatcaggtagaaggagatggcgactcttggtcttgccccaaacatgaatccaaacaagtcatttgaggtactgcctaatccaggtgactccgtatcgagcctcagttttagcccaaagagcaaccttctggtggcaacttcctgggataaccaggtgcggtgctgggagattgttggtgggagtagtcaaccaaaggcatctatatcgcatgaccagccagtcctctgttcagcttggaaggatgatggaactactgtgttctctggaggctgtgataaacaagtaaaaatgtggcctctgttgtctggtgggcaggctcagactgttgcaatgcatgacgcacctgtcaaggagatcgcttggattcctcaaatgaatcttcttgtctctggaagctgggataagactctaaggtattgggacacaaggcaatcaaatcctgtccatgttcagcaacttcctgagcgctgttacgcacttacagtgaattatccccttatgattgtgggaactgctgatcgtaatctggtcgtcttcaacttgcagaatcctcagacggagttcaagcgcatccaatcgccactcaaataccagactaggtgtcttgctgcattcccggatcaacaaggatttttggtgggttccatagaaggaagagttggtgtgcatcatattgatgactcacagcaaagcaaaaatttcacgttcaaatgtcacagggaagggaatgatattttctctgtcaattcactcaattttcacccagttcatcacacgtttgcaactgctggatcagatggcgcatttaatttctgggataaggatagcaaacaaagactgaaggcttttagtcggtgccctcttcctattccttgcagtaccttcaacagtgatgggtcgatatttgcttatgcagtctgctatgactggagccgtggggctgaaaaccacaaccctgccactgcaaagacatccatctatcttcacagtccacaggaatctgaggttaaagggaagccgagaatcgcaacaagtagaaagtgattacatccagctacgcaaaaccaaagagtgcacaagaaatcatgtacattggaagacaaaaacgtttctccaggacctctgtccatcgtgtaggatgcttttctcttggttggtcatcaattttgttgtgtccagtctggtgttagcatctggtagatgtaaatgtcagtctactcgtagtcactgaagatagggggtttagtcgcaggttttagcatgcatcagtttgcagtgtctagttctatttaagttatgtttaccaagtttatgcgagtcttatgttgtcgatataatcagatcagcccgaaccgtttctaagggaggtgttgcaagtgatgtaaattattgcaaatgtagattcatatttcgttagaattatcgccacgttctgagatgtactaaatttacccgtgagaaaccagtggatgctgactttctggttttggcccgtgaatctgaatggcctacttgaatttgaaatggtagctgtctgaaaaatacgattaacatgt

SEQ ID NO: 3068 - DNA, 1530 bp, Pennisetum glaucum
gatctcacatctccacgcagcacttcttccttccaacaaacctcgagaacctccccgtccccccttcctcgtcggcgcggcaacagtcgaccgaccgagacgcccgcccatccgcgttgccgacggatcctccctccactccgcaccctccccgctgaagcttgcggctccgggggactcgtcgactcggcacaaggcgtagagagagagatggcgactctaactggcatcgcggcgaaccctaatccgaacaagtcattcgagatcctgcccaacccgggagactcagtctcgagcctcagcttcagccctaagagcaacttactggtggcgacctcctgggataaccaggtgaggtgctgggagattgttggcgggaacagtcagccgaaggcgtcgatttcgcatgatcagccggtcctctgctccacttggaaggatgatggaactactgtcttctctggaggttgtgacaagcaggtcaaaatgtggcctctgctgtcaggtggacaacctcagacggttgcgatgcatgatgcacctgtcaaggaggtcgcatggattcctcagatgaaccttcttgtctctggaagctgggataagactctaaggtactgggacacaagacaagcaaaccctgtgcatatccaacaacttccagagcgttgctatgctcttacagtgaattaccctcttatgattgtgggaactgctgatcgtaatcttgtagtcttcaacttgcagaatcctcagacggagttcaagcgtattcagtcaccacttaaataccaaacacggtgccttgctgcattccctgatcaacaaggatttctggttggttcgatagaaggaagagttggtgttcatcatatcgatgatgcacaacaaagcaagaatttcactttcaaatgtcacagggaaggaaatgatatattcgctgtcaattcattgaacttccatcctgtccatcacacatttgcaactgctggatctgatggtgctttcaacttctgggataaggacagcaaacagaggctgaaggcttttagtagatgccctctccccattacttgcagcaccttcaacagtgatggttccatatttgcttatgcggtctgctatgattggagccgtggggctgaaaaccacaaccctgcagctgcaaagacatccatctacctccacagtccacaggaatctgaggtcaaaggaaagccgcggatcgcaacaggccgcaagtgatttcgttccaatttgcaggatctgtttgtctttaggccagtcaccagttttgttatgctgccacctatagtccctgaagtctggtagatgtaaatttccgcgtacatgtaggcacagatgatagggtttctgttgcacgtccttgacatgtagtaagtgtttgcagtgtctagccttcgagttgtgtatcgaggtgcttttcaatgatgtaaattatggtgcatttctataatatacatcgatggaattgtcagcatcttctgcaaggtactccctttatggtatcat

SEQ ID NO: 3069 - DNA, 1856 bp, Sorghum bicolor
tgcatccactcgtggctgtctgcttgtcttgcccccctctcgctctccgacgactggtgcgccgcgccgccgccgccctaagccaggtgctgaggctttatttcgtctcttcgccggcgaacgagcacccacgaggcgtagagagagatggcgagtctaaccggcctcgccgcgaaccctaatccgaacaagtcattcgagatactgccgaacccgggtgactccgtctccagcctcagctttagtcccaagagtaatctgcttgtggcaacctcctgggataaccaggtgaggtgttgggagattgttggtggcaacagtcagccaaaggcatccatatcacatgaccagccggtcctctgctccgcttggaaagatgatggaactactgtcttctctggaggctgtgacaagcaggtcaaaatgtggcctctgctgtcaggtgggcagcctcagacagttgcgatgcatgacgcgcctgtcaaggaggtcgcctggattcctcagatgaatcttcttgtctctggaagctgggataagactttaaggtactgggatacaagacaagcaaatcctgtgcatatccagcaacttcctgagcgttgctatgctcttactgtgaattatccccttatgattgtgggaactgctgatcgtcatcttgttgtcttcaatttgcagaatcctcagacggagttcaagcgtatccaatcaccactaaaataccagacacggtgccttgctgcattccctgatcaacaggggtttctggtgggttcaatagaaggaagagttggtgttcatcatattgatgatgcacagcaaagcaagaacttcacattcaaatgtcacagggaaggaaatgatatattctctgtcaattcactcaacttccaccctgtccatcacacatttgcaactgctggatctgacggcgctttcaacttctgggataaggatagcaagcagaggctaaaggctttcagtagatgcccccttcccattccttgcagtaccttcaacagtgatggttccatatttgcttatgcggtttgctatgactggagccgtggggctgaaaatcacaaccctgcagctgcaaagacatctatctatctccacagtccacaggaaaccgaggtgaaaggaaagccacgcctcacgacaggcaggaagtgattacattgcagaagatgttactaaatggctgcacaagaaatcatgatgtcactcactagttatgttgtgcccccctcctatcttgggaagtctggtagattgtaaatttcagcttacttgtaggcgccaattatagggtttctgttggaagtcttaacatgctgtagtacgtggtgtttgtggtgtcttccaaatagattgtctgtggaggctccgtgatcatctccctactgcttattttggcagtaaaatcagtgtaccaaagaatgttctaatgtaaattttcgtgcatatggtcgtatggatagatactaatggagttgtagttcacagataaatccggttctggattatgatgggcatggagcaatctatggatacccaccgagccaatcggttcaatctaaggtagcctttcaggttgagtgatgaaaagtttgccagtttagggcatgtttgggactgtttacctccatgttttttttaagttccgccccatgttttccagcaaaaacatgtgtagctctatgaactcagttctggccaacctttgggctggctttactgacgcaatgagtttgattcccttgttccaatttggcatcatctttgatgcggagcttacggaggctacatgaggcagcagggtgacagattatggaggttgcataatgatg

SEQ ID NO: 3070 - DNA, 1826 bp, Saccharum officinarum
aaacgtgcattcattccccttccgtccgctgcatcccgtgcgttctgtctgcctctctcgccccctctcgctctccgacgactggtgcgccgcgccgccgccgccgccctaagccaggtgctgaggctttagttggtatcttcgccggcgaggagcacccaccaggcgtagagagagatggcgagtctaaccggcctcgccgcgaaccctaatccgaacaagtcattcgagatactgccgaacccgggtgactccgtctccagcctcagctttagtcccaagagtaatctgcttgtggcaacctcctgggataaccaggtgaggtgttgggagattgttggtggcaacagtcagccaaaggcatccatatcacatgatcagccggtcctctgctcggcttggaaggatgatggaactactgtcttctctggaggctgtgacaagcaggtcaaaatgtggcctctgctgtcaggtgggcagcctcagacggttgcaatgcatgatgcgcctgtcaaggaggtcgcctggattcctcagatgaatcttcttgtctctggaagctgggataagactttaaggtattgggatacaaggcaagcaaatcctgtgcatatccagcaacttcctgagcgttgctatgctcttactgtgaattatccccttatgattgtgggaactgctgatcgtcatcttgttgtcttcaatttgcagaatcctcagacggagttcaagcgaatccaatcaccactaaaataccagacacggtgccttgctgcattccctgatcagcaagggtttctggtgggttcaatagaaggaagagttggtgttcatcatatcgatgatgctcagcaaagcaaaaacttcacattcaaatgtcacagggaaggaaatgatatattctctgtcaattcactcaacttccaccctgtccatcacacatttgcaactgctggatctgacggtgctttcaacttctgggataaggatagcaagcagaggctaaaggcttttagtagatgcccccttcccattccttgcagtaccttcaacagtgatggttccatatttgcttatgcggtctgctatgactggagccgtggggctgaaaatcacaaccctgcagctgcaaagacatccatctatctccacagtccacaggaaaccgaggtcaaaggaaagccacgccttacgacaggcaggaagtgattacattgcagaagatgttactaaatggctgatgtcattcaccagttttgttatgcccccccccccccctctcttggaagtctggtagattgtaaatttcagcttacttgtaggcaccaattatagggtttctgttggaagtcttaacatgctgtagtacctggtgtttgtggtgtcttccaaatatattgtctgtggaggttctgtgctcatctccttactgcttattttggcggtaaaatcagtgtcccagagaatgttgtgatgtaaattttcgtgcatatggaccgatactaatggagttgtagttcacagcccgttctgggttaggatgggcatggagcaatccatggatacccaccgagccaatctagttcaatttaataataaggtagcgtttcagttagtgatgaaaaatttgctagttttagggcctgtttgagactgtttcgctccatgtttttactctgcttcatgtttttaagccaaagtagctctacaaactctgttccagggaactctagatacttcaaatttttgtgaagctgcgtcacggaaaccgccctttgctaggcggctaggtggacctttatttctgggctggcttcactgaggca

SEQ ID NO: 3071 - DNA, 1512 bp, Cenchrus ciliaris
cttccttccagcaaacctccagaacctcctcccccattcccttcctcggcggcgcggcagccggcgcgcgaccgatcgaccgagacgcccctccgcgttggcgacggatcctccatccactccgcaccctctccggtgaagcacgcggctccgcctcgtcgactcggaacaaggcttagagagagatggcgctatccagcctcgcggcgaattctaatccgaacaagtcattcgagatcctgcccaacccgggtgactcagtctcaagcctcagcttcagccccaagagcaacctgctggtggcgacctcctgggataatcaggtgagatgctgggagattgttggcgggaacagtcagccgaaggcatccatttcacatgatcagccggtcctctgctccgcttggaaggatgatggaactactgtcttctctggaggttgtgacaagcaggtcaaaatgtggcctctgctgtcaggtggccagcctcagacggttgcgatgcatgatgcgcctgtcaaggagattgcatggattcctcagatgaatcttcttgtctctggaagctgggataagactctaaggtactgggacacaagacaagcaaaccctgtgcatatccagcaacttccagagcgttgctacgctcttacagtgaattaccctcttatgattgtgggaactgctgatcgtaatcttgtagtcttcaacttgcagaaccctcagacggagttcaagcgtattcagtcaccacttaaataccaaacacggtgccttgctgcattccctgatcaacaaggatttctggttgggtcgatagaaggaagagttggtgttcatcatatcgatgatgcacaacaaagcaagaatttcacttttaaatgccacagggaaggaaatgatatattctctgtcaattcactgaacttccatcctgtccatcacacatttgcaactgctggatctgatggtgctttcaacttctgggataaggacagcaagcagaggctgaaggcttttagtagatgccctcttcccattacttgcagcaccttcaacagtgatggttccatatttgcttatgcggtctgctatgattggagccgtggggctgaaaaccacaaccctgcagctgcaaagacatccatctacctccacagtccacaggaatctgaggtcaaaggaaagccgcggatcgcgacgggcaggaagtgatttcgttccaactcacgggttctgtttgtctttaggccagtcaccagttttgttatgctgccacctatagtccctgaagtctggtagatgtaaatttccgcgtacatgtaggcacagatgatagggtttctgttgcacgtccttgacatgtagtaagtgtttgcagtgtctagccttcgagttgtgtatcgaggtgcttttcaatgatgtaaattatggtgcatttctataatatacatcgatggaattgtcagcatcttctgcaaggtactcccttttatggtatcatggttaaaaa

SEQ ID NO: 3072 - DNA, 1399 bp, Zea mays
tttacaccaagtgcccaagccgtcttcgactacaccaggtgccaagttttcttcgcgtccttcacccgcgacgagcacccaccaggcatagagagagatggcaagtctaaccggcctcaccgcgaaccctaatccgaacaagtcattcgagatactgccgaacccaggtgactctgtctccagcctcagctttagtcccaagagtaatctgcttgtggcaacctcctgggataaccaggtgaggtgctgggagattgttggtggtaacagtcagccaaaggcgtccatttctcatgatcagccggttctctgctcggcttggaaggatgatggaactactgtcttctctggaggctgtgacaagcaggtcaaaatgtggcctcttctgtcaggtgggcagcctcagacggttgctatgcatgatgcccctgtcaaggaggtcgcctggattcctcagatgaatcttcttgtatccggaagctgggataagactttaaggtactgggatacaaggcaatcaaatcctgtgcatattcagcaacttcctgaacgttgctatgctcttactgtgaattatccccttatgattgttggaactgctgaccgtcatcttgttgtcttcaatttgcagaatcctcagacggagttcaagcgaatccaatcaccactaaaataccagacacggtgccttgctgcattccctgatcaacaagggtttttggttggttcaatagaaggaagagttggcgttcatcatatcgatgacgcacagcaaagcaaaaacttcacattcaaatgccacagggaaggaaatgatatattctctgtcaattcactcaacttccaccctgtccatcacacatttgcaactgctggatctgacggtgctttcaacttctgggataaggatagcaagcagaggctaaaggcttttagtagatgcccccttcccattccttgcagtaccttcaacagtgatggttccatatttgcttatgcggtttgctatgactggagccgtggggccgaaaatcacaaccctgcagctgcaaagacatccatctatctccacagtccacaggaaaccgaggtcaaaggaaagccgcgcattgcaacaggcaggaagtgattgcattgaaggtgttgcaaggaaccatgatgtcatccagcagttttgtcatgcctccctcctgtcttggaagtctggtagagtgtaaatttcagctaacttatgcgccgattatagggtttctgtagtacctggtgtttgtggtgtcttcaaaatagattctgtcgacgttctgtgatgatctccttactgcttatttctggcagtaaaatcagtgtatcttaaaaaggttgtgatgtaaattttcgtgcatatggaccccgatactaa

SEQ ID NO: 3073 - DNA, 1594 bp, Secale cereale
gcgaccgtctccgcctccttccacacgactcgagaatcctcggcgccactccgcagtcagtccccagtcgccgccgcgccgccccccagcagccaccgcagatcgctctccgtccgtccgtccgtccggcagattttgaaggttcacagaaggagagatggcaactctaaccagccttgcctcaaacccgaatccgaacaagtcattcgaggtccttcctaatccgggtgactccctctcaagcctcagttttagcccgaaaagtaatcttctggtggcaacttcctgggataaccaggtgaggtgttgggagataggtaatggtaacagtcagccaaaggcatccatatcacatgatcagccggtgctctgctcagcctggaaagatgatgggactactgtcttctctggagggtgtgataaacaggtcaaaatgtggcctctgctgtctggtgggcaggctcagacggttgcaatgcatgatgcacctgtcaaggaggttgcatggatttcgcagatgaatcttcttgtctccggtagctgggacaagacactaaggtattgggacacaagacagccgaatcctgcccacgttcagcaacttcctgatcgttgctacgcacttgctgtgaattatccccttatgattgtgggaacagctgatcgcaatattgtgatcttcaacttgcagaatcctcagactgagtttaagcgtattcaatcacctctgaaataccagacacggtgcgttgctgcctttccagatcaacaaggattcctggtgggttccatagaaggaagagttggtgtgcatcatattgatgattcacagcaaagcaaaaacttcacattcaagtgtcacagggaaggaaatgatattttctctgtcaattcgctcaattttcaccctgttcatcacacgtttgccacagctggatctgatggtgctttcaacttttgggataaggatagcaagcagagacttaaggctttcagtcggtgtcctcaacccattccttgcagtagcttcaataacgatggctcaatatttgcttatggggtctgctatgactggagccgtggtgccgagaaccataatcctgcaaatgcaaagacatcaatctatctccacagtccccaggaagccgaggtgaaaggaaagccaagaatcgcaacggggcggaagtgatggcatcctgcctgccgaaaagtcgatagttgcgcaagagatgatgtatattcaagggccttgtttcgctcgggcctttgtccttgccgtgtcctctggatgttcttacttggttcggccacctggtagatgaaaaccctagtcccagcaaccagtggtaggttacttagccgtaggtcgtcgtagcacatagctgttcctgtaatccgtagttgttcgaaggaatgtttccccgtgttcttctgttgtgatatatagtcaggtcagtgcgtagtctttcgaaaggaagatgtcttaagtgtcttgtaagttgtgtagatctttggaaatatgggtatgatattcgagtggagttattctgataccttatatatatatatagcaactgctaagttatcagcagcc

SEQ ID NO: 3074 - DNA, 1629 bp, Secale cereale
tactacatctggtctcatcgcccctgagcttcagcagcagcgaccgactccgcctccttccccacgactcgagaatcctcggcgccactccgcagtcagtccccagtcgccgccgcgccgccccccagcagccaccgcagatcgctctccgtccgtccgtccgtccggcagattttggagcttcacagaaggagagatggcaactctaaccagccttgcctcaaacccgaatccgaacaagtcattcgaggtcctgcctaatccgggtgactccctctcaagcctcagttttagcccgaaaagtaatcttctggtggcaacttcctgggataaccaggtgaggtgttgggagataggtaatggtaacagtcagccaaaggcatccatatcacatgatcagccggtgctctgctcagcctggaaagatgatgggactactgtcttctctggagggtgtgataaacaggtcaaaatgtggcctctgctgtctggtgggcaggctcagacggttgcaatgcatgatgcacctgtcaaggaggttgcatggatttcgcagatgaatcttcttgtctccggtagctgggacaagacactaaggtattgggacacaagacagcccaatcctgcgcacgttcagcaacttcctgatcgttgctacgcacttgctgtgaattatccccttatgattgtgggaacagctgatcgcaatattgtgatcttcaacttgcagaatcctcagactgagtttaagcgtattcaatcacctctgaaataccagacacggtgcgttgctgcctttccagatcaacaaggattcctggtgggttccatagaaggaagagttggtgtgcatcatattgatgattcacagcaaagcaaaaacttcacattcaagtgtcacagggaaggaaatgatattttctctgtcaattcgctcaactttcaccctgttcatcacacgtttgccacagctggatctgatggtgctttcaacttttgggataaggatagcaagcagagacttaaggctttcagtcggtgtcctcaacccattccttgcagcagcttcaataatgatggctcaatatttgcttatggggtgtgctatgactggagccgtggtgccgagaaccataatcctgcaaatgcaaagacatcaatctatctccacagtccacaggaagccgaggtgaaaggaaagccaagaatcgcaacggggcgcaagtgatgggatcctgcctgccgaaaagtcgatagttgcgcaagagatgatgtatattcaagggccttgtttcgctcgggcctttgtccttgccgtgtcctctggatgttcttacttggttgggccacctggtagatgaaaaccctactcccagcaaccagtggtaggttacttagccgtaggtcgtcgtagcacatagctgttcctgtaatccgtagtcgtccgaaggaatgtttccccgtgttcttctgttgtgatatatagtcaggtcggtgcgtagtctttcgaaaggaagatgtcttaagtgtcttgtaagtggtgtagatctttggaaatatgggtatgatattcgagtggagttattctgataccatatatatatatagcaactgctaagttatcagcag

SEQ ID NO: 3075 - DNA, 1466 bp, Triticum aestivum
gagatggcaactctaaccagccttgcctcaaacccgaatccaaacaagtcattcgaggtcctgcctaatccgggtgactccctctcaagcctcagttttagcccgaaaagtaatcttctggtggcaacttcctgggataaccaggtgaggtgttgggagataggtaatggtaacagtcagccaaaagcatccatatcacatgatcagccagtgctctgctcagcctggaaagatgatgggactactgtcttctctggagggtgtgataaacaggtcaaaatgtggcctctgctgtctggtgggcaggctcagacggttgcaatgcatgatgcacctgtcaaggaggtcgcatggatttctcagatgaatcttcttgtctcaggaagctgggacaagacactgaggtattgggacacaagacaaccaaatcctgcccatgttcagcaacttcctgatcgttgctacgcacttgctgtgaattatccccttatgattgtgggaacagctgatcgcaatattgtgatcttcaacttgcagaatcctcagactgagtttaagcgtattcaatcacctctgaaataccagacacggtgcgttgctgcctttccagatcaacaaggattcctggtgggttccatagaaggaagagttggtgttcatcatattgatgattcacagcaaagcaaaaacttcacattcaaatgtcacagggaaggaaatgatattttctctgtcaattcgctcaactttcaccctgttcatcacacgtttgccacagctggatctgatggtgctttcaacttttgggataaggatagcaagcagagacttaaggctttcagtcggtgtcctcaacccattccttgcagtagcttcaataatgatggctcaatatttgcttatggggtctgctatgactggagccgtggcgctgagaaccataatcctgcaaatgcaaagacatccatctatctccacagtccccaggaagccgaggtgaaaggaaagccaagaatcgcaacagggcggaagtgatggtggcatcctgcctgccgaaaagtcgatagttgtgcaagagatgatgtatattcaagggccttgtttcgctcgggccttgccttgacgtgtcctctggatgttcttggttcggccacctgttagatgaaaagtctactcccagcaaccagtgatagcttacttagccgtaggtcgtagcacatagctgttcctgtaatgcatagttgtccgaaggaatgttttccggtgttcttctgttgtgatatagtcaggtcagtgcgtagtcttttgaaaaggagaaagtcttcagtgccttgtatgtggtgtagatctttggaaatatgggcatgatatttggtggagttattctgagaccatatatataatatataccccctccgttctaaattacttgtcttgaatttgtctagactcattttagtgctaga

SEQ ID NO: 3076 - DNA, 1601 bp, Triticum aestivum
gctccccgtccggcagattttgaaggttcacagaaggagagatggcaactctaaccagccttgcctcaaacccgaatccaaacaagtcattcgaggtccttcctaatccgggtgactccctctcaagcctcagttttagcccgaaaagtaatcttcttgtggcaacttcctgggataaccaggtgaggtgttgggagataggtaatggtaacagtcagccaaaggcatccatatcacatgatcagccagtgctctgctcagcctggaaagatgatgggactactgtcttctctggagggtgtgataaacaggtcaaaatgtggcctctgctgtctggtgggcaggctcagacggttgcaatgcatgatgcacctgtcaaggaggtcgcatggatttctcagatgaatcttcttgtatccggaagctgggacaagacactaaggtattgggacacaagacagccgaatcctgcccatgttcagcaacttcctgatcgttgctacgcacttgctgtgaattatccccttatgattgtgggaacagctgatcgcaatattgtgatcttcaacttgcagaatcctcagactgagtttaagcgtattcaatcacctctgaaataccagacacggtgcgttgctgcctttccagatcaacaaggattcctggtgggttccatagaaggaagagttggtgtgcatcatattgatgattcacagcaaagcaaaaacttcacattcaagtgtcacagggaaggaaatgatattttctctgtcaattcgctcaactttcaccctgttcatcacacgtttgccacagctggatctgatggtgctttcaacttttgggataaagatagcaagcagagacttaaggctttcagtcggtgtcctcaacccattccttgcagtagcttcaataatgatggttcaatatttgcttatggggtgtgctatgactggagccgtggcgctgagaaccataatcctgcaaatgcaaagacatccatctatctccacagtccccaggaagccgaggtgaaagggaagccaagaatcgcaacggggcggaagtgatggtggcatcctgcctgccgaaaagtcgatagttgtgcaagagatgatgtatattcaagggccttgtttcgctcgggccttgccttgacgtgtcctctggatgttcttacttggttcggccgcctggtagatgaaacgcctactcccagcaaccagtgataggttacttagccgtaggtcgtagcacatagccgtttatgtaatgcatagttgtccgaaggaatgtttccccgtgttcttgtgttgtgatatagtcaggtcagcgcgtagtcttttgaaaaggagaaagccttcggtgtcttgtaagtggtgtagatctttggaaatatgggcatgatatttggttctagttagcaccatgctgcaaatgcatgcggcattcggaggatttacggtttgaatcttatttacaatgtataaacatcacacttagctacatatcttatggtctcttagaaatgaaccacagttctgtagcatttctgcacgttcgagaacccaatgactcttatccaagtctaggattcc

SEQ ID NO: 3077 - DNA, 1688 bp, Triticum aestivum
tctcgtctcatcgcccagcgaccgtctccgcctcctcccagacgactcgagaatcctcggcgccactccgcacctactcgcaagtcgcacccgcacccgcagccgccgccgaccgctccccgtccgccggcagattttgaaggttcacagaaggagagatggcaactctaaccagccttgcctcaaacccgaatccaaacaagtcattcgaggtcctgcctaatccgggcgactccctctcaagcctcagttttagcccgaaaagtaatcttctggtggcaacttcctgggataaccaggtgaggtgttgggagataggtaatggtaacagtcagccaaaggcatccatatcacatgatcagccagtgctctgctcagcctggaaagatgatgggactactgtcttctctggagggtgtgataaacaggtcaaaatgtggcctctgctgtctggtgggcaggctcagacggttgcaatgcatgatgcacctgtcaaggaggtcgcatggatttctcagatgaatcttcttgtctcaggaagctgggacaagacactgaggtattgggacacaagacaaccaaatcctgcccatgttcagcaacttcctgatcgttgctacgcacttgctgtgaattatccccttatgattgtgggaacagctgatcgcaatattgtgatcttcaacttgcagaatcctcagactgagtttaagcgtattcaatcacctctgaaataccagacacggtgcgttgctgcctttccagatcaacaaggattcctggtgggttccatagaaggaagagttggtgttcatcatattgatgattcacagcaaagcaaaaacttcacattcaaatgtcacagggaaggaaatgatattttctctgtcaattcgctcaactttcaccctgttcatcacacgtttgccacagctggatctgatggtgctttcaacttttgggataaggatagcaagcagagacttaaggctttcagtcggtgtcctcaacccattccttgcagtagcttcaataatgatggctcaatatttgcttatggggtctgctatgactggagccgtggtgctgagaaccataatcctgcaaatgcaaagacatccatctatctccacagtccccaggaagctgaggtgaaaggaaagccaagaatcgcaacagggcggaagtgatggtggcatcctgcctgccgtaaagtcgatagttgtgcaagagatgatgtatattcaagggccttgtttcactcgggcctttccttgacgtgtcctctggatgttcttggttcggccacctgttagatgaaaagcctactcccagcaaccagtgataggttacttagccgtaggtcgtagcacatagctgttcctgtaatgcatagttgcccgaaggaatggttttcccgtgttcttctgttgtgatatagtcaggtcagtgcgtagtctttcaaaaggaaggagtcatcagcgtctttgtaagtggtatagatcttcggacatatgggcatggcatttggtggagttattccgacaccatatatatatatatacatatagcaactggtaagttatcagcagcctgcgccaattgaaaaagatgtctggtttcggtttcagcgaatgcacaaccagatttattgggaggatttagggtttgaatcttatttacaatgt

SEQ ID NO: 3078 - DNA, 1796 bp, Triticum aestivum
acgcgctacaccgaagcctatactactacatctcgtctcatcgccctcctcccacacgacgactcgagaatcctcggctgaggctccactccgcactcgcaagtcgcacccgcagccgccgccgaccgctccccgtccggcagattttgaaggttcacagaaggagagatggcagctctaaccagccttgcctcaaacccgaatccaaacaagtcattcgaggtccttcctaatccgggtgactccctctcaagcctcagttttagcccgaaaagtaatcttcttgtggcaacttcctgggataaccaggtgaggtgttgggagataggtaatggtaacagtcagccaaaggcatccatatcacatgatcagccagtgctctgctcagcctggaaagatgatgggactactgtcttctctggagggtgtgataaacaggtcaaaatgtggcctctgctgtctggtgggcaggctcagacggttgcaatgcatgatgcacctgtcaaggaggtcgcatggatttctcagatgaatcttcttgtatccggaagctgggacaagacactaaggtattgggacacaagacagccgaatcctgcccatgttcagcaacttcctgatcgttgctacgcacttgctgtgaattatccccttatgattgtgggaacagctgatcgcaatattgtgatattcaacttgcagaatcctcagaccgagtttaagcgtattcaatcacctctgaaataccagacacggtgcgttgctgcctttccagatcaacaaggattcctggtgggttccatagaaggaagagttggtgtgcatcatattgatgattcacagcaaagcaaaaacttcacattcaagtgtcacagggaaggaaatgatattttctctgtcaattcgctcaactttcaccctgttcatcacacgtttgccacagctggatctgatggtgcattcaacttttgggataaggatagcaagcagagacttaaggcttttagtcggtgtcctcaacccattccttgcagtagcttcaataatgatggctcaatatttgcttatggggtctgctatgactggagccgtggcgctgagaaccataatcctgcaaatgcaaagacatccatctatctccacagtccgcaggaagccgaggtgaaaggaaagccaagaatcgcaacagggcggaagtgatggtggcatcctgtctgccgaaaagtcgatagttgtgcaagagatgatgtatattcaagggccttgtttcgctcgggccttgccttgccgtgtcctctggatgttcttacttggttcggccacctggtacatgaaaagtctactcccagcaaccagtgataggtacttagccgtaggtcgtagcacatagctgttcctgtaatgcatagttgtccgaaggaatgttttcccgtgttcttgtgttgtgatatagtcaggtcagcgcgtagtcgtctttcaaaaggagaaagtcttcagtgtcttgtaagtggtgtagatctttggaaatatgggcatgacttttggtagagttattctgataccatatatatatagcaactggtaagttatcagcagcctgcgccaattgaaaaaagatgtctggtttcggtttcagcgaacatatgtacggtatggtctcttagaaatgaaccaaagttctgcagcatttctgcatgttcgaggacccactgactcttcctgtttatcccagtataggattcccatcttccctagtatcattgagttattttttatggtttcaaaagttccaattc

SEQ ID NO: 3079 - DNA, 1474 bp, Brachypodium distachyon
actgaaacgtaatcctctctcccccagtgcccctccgcgctcgcgctcgctctcgcagtcgagaaatcgcagcattcccggcggcgatcgctcccggatcagggggaaggagagatggcgaatctaaccagccttacctcaaacccgaacccgaacaagtcttttgaggtcctgcctaatccaggcgactccctctcaagcctcagttttagcccaaagagtaatctgctagtagcaacgtcctgggataaccaggtgaggtgttgggagatagttggtagtaacagtcagccaaaggcatccatatcacatgatcagccggtgctctgctcggcttggaaggatgacgggactactgtcttctctggaggctgcgataagcaggttaaaatgtggcctttgttgtctggtgggcaagctcagactgttgcaatgcatgatggacccgtcaaggagatagcatggattcctcaaatgagtcttcttgtctctggaagctgggataagacattaaggtattgggacacaagacaacaaaatcctgcccatgttcagcaacttccagagcgttgctatgctctttcagtgaattatccccttatgattgtgggaactgctgatcgtcatatcgtgatattcgacttacggaatcctcaggcggaatttaagcgtattcaatcaccactgaaataccagacacggtgcgtggctgcattccctgatcaacagggatttctggtgggttcaatagaaggaagagttggtgtgcatcatattgatgacgcacagcaaagcaaaaacttcacttttaaatgtcacagggagggaaatgatatattctctgtcaattcactcaactttcaccctgttcatcacacatttgccactgctggatccgatggtgctttcaatttctgggataaggatagcaaacagagattgaaggcttttagtcggtgccctcttccgattccttgcagtaccttcaatatggatggctcaatatttgcttatggggtctgttatgactggagccgtggtgcagaaaaccataatcctacaaatgcaaagacatccatatatctccacagtccgcaggaagctgaggtgaaaggaaagccgcggatcgcaacaggacggaagtgattgcttcctccctaccaacagttgtcaatagatgtacaagagagaaatgtatattcatgggcgttgtttttcgctcgggccttgccgtgtccatctgattctgaaggatgctttctttggttggtcatctggagtctagccgctgatgatagtaacttagtcgctggtagcacatacgtatctgcaaatctggtatctgttctgttatggcatagttgtctcaaggagtgttttcccatgttttatagtactgccagatgagcgtgtagtcttgatattgctgtagacttgtgcaaatatatgtcctgatatctgctcttatggtaaa

SEQ ID NO: 3080 - DNA, 1498 bp, Brachypodium distachyon
acagacagactgaaacgtaatcctctctcccccagtgcccctccgcgctcgcgctcgctctcgcagtcgagaaatcgcagcattcccggcggcgatcgctcccggatcagggggaaggagagatggcgaatctaaccagccttacctcaaacccgaacccgaacaagtcttttgaggtcctgcctaatccaggcgactccctctcaagcctcagttttagcccaaagagtaatctgctagtagcaacgtcctgggataaccaggtgaggtgttgggagatagttggtagtaacagtcagccaaaggcatccatatcacatgatcagccggtgctctgctcggcttggaaggatgacgggactactgtcttctctggaggctgcgataagcaggttaaaatgtggcctttgttgtctggtgggcaagctcagactgttgcaatgcatgatggacccgtcaaggagatagcatggattcctcaaatgagtcttcttgtctctggaagctgggataagacattaaggtattgggacacaagacaacaaaatcctgcccatgttcagcaacttccagagcgttgctatgctctttcagtgaattatccccttatgattgtgggaactgctgatcgtcatatcgtgatattcgacttacggaatcctcaggcggaatttaagcgtattcaatcaccactgaaataccagacacggtgcgtggctgcattccctgatcaacagggatttctggtgggttcaatagaaggaagagttggtgtgcatcatattgatgacgcacagcaaagcaaaaacttcacttttaaatgtcacagggagggaaatgatatattctctgtcaattcactcaactttcaccctgttcatcacacatttgccactgctggatccgatggtgctttcaatttctgggataaggatagcaaacagagattgaaggcttttagtcggtgccctcttccgattccttgcagtaccttcaatatggatggctcaatatttgcttatggggtctgttatgactggagccgtggtgcagaaaaccataatcctacaaatgcaaagacatccatatatctccacagtccgcaggaagctgaggtgaaaggaaagccgcggatcgcaacaggacggaagtgattgcttcctccctaccaacagttgtcaatagatgtacaagagagaaatgtatattcatgggcgttgtttttcgctcgggccttgccgtgtccatctgattctgaaggatgctttctttggttggtcatctggagtctagccgctgatgatagtaacttagtcgctggtagcacatacgtatctgcaaatctggtatctgttctgttatggcatagttgtctcaaggagtgttttcccatgttttatagtactgccagatgagcgtgtagtcttgatattgctgtagacttgtgcaaatatatgtcctgatatctgctcttatggtaaactgggtgccaagtaaa

SEQ ID NO: 3081 - DNA, 1579 bp, Triticum aestivum
cgagcaatcctcctccccacacctccctcggcgccacttcgcagcccccagccgcaaccgcgccgtcaccgaccgctccccgtccggccgtcagattttgaaggttcacagcaggagagatggcaactctaaccagccttgcctcaaacccgaatccaaacaagtcattcgaggtcctgcctaatccgggtgactccctctcaagcctcagttttagcccgaaaagcaatcttctggtggcaacttcctgggataaccaggtgaggtgttgggagataggtaatggtaacagtcagccaaaggcatccatatcacatgatcagccagtgctctgctcagcctggaaagatgatgggactactgtcttctctggagggtgtgataaacaggtcaaaatgtggcctctgctgtctggtgggcaggctcagacggttgcaatgcatgatgcacctgtcaaggaggtctcttggatttctcagatgaatcttcttgtctcgggaagctgggacaagacgctaaggtattgggacacaagacaaccaaatcctgcccatgttcagcaacttcctgatcgttgctacgcacttgctgtgaattatccccttatgattgtgggaacagctgatcgcaatattgtgatcttcaacttgcagaatcctcagactgagtttaagcgtattcaatcacctctgaaataccagacacggtgcgttgctgcctttccagatcaacaaggattcctggtgggttccatagaaggaagagttggtgtgcatcatattgatgattcacagcaaagcaaaaacttcacattcaaatgtcacagggaaggaaatgatatcttctctgtcaattcactcaactttcaccctgttcatcacacgtttgccacagctggatctgatggtgctttcaacttttgggataaggatagcaagcagagacttaaggctttcagtcggtgtcctcaacccattccttgcagtagcttcaataatgatggctcaatatttgcttacggggtctgctatgactggagccgtggtgctgagaaccataatcctgcaaatgcaaagacatccatctatctccacagtccccaggaagctgaggtgaaaggaaagccaagaatcgcaacaggacggaagtgatggcatcctgcctgctgaaaagtcgatagttgtgcaagagatgatgtatattcaagggccttgccttgacgtgtcctctggttgttcttggttcggccacctgttagatgaaaagtctactcccagcaaccagtgataggttacttagccgtaggtcgtagcacatagctgttcctgtaatgcatagttgtccgaaggaatgttttccggtgttcttctgttgtgatatagtcaggtcagtgcgtagtcttttgaaaaggagaaagtcttcagtgccttgtatgtggtgtagatctttggaaatatgggcatgatatttggtggagttattctgagaccatatatataatatataccccctccgttctaaattatttgtcttggatttgtctagactcattttagtgctagatacatccgtatctaga

SEQ ID NO: 3082 - DNA, 1677 bp, Triticum aestivum
cagattttgaaggttcacagcaggagagatggcaactctaaccagccttgcctcaaacccgaatccaaacaagtcattcgaggtcctgcctaatccgggtgactccctctcaagcctcagttttagcccgaaaagcaatcttctggtggcaacttcctgggataaccaggtgaggtgttgggagataggtaatggtaacagtcagccaaaggcatccatatcacatgatcagccagtgctctgctcagcctggaaagatgatgggactactgtcttctctggagggtgtgataaacaggtcaaaatgtggcctctgctgtctggtgggcaggctcagacggttgcaatgcatgatgcacctgtcaaggaggtctcttggatttctcagatgaatcttcttgtctcgggaagctgggacaagacgctaaggtattgggacacaagacagccaaatcctgcccatgttcagcaacttcctgatcgttgctacgcacttgctgtgaattatccccttatgattgtgggaacagctgatcgcaatattgtgatcttcaacttgcagaatcctcagactgagtttaagcgtattcaatcacctctgaaataccagacacggtgcgttgctgcctttccagatcaacaaggattcctggtgggttccatagaaggaagagttggtgtgcatcatattgatgattcacagcaaagcaaaaacttcacattcaaatgtcacagggaaggaaatgatatcttctctgtcaattcactcaactttcaccctgttcatcacacgtttgccacagctggatctgatggtgctttcaacttttgggataaggatagcaagcagagacttaaggctttcagtcggtgtcctcaacccattccttgcagtagcttcaataatgatggctcaatatttgcttatggggtctgctatgactggagccgtggtgctgagaaccataatcctgcaaatgcaaagacatccatctatctccacagtccccaggaagccgaggtgaaaggaaagccaagaatcgcaacagggcggaagtgatggtggcatcgcctgccgtaaagtcgatagttgtgcaagagatgatgtatattcaagggccttgtttcactcgggcctttccttgacgtgtcctctggatgttcttggttcggccacctgttagatgaaaagcctactcccagcaaccagtgataggttacttagccgtaggtcgtagcacatagctgttcctgtaatgcatagttgcccgaaggaatggttttcccgtgttcttctgttgtgatatagtcaggtcagtgcgtagtctttcaaaaggaaggagtcatgagcgtctttgtaagtggtatagatctttggacatatgggcatggcatttggtggagttattccgataccatatatatatatatacacatacatatagcaactggtaagttatcagcagcctgcgccaattgaaaaagatgtctggtttcggtttcagcgaatgcacaaccagatttattgggaggatttagggtttgaatcttatttacaatgtataaacatcacactgagctacatatgtatggcatggtctttagaaatgaaccatagttctgtagcatttctgcatgttggagaacccaatgactcttcctgtttgtccaagtcta

SEQ ID NO: 3083 - DNA, 1357 bp, Avena sativa
cgcagtcgcaccgcccccattctcagaggcgatcgcatccgacagaaggggagatggcaaatctaaccagccttacctcaaacccaaatccgaacaagtcattcgaggtcctgcctaatccaggcgactccctttcaagccttagttttagccccaagagtaacttgctggtggcaacttcctgggataaccaggtgaggtgttgggagatagtcaacggtaacagtcagccaaaggcatccatatcacatgatcagccagttctgtgctcggcttggaaggatgatgggacgaccgtgttctctggaggctgtgataaacaagtcaaaatgtggcctctgctgtctggggggcaggctcagacggttgcaatgcatgatgcacctgtcaaggaggtcgcatggatacctcaaatgaatcttcttgtctctggaagctgggataagacactaaggtattgggacacgaggcaaccaaatccagcccatgtccagcaacttccagatcgctgctactcccttgcagtgaattatccccttatgattgtgggaacagctgatcgtcatatcgtcatcttcaacttgcagaatcctcagacggagttcaagcgtattcaatcacctctaaaataccagacacggtgtgttgctgcattccctgatcaacaaggattcctggtgggttccatagaaggaagagttggagttcatcatattgatgatgcccagtcaagcaaaaacttcacattcaaatgtcacagggaaggaaatgacattttctctgtcaattcactcaactttcaccctgttcatcacacatttgccactgctggatctgatggtgctttcaatttttgggataaggatagcaagcagagactgaaggcttttagtcggtgccctcaaccaatttcttgcagtaccttcaataacgatggctcaatatttgcttatggggtttgctatgactggagccgtggtgctgaaaaccataaccctgcaaatgcaaagacatccatttatctccacagtccgcaggaagccgaggtgaaaggaaaaccacgaatagccacaggacgaaagtgatgtcatcctggctacaataggtgtacaagaaatcatgtatattcaaggcccttgtttctctcggggctctccttgccgtgtcctcttaatttcttcctttggttcggccgtatgatagatgtaaaatctacttctagccaccaatgatagggacttagctgtgagtcgtagcacatagctgtttatgtaatccatagatctcccaagacactgttttcctgtgttctttgatataatcagatcagtgtggagtcttgattttactgtcaaaa

SEQ ID NO: 3084 - DNA, 1676 bp, Hordeum vulgare
cgtgcatcccccgcgacgcgacgaaagcctatacacatctcgtctcatcgccccttcgtatcatacttcatctcgtctcctcccacgcgactcgagaaccttcctcccctccgccactccccactcgcagccgccgccggcagccctccgtccgtccgtccggcagtcagattttggaggatcgcagaaggagagatggcaactctaaccagccttacctcaaacgcgaatccaaacaagtcatttgaggtcctgcctaatccaggtgactccctctcaagcctcagttttagccccaagagtaatcttctggtggcaacttcctgggataaccaggtgaggtgttgggagataggtaacggtaacagtcagccaaaggcatccatatcacatgatcagccagtgctctgctcagcctggaaagatgatggtaccactgtcttctctggaggctgtgataaacaggtcaaaatgtggcctctgctgtctggtgggcaggctcagacggttgcaatgcatgatgcacctgtcaaggaggtcgcttggatttctcagatgaatcttcttgtctctggaagctgggataagacactaaggtattgggacacaagacaagcaaatccagctcatgttcagcaacttccagatcgttgctacgctcttgctgtgaattatccccttatgattgttggaaccgctgatcgcaatatcgtgatcttcaacttgcagaatcctcagactgagtttaagcgtattcaatcgcctctgaaataccagacacggtgtgttgctgcatttccagatcaacaaggattcctggtgggttccatagaaggaagagttggtgtgcatcatattgatgattcacagcaaagcaaaaacttcacattcaaatgtcacagggaaggaaatgacattttctctgtcaattcgctcaactttcaccctgttcatcacacgtttgccacagctggatctgatggtgctttcaacttctgggataaggatagcaagcagagacttaaggcttttagtcgttgtcctcaacccattccttgcagtagcttcaataatgatggctcaatatttgcttatggggtgtgctatgactggagccgtggtgccgagaaccataatcctgcaaacgcaaagacgtccatctacctccacagtccccaggaagccgaggtgaaaggaaagccaagaatcgcaacaggacggaagtgatggcatcctgcctgccaagaaagtggatagttgcgcaagagatcatgtatattcaagggccttgtttcgctcgggccatgccttgcgtgtcctctggatgttgttacacctggtagatgataagcctagtcccagcagccagcgataggttacttagccgtaggtcgtagcgcatagccgtttctgtattgcatagttgtccgaaggaatggtttccccgtgttattgtgttgtgatatatagtcaggtcagtgcgtagcctttcgtcaaaacgtgaaagtcttcagtgtcttgtaagtggtgtaggtccttggaaatatgggcatgacatttggagttattctgattccatatatgtatacttatatagcaactgctaagttatcatcgtaagtcgcttttggagcacggccacattgagcacgttatttttcaagtttgaaactgtt

SEQ ID NO: 3085 - DNA, 1290 bp, Avena sativa
gacagaaggggagatggcaaatctaaccagccttacctcaaacccaaatccgaacaagtcattcgaggtcctgcctaatccaggcgactccctttcaagccttagttttagccccaagagtaacttgctggtggcaacttcctgggataaccaggtgaggtgttgggagatagtcaacggtaacagtcagccaaaggcatccatatcacatgatcagccagttctgtgctcggcttggaaggatgatgggacgactgtgttctctggaggctgtgataaacaagtcaaaatgtggcctctgctgtctggggggcaggctcagacggttgcaatgcatgatgcacctgtcaaggaggtcgcatggatacctcaaatgaatcttcttgtctctggaagctgggataagacactaaggtattgggacacgaggcaaccaaatccagcccatgtccagcaacttccagatcgctgctactcccttgcagtgaattatccccttatgattgtgggaacagctgatcgtcatatcgtcatcttcaacttgcagaatcctcagacggagttcaagcgtattcagtcacctctaaaataccagacacggtgtgttgctgcattccctgatcaacaaggattcctggtgggttccatagaaggaagagttggagttcatcatattgatgatgcccagtcaagcaaaaacttcacattcaaatgtcacagggaagggaatgacattttctctgtcaattcactcaactttcaccctgttcatcacacatttgccactgctggatctgatggtgctttcaatttttgggataaggatagcaagcagagactgaaggcttttagtcggtgccctcaaccaatttcttgcagtaccttcaataacgatggctcaatatttgcttatggggtttgctatgactggagccgtggtgctgaaaaccataaccctgcaaatgcaaagacatccatttatctccacagtccgcaggaagccgaggtgaaaggaaaaccacgaatagccacaggacgaaagtgatgtcatcctggctacaataggtgtacaagaaatcatgtatattcaaggcccttgtttctctcggggctctccttgccgtgtcctaatttcttcctttggttcggccgtatgatagatgtaaaatctacttctagccaccaatgatagggacttagctgtgagtcgtagcacatagctgtttatgtaatccatagatctcccaagacactgttttcctgtgttctgtgatataatcagatcagtgt

SEQ ID NO: 3086 - DNA, 1095 bp, Cenchrus ciliaris
cccatccgcgctcgacctcctcccaccgaccgttccgccccgccgccgccgccgccgccgccccgccggcccagaggcagggagggagggcccaggcatccggtacggacgcagcgcttgcctccagtgaccagttcaggcggcgatggcgtaccgggcggacgacgactacgactacctcttcaaggtggtgctcatcggggactccggcgtcggcaagtcgaacctgctctcgcgattcacgcgcaacgagttcagcctcgagtccaagtccaccatcggcgtcgagttcgccacccgcagcatccacgtcgacgacaaggtcgtcaaggcccagatctgggacaccgccggccaggaaagataccgtgccatcacaagtgcatactaccgcggagcagtaggagcactagttgtctatgatgtcacacgacatgtcaccttcgagaacgtggagaggtggatgagggagctgaaggaccacaccgacgccaacattgtgatcatgctcgttggaaacaaggcggatctgcgccacctcagggccgtcccgaccgaggatgcaaaggccttcgctgagaaagaaaatgccttcttcatggagacgtcggccctggaggcaatgaatgtggaggatgccttcaccgaggtgctcacacagatctaccgagtggtaagcaagaaggcacttgacatcggtgatgaccctgcggcaccccccaagggccagaccatcaatgttggcggcaaggacgacgtgtccgcggtgaagaagtctgcttgttgttcgtcttagctttggaaggatagaacatgtacttgggttggttgatacttttgcagtagagggctcaggatgttattgcagtcatggtcctcaatctgtattcatgtgttacaggtgtctcatgttaattttgccattttgatacattaattcattcaggacttcagcttgctggtatagtttagggatgtgaaaatgtgaaagtgtgcggctatcagattctttcatataggcctttcaccttgtttctttcatttcttgtgtctgtatactctcatttttccccgaccaacttggctatttgctgg

SEQ ID NO: 3087 - DNA, 1270 bp, Setaria italica
gaacccaagggaaacccaacaaaaaagtggtggaaaactgagaaaaacctgcacccgcgtccgcgtgctccgctccgcccttcccatccgctccccctcctccacctccaccgcccgttccccgccgccgccgccgccgccggcccagagtcagggagggagggccgaggcaccccgtcccgcgccgccgcagcgcagttccagcggccctcacttccagcgcccagttcaggcggcgatggcgtaccgggcggacgacgactacgactacctcttcaaggtggtgctcatcggggactccggcgtcggcaagtcgaacctgctctcgcgcttcacgcgcaacgagttcagcctcgagtccaagtccaccatcggcgtcgagttcgccacccgcagcatccacgtcgacgacaaggtcgtcaaggcccagatctgggacaccgccggccaggaaagataccgtgctatcacaagtgcatactaccgtggagcagtaggggcactagttgtctatgatgtcacacggcatgtcacctttgagaacgtggagaggtggatgagggagctcaaggaccacacggacgccaacatcgtgatcatgctcgtcggaaacaaggcagacctgcggcaccttagggccgtcccgactgaggatgcaaaggccttcgctgagaaagaaaatgccttcttcatggagacgtcagccctggaggcaatgaatgtggaggatgccttcaccgaggtgctcacgcagatctaccgtgtggtaagcaagaaggcccttgacatcggtgatgaccccgcggcgcctcccaagggccagaccatcaatgtcggcggcaaggacgacgtgtccgcagtgaagaagtctgcttgctgttcgtcttagcttggaaggatagaacatgtacttgggttggttgatacttttgtagtagagggtgcaggatgttattgcagtcatggtcctcaatctgtattcatgtgttacaggtgtctcgtgttcattttgccatttgatacattaattcattcaggacttaagcttgctggtatagctagggatgtgaaagtgtgcggctttcagattctttcatataggcctttctaccttgttgctttcatttcttgtgtctgtgtactgtctcctttctgaccaacttgtctatttgctggtatagttgcatccttcagcaggctatttgctttgctagactgctgaaaattgctaaactgttaaccatactgccatagtggaaattggctaggc

SEQ ID NO: 3088 - DNA, 1230 bp, Setaria italica
gaacccaagggaaacccaacaaaaaagtggtggaaaactgagaaaaacctgcacccgcgtccgcgtgctccgctccgcccttcccatccgctccccctcctccacctccaccgcccgttccccgccgccgccgccgccgccggcccagagtcagggagggagggccgaggcaccccgtcccgcgccgccgcagcgcagttccagcggccctcacttccagcgcccagttcaggcggcgatggcgtaccgggcggacgacgactacgactacctcttcaaggtggtgctcatcggggactccggcgtcggcaagtcgaacctgctctcgcgcttcacgcgcaacgagttcagcctcgagtccaagtccaccatcggcgtcgagttcgccacccgcagcatccacgtcgacgacaaggtcgtcaaggcccagatctgggacaccgccggccaggaaagataccgtgctatcacaagtgcatactaccgtggagcagtaggggcactagttgtctatgatgtcacacggcatgtcacctttgagaacgtggagaggtggatgagggagctcaaggaccacacggacgccaacatcgtgatcatgctcgtcggaaacaaggcagacctgcggcaccttagggccgtcccgactgaggatgcaaaggccttcgctgagaaagaaaatgccttcttcatggagacgtcagccctggaggcaatgaatgtggaggatgccttcaccgaggtgctcacgcagatctaccgtgtggtaagcaagaaggcccttgacatcggtgatgaccccgcggcgcctcccaagggccagaccatcaatgtcggcggcaaggacgacgtgtccgcagtgaagaagtctgcttgctgttcgtcttagcttggaaggatagaacatgtacttgggttggttgatacttttgtagtagagggtgcaggatgttattgcagtcatggtcctcaatctgtattcatgtgttacaggtgtctcgtgttcattttgccatttgatacattaattcattcaggacttaagcttgctggtatagctagggatgtgaaagtgtgcggctttcagattctttcatataggcctttctaccttgttgctttcatttcttgtgtctgtgtactgtctcctttctgaccaacttgtctatttgctggtatagttgcatccttcagcaggctatttgctttgctagactgctgaaaattgct

SEQ ID NO: 3089 - DNA, 987 bp, Pennisetum glaucum
cgcccccgcccccgccgcgccggcccggaggcagggagggagggcccaggcaccgcgtcccgcgccgcacggagcagcgcgtgcctccagcgcccagtccaggcggcgatggcgtaccgggcggacgacgactacgactacctcttcaaggtggtgctcatcggggactccggcgtcggcaagtcgaacctgctctcgcgattcacgcgcaacgagttcagcctcgagtccaagtccaccatcggcgtcgagttcgccacccgcagcatccacgtcgacgacaaggtcgtcaaggcccagatctgggacaccgccggccaggaaagatatcgtgctatcacaagtgcatactaccgcggagcagtaggggcactagttgtctatgatgtcacacggcatgtcaccttcgagaacgtggagaggtggatgagggagctgaaggatcacacagatgccaacatcgtgatcatgcttgttggaaacaaggcggatctgcgccacctcagggctgtcccgaccgaggatgcaaaggccttcgccgagaaagaaaatgccttcttcatggagacgtcggccctggaggcaatgaatgtggaggatgccttcaccgaggtgctcacacagatctaccgcgtggtgagcaagaaggcacttgacatcggtgatgacccagcggcacctcccaagggccagaccatcaatgttggcggcaaggacgatgtgtccgcggtgaagaagtctgcttgctgttcgtcttagctttggaaggatagaacgtgtacttgggttggttgatactttgcagtagagggctcaagatgttattgctgtctgtattcatgtgttacatccttacaggtggcccgtgttcattttgccatttgatacattaattcattcaggacttttgcttgctggtatagtttagggatgtgaaagtgtgtggctatcagattttttcatataggttttctaccttgttgcttt

SEQ ID NO: 3090 - DNA, 1269 bp, Sorghum bicolor
acctccccggcaccgcccgctgggggctcggcgtgcgcccgactaacccaaccgaccacgacgcgcgcacgcgtccgcacggcaccgaccccgcaccgcacgaatccggcaaaccgagcaaaaaaacgaggtgagattaggaactgagaaaaaacccgcacccgcgtccgggtgctctctctctctctctctcgccgccccctcccatccgcgctcccctcctcatccaccgcccgtcccgccgccgccggcccaaggcccgctagccagccggccagcctttgtgtgcgtgtgtgcccgtggtggtggcgatggcgtaccgggcggacgacgactacgactacctcttcaaggtggtgctcatcggggactccggcgtcggcaagtcgaacctgctctcgcgcttcacgcgcaacgagttcagcctcgagtccaagtccaccatcggcgtcgagttcgccacccgcagcatccacgtcgacgacaaggtcgtcaaggcccagatctgggacaccgccggccaggaaaggtaccgtgctatcacaagtgcctattaccgtggagcagtaggagcactcgtcgtctatgacgttacacggcatgtcaccttcgagaacgtggagaggtggatgagggagctcaaagaccacacggacgccaacatcgtgatcatgcttgtcggcaacaaggcggatctgcgccacctcagggccgtcccgaccgaggacgccaaggccttcgccgagagagagaatgctttcttcatggagacatcggccctggaggcaatgaacgtggaggacgccttcaccgaggtgctcacccagatctaccgtgtcgtgagcaagaaggccctcgacattggcgacgaccccgcagcgcctcccaagggccagaccatcaatgttggcggcaaggatgatgtgtctgcggtgaagaagtctgcctgctgttcgtcttagcttggaaggatagaacatgtacttgggttggttgatacttttgcagtagagggcgcaggacgttattgcagtcatggtcctcgacctgtattcatgtgttaccaggtgtcgttgattttgccatttgatacattaattcattcaggacttaagctgccggtatagtttagggatggaagtgtgcggctatcatatttattttttcatataggccttatctattttgttgctttcatttcttgtatctgtatactgtcgcttctcttatatcaacctaggtgcattgcttcaacaaactatttgcttt

SEQ ID NO: 3091 - DNA, 1117 bp, Saccharum officinarum
tgggaactgagaaaaaacccgcacccgcgtccgcgtgccctctccgccccatcccatccgccgcgctcccctcctcgtccaccgcccgtcccgccgccgccggcccaaggcccgccagccagccggccagcctttcggcgtgcgtgcgtgcccgtctggtggcgatggcgtaccgggcggacgacgactacgactacctcttcaaggtggtgctcatcggggactccggcgtcggcaagtcgaacctgctgtcgcgcttcacgcgcaacgagttcagcctcgagtccaagtccaccatcggcgtcgagttcgccacccgcagcatccacgtcgacgacaaggtcgtcaaggcccagatctgggacaccgccggccaggaaaggtaccgtgctatcacaagtgcatactaccgcggagctgtaggggcgctcgttgtctacgacgtcacacggcatgtcaccttcgagaacgtggagaggtggatgagggagctcaaggaccacacggacgccaacatcgtgatcatgcttgtcggcaacaaggcggatctgcgccacctcagggccgtcccgaccgaggacgccaaggcctttgccgagagagagaacgctttcttcatggagacgtcggccctggaggcgatgaacgtggaggatgccttcaccgaggtgctcacccagatctaccgtgtcgtgagcaagaaggccctcgacatcggtgacgaccctgcagcacctcccaagggccataccatcaatgtaggcggcaaggacgatgtgtccgcggtgaagaagtctgcctgctgttcgtcttagcttggaaggatagaacatgtacttgggttggttgatacttccgcagtagagggcgcaggacgttattgcagtcatggtcctcgacctgtattcatgtgttaccaggtgtctcgttgatttttgccatttgatacattaattcattcaggacttcagcctgctggtatagtttaggcatatggaagtgtgcggttatcatttttttttttcatataggccttctctaccttgttgcattcatttcttgtatctgtactgtcgcttcccttgcattgcttcaacaggctatatgctttgctact

SEQ ID NO: 3092 - DNA, 1197 bp, Panicum virgatum
gaaaacaggaaaaaaaaaaccaaactcgcatccgcacccgcgtccgcgtgctcagctccgcccttcccatccggcacccgctccctctcctctcctgcaccacccgttcccgccgccgccgccggcccaagtgagggaccaggcaggcagcccgcccccgtgccgccgaagccgcggagcagcgcgcgattccgggggccgaccgtccgtcccaggcggcgatggcgtaccgggcggaggacgactacgactacctcttcaaggtggtgctcatcggggactccggcgtcggcaagtccaacctgctctcccgcttcacgcgcaacgagttcagcctcgagtccaagtccaccatcggggtcgagttcgccacccgcagcatccacgtcgaggacaaggtcgtcaaggcccagatctgggacaccgccggccaggaaaggtaccgagctatcacaagtgcatactaccgtggagcagtaggggcactagttgtctatgacgtgacacgccatgtcacctttgagaacgtggagaggtggatgagggagctcaaggaccacacggacgccaacatcgtgatcatgctcgtcgggaacaaggcggacctgcgccaccttagggctgtctcgacggaggatgcaaaggccttcgccgagagagagaatgccttcttcatggagacgtcagccctggaggcgatgaatgtggaggatgccttcaccgaggtgctcacacagatctaccgcgtggtaagcaagaaggctcttgacatcggcgatgaccctgcagcgcctcccaagggccagaccatcaatgttggcggcaaggatgatgtgtcggcggtgaagaagtctgcttgttgttcgtcttagcttggaaggatagaacatgtacttgggttggtcaatacattttgcagtagcgggcacaggaagttatggcagtgatggtcctcaatctgtattcttgtgttaacaggtgcctcgtgttcatttgccatttgatacattaattcattcaggactttcagattgctggtatagtttagggatatgaaggtgtgcggctatcagattttttcatataggccttctgtataccatcctttttcgcttcagcatgctatttactttgctagactattaccatcgtgaaaattgacaccctactccgtagcagctagcagttccaagggta

SEQ ID NO: 3093 - DNA, 1124 bp, Zea mays
atacaggtcagttggaaacatggtattaaaatgaactcgtctctagcattgatccaagaaaaaaaaaacacgcacccgcgtccgcgtgctctctgccccctgcccccctcccatctgcgccgccctcctcatccaccgcccgtcccgccgccgccagcccaaggccaggcatccgccagcctctcgcaccacgcgtatcgcgtgcccgcccgaccggctcgtggcgatggcgtaccgggcggacgacgactacgactacctattcaaggtggtgctcatcggggactccggcgtcggcaagtccaacctgctctcgcgcttcacgcgcaacgagttcagcctcgagtccaagtccaccatcggcgtcgagttcgccacccgcagcatccacgtcgacgacaaggtcgtcaaggcccagatctgggacaccgccggtcaggaaaggtaccgtgctatcacgagcgcgtactaccgcggagcagtaggggcgctcgtcgtctacgacgtcacgcggcacgtcaccttcgagaacgtggagaggtggatgagggagctcagggaccacacggacgccaacatcgtgatcatgctggttgggaacaaggcggacctgcgccacctcagggctgtcccgaccgaggacgccaaggcctttgccgagagggagaacgccttcttcatggagacgtcggccctggaggcgatgaacgtggagggcgccttcaccgaggtgctcacccagatctaccacgtcgtgagcaagaaggccctcgacatcggcgatgaccccgcagcgcctcccaggggccagaccatcagtgtcggcggcaaggacgatgtgtccgcagtgaagaagtctgcctgctgttcgtcttagcttggaagggggtaggacatgtacttgggttggttggttacttgtgcagtagagagcgcaggacgttatttgcagtcatggtccttgagctgtattcatgtgttaccagctgtctcgttgatttttgccatttgatacatttaattcattcaggaattcagcctgcgggtatagcttagggacatggaagtgtgcggctatcgtatttttttcatataacagagccttctctgcattgttgctttca

SEQ ID NO: 3094 - DNA, 1206 bp, Panicum virgatum
aaagggagacccaacaagaaagcggtgggagcggagaaaaatccgcacccgcgcccgcgtgctcagctccgcccttcccatccggcatccgctccctcctctcctctcgtctcctgcaccgcccgttccagccgccgccgccgccgccgccggcccaagtgagggagcagggcaggcagcccgtccccgcgccgccgcagccgcggagcagcgcgcgattccggggaccgaccgaccgaccgtcccaggcggcgatggcgtaccgggcggaggacgactacgactacctcttcaaggtggtgctcatcggggactccggcgtcggcaagtcgaacctgctctcccgcttcacgcgcaacgagttcagcctcgagtccaagtccaccatcggggtcgagttcgccacccgcagcattcacgtcgaggacaaggtcgtcaaggcccagatctgggacaccgccggccaggaaaggtaccgtgctatcacaagtgcatactaccgtggagcagtaggggcactagttgtctatgacgtgacacggcatgtcacctttgagaacgtggagaggtggatgagggagctcaaggaccacaccgacgccaacatcgtgatcatgctcgtcgggaacaaggcggaccttcgccacctcagggccgtcacgacagaggacgcaaaggccttcgccgagagagagaacgccttcttcatggagacgtcagccctggaggcgatgaatgtggaggatgccttcaccgaggttctcacacagatctaccgcgtggtgagcaagaaggcccttgacattggtgatgaccccgctgcgcctcccaagggccagaccatcaatgttggcggcaaggacgacgtgtcggcggtgaagaagtctgcttgttgttcgtcttagcttggaaggatagaacatgtacttgggttggctgatacattttgcagtagagagggcacaggatgttatggcagtgatggtcctcaatctgtattcttgtgttaacaggtgcctcgtgttcattttgccatttgatacattaattcattcaggacttcagattgctggtatagtttagggatatgaaggtgtgcggctatcagatttttttcatataggccttctgtaccgtattgcttttatttgtcgtgtctgtataccgccccttttccgcttcagcatgctatttactttgctagac

SEQ ID NO: 3095 - DNA, 1563 bp, Hordeum vulgare
tcggctggctagcaaaacaaacgcccgtcggccagcgaggcagagcgagccaaacgacaacaacccgagcgagcgagagagagagagagacgacagcccggcgcgcacgcacgtctctcgtttctattttgcgtgcgtcgcctctcctcaacgttctccccacctctcttcctctcatagtcatatacggcaccgctcgcgtcccccaccgctcctcctctcccggcccttcccctgacgaccgccctcccggaagcgctgccgcggcctccctccccacccacccgcctccgccagcaaggaagggggctgtcgtcgggtcgggtcggccatggcctacagggcggaggacgactacgactacctcttcaaggtcgtgctcatcggcgactccggggtcggcaagtccaacctcctctcccgcttcacccgcaacgagttcagcctcgagtccaagtccaccatcggcgtcgagttcgccaccaggagcatcagggtcgacgacaaggtcgtcaaggcccagatctgggacacggcaggacaggagaggtatcgggcaattacaagtgcatactatcgaggggccgttggtgcacttgtcgtgtacgatgtgacacgccatgtgacctttgagaatgtggagaggtggttgaaggagctccgggatcacacagatgcaaacattgtcatcatgcttgtcggcaacaaagctgatctacgccaccttagggctgtatcagtggaggatgccaaggcctttgctgagagggaaagcaccttctttatggaaacatctgcgttggaggccatgaacgttgaaaacgccttcactgaggttctgactcagatctatcgcgtggtcagcaagaaggccctcgacataggcgatgaccctgctgctccaccgagaggacaaaccatcaacgttggtggcaaggatgatgtctctgctgtgaaaaaggcaggctgctgttcatcctaaattcgttttgcttgtgaagagggatcatatgctcacctgattatatgggtaactgcaaatatgacatcctttttccctcctaacctggttgtttgcgagaatatactggtgcaccaagaatttcgtttagatatcaagatttaaccccaggttgataatgggggacatgctaacctttggaatgtcagtgattttgtggttaccttttatggtttcttagctgctgtattgtcccacctcaattgacacaagaatcttctcaacatttcactgtgcagcctaacctgataaaggttgtaatgggagctatggttcattacttctcttggctttcctgctgaatggatgtgtactatgtagccctcagagattatactgtatcttctgtatcacaataggttatgtctacttggtaaatgtcatctgtaactggtagccagtatgagttttacactgttatattgggtatcttccctcccagatgtacagaatttgcattgaagatccatgtttcttatcagcctatgttttcatatgctgccattttatgcctatagtgttcactatgctgctgtttgagg

SEQ ID NO: 3096 - DNA, 1126 bp, Brachypodium distachyon
aatcgcggcgcggcgcgtgaaaacccaaacccagcagcaacgcacgcgccgagcacaagaagaaggaagcggggagaagaagaagccgagggaggggaaggagaaggaaaagcgcaccacaaggcacaatccctctcgccgccgccggggaagacggaaggggaaggcatcggggcagagagagagagagggatggcgtacagggcggaggacgactacgactacctgttcaaggtggtgctgatcggggactccggggtggggaagtcgaacctgctcacgcgcttcacccgcaacgagttcagcctcgagtccaagtccaccatcggggtcgagttcgccacccgcagcatccacgtcgacgacaaggtcgtcaaggcccagatctgggacaccgccggccaagagagataccgggctatcaccagcgcgtactaccgtggagcagtgggcgctctcgttgtctacgatgtcacgcggcacgtcaccttcgagaacgtggagaggtggctgagggagctcaaggaccacacggacgccaacattgtcatcatgcttgtgggaaacaaggccgatctgcgccaccttagggctgtccagtctgaggatgcaaaggcgtttgccgagagagagaacacattcttcatggagacatcagccctggaggcgatgaatgtggaggatgccttcaccgaggtgctctcccagatctaccgtgtagtgagcaagaaagctctcgacatcggtgatgaccctgctgctcctcccaaggggaagaccatcagtgtcggctcaaaggatgatgtgtccgccgtgaagaaatccgcctgttgttcgtcttagctcgggaagatagaatatacatcagtaggaggatactatgttattgcaatcgtagtcctcttttgtattcattcatgtgctgtggagtctgccttattcacttttgccattttgatacattaattcgttcaagactaaaggtttgctggtacagtttagggatatggaagtgtgaggttatcatgattttcatataggcctttgctcgaatgtttttacctcttgatatgcttattgctgaagctgtcttcacttgttaaaattgccctgcatgtatgtggtg

SEQ ID NO: 3097 - DNA, 1133 bp, Brachypodium distachyon
agatcccaatcgcggcgcggcgcgtgaaaacccaaacccagcagcaacgcacgcgccgagcacaagaagaaggaagcggggagaagaagaagccgagggaggggaaggagaaggaaaagcgcaccacaaggcacaatccctctcgccgccgccggggaagacggaaggggaaggcatcggggcagagagagagagagggatggcgtacagggcggaggacgactacgactacctgttcaaggtggtgctgatcggggactccggggtggggaagtcgaacctgctcacgcgcttcacccgcaacgagttcagcctcgagtccaagtccaccatcggggtcgagttcgccacccgcagcatccacgtcgacgacaaggtcgtcaaggcccagatctgggacaccgccggccaagagagataccgggctatcaccagcgcgtactaccgtggagcagtgggcgctctcgttgtctacgatgtcacgcggcacgtcaccttcgagaacgtggagaggtggctgagggagctcaaggaccacacggacgccaacattgtcatcatgcttgtgggaaacaaggccgatctgcgccaccttagggctgtccagtctgaggatgcaaaggcgtttgccgagagagagaacacattcttcatggagacatcagccctggaggcgatgaatgtggaggatgccttcaccgaggtgctctcccagatctaccgtgtagtgagcaagaaagctctcgacatcggtgatgaccctgctgctcctcccaaggggaagaccatcagtgtcggctcaaaggatgatgtgtccgccgtgaagaaatccgcctgttgttcgtcttagctcgggaagatagaatatacatcagtaggaggatactatgttattgcaatcgtagtcctcttttgtattcattcatgtgctgtggagtctgccttattcacttttgccattttgatacattaattcgttcaagactaaaggtttgctggtacagtttagggatatggaagtgtgaggttatcatgattttcatataggcctttgctcgaatgtttttacctcttgatatgcttattgctgaagctgtcttcacttgttaaaattgccctgcatgtatgtggtg

SEQ ID NO: 3098 - DNA, 1549 bp, Setaria italica
gttcgttccttgcaggagcaaaacgcccagcagagacaccgaggcgggacgggaacctgccacaggcggccagcgaggcgcttgctattttccgccgccccctcctcctcaacgttctccccacctcccgcctccgccccctcctcttatacgcgccacccacgcctcgcctccgcctcccctcctcctccacctcgcctccgcctcccctcccgcggcagccccgagaagcactgcgggcctcacctgcccgtcctcctgcccccaagaaccgccggttcaggaaggaaggaagggaaggaagggaagcgcctgcctgccggggctgagcgaccgaccatggcgtacagggcggaggacgactacgactacctcttcaaggtcgtgctcatcggcgactccggggtcggcaaatccaacctgctctcgcggttcacgcgcaacgagttcagcctcgagtccaagtccaccatcggggtcgagttcgccaccaggagcatcagggtcgacgacaaggtcgtcaaggcccagatctgggacaccgccgggcaggagaggtatcgggcaattacaagtgcatactatagaggggctgttggcgcactggtcgtgtacgatgtgacacgccatgtgacctttgagaatgtggagaggtggttgaaggagctccgggatcacacagatgcaaacattgtcatcatgcttgtcggcaacaaggctgatctgcgacaccttagggctgtatctgtggaggatgccaagggctttgctgagagggaaagtaccttcttcatggaaacttccgcactggagtccatgaacgtcgagagcgccttcaccgaggtcctaactcagatctatcgtgtggtcagcaagaaggccctcgacattggcgatgaccctgcagctccaccaagaggacaaaccatcaatgttggaggcaaggatgatgtctctgctgtgaagaagtcagggtgttgttcatcctaaatcgcatacgaccatgaaaaggaaccatatgctcacccaatcatatgattggtaattgaaaatatgactcccttgtgttgcctagcctggttggttatgagattatgttggtacaccagaaaaacgatttagaggttaaaagttttaattccaggctgggacaaaaactaacgttttgcagtgtcattgatattcatggtctccttgtatggtttatatgcactactgttccacactaattgatattagaatctcctccacacacctcactacataacataccctgctaaaatgttgtaattggagctactgatgtttccttgctgggagcaaagagtttaactttgtcttttatgtcacaaggggttatgttccactcggtaaatgtccatctgtcactggtaggcagcaagtgtttttagagggttatatcatgtaattctcacaggtgtacaaaatttggattgaaggtttatgttcctcatcagcctatttattttcatgttcaggcatatacacatttttattttatgttcatgatggttttaatcttggtttt

SEQ ID NO: 3099 - DNA, 1739 bp, Setaria italica
agggggtatcatgcatctgatctaccagcgacgagctcaggagcaggcaactctgtgcatgcatggagctgaaggttttgctcattctagtggatggatcttcagagcctgcacatctttctgtcatgcatgtgagcggcgtcatgtgccgggtggacgcctgtcgccgcatgtgttcgttccttgcaggagcaaaacgcccagcagagacaccgaggcgggacgggaacctgccacaggcggccagcgaggcgcttgctattttccgccgccccctcctcctcaacgttctccccacctcccgcctccgccccctcctcttatacgcgccacccacgcctcgcctccgcctcccctcctcctccacctcgcctccgcctcccctcccgcggcagccccgagaagcactgcgggcctcacctgcccgtcctcctgcccccaagaaccgccggttcaggaaggaaggaagggaaggaagggaagcgcctgcctgccggggctgagcgaccgaccatggcgtacagggcggaggacgactacgactacctcttcaaggtcgtgctcatcggcgactccggggtcggcaaatccaacctgctctcgcggttcacgcgcaacgagttcagcctcgagtccaagtccaccatcggggtcgagttcgccaccaggagcatcagggtcgacgacaaggtcgtcaaggcccagatctgggacaccgccgggcaggagaggtatcgggcaattacaagtgcatactatagaggggctgttggcgcactggtcgtgtacgatgtgacacgccatgtgacctttgagaatgtggagaggtggttgaaggagctccgggatcacacagatgcaaacattgtcatcatgcttgtcggcaacaaggctgatctgcgacaccttagggctgtatctgtggaggatgccaagggctttgctgagagggaaagtaccttcttcatggaaacttccgcactggagtccatgaacgtcgagagcgccttcaccgaggtcctaactcagatctatcgtgtggtcagcaagaaggccctcgacattggcgatgaccctgcagctccaccaagaggacaaaccatcaatgttggaggcaaggatgatgtctctgctgtgaagaagtcagggtgttgttcatcctaaatcgcatacgaccatgaaaaggaaccatatgctcacccaatcatatgattggtaattgaaaatatgactcccttgtgttgcctagcctggttggttatgagattatgttggtacaccagaaaaacgatttagaggttaaaagttttaattccaggctgggacaaaaactaacgttttgcagtgtcattgatattcatggtctccttgtatggtttatatgcactactgttccacactaattgatattagaatctcctccacacacctcactacataacataccctgctaaaatgttgtaattggagctactgatgtttccttgctgggagcaaagagtttaactttgtcttttatgtcacaaggggttatgttccactcggtaaatgtccatctgtcactggtaggcagcaagtgtttttagagggttatatcatgtaattctcacaggtgtacaaaatttggattgaaggtttatgttcctcatcagcctatttattttcatgttcaggcatatacacatttttattttatgttcatgatggttttaatcttggtttttgttcttttcatccat

SEQ ID NO: 3100 - DNA, 1008 bp, Zea mays
ggaattgggaactgagaaggaaaaaaaaacacccacacccacacccgctctgccccatccgcgcgcccctcctcctccaccgcccgtcccgccgccgcccggccgtctggtggcgatggcgtaccgggcggacgacgactacgactacctcttcaaggtggtgctcatcggcgactccggcgtcggcaagtcgaacctgctctcgcgcttcacgcgcaacgagttcagcctcgagtccaagtccaccatcggcgtcgagttcgccacccgcagcatccacgtcgaggacaaggtcgtcaaggcccagatctgggacaccgccggccaggaaagataccgcgctatcacgagcgcgtactaccgcggagcggtaggggcgctggtcgtgtacgacgtcacgcggcacgtcaccttcgagaacgtggagcggtggatgagggagctgagggaccacacggacgccaacatcgtcatgatgctggtagggaacaaggcggacctgcgccacctcagggccgtcccgaccgaggacgccaaggccttcgccgagcgccagaacgccttcttcatggagacgtcggccctggaggcgatgaacgtggaggacgccttcaccgaggtgctcgcgcagatctaccgcgtcgtcagcaagaaggcgctcgacatcggcgacgaccccgccgcgcctcccaggggccataccatcaacgtcggcggcaaggacgacgtgtccgcggtcaagaagtctgcctgctgctcgtcttagcttgagaggatagagcgtgtacttgggtttggttgttgatacttcagcactagagggcacatgacgttattgcagtcatggtcctcgatctgtattcattcgtttccaggtgtctcgttgattttgccatttgattcattcaggacttgggcctttctggtgtagtgtagggataccttgttccttttatttcttgtacctgcatactgtcgcttctcttatcaaactagctgcattacttc

SEQ ID NO: 3101 - DNA, 1415 bp, Zea mays
ggcggccagggccagggaggcagcttcggcgcggcgcaggccgcagcgcgcttgctatttttccgccggccccttggccctcgccttgctcctcttctttattatacgcgccaccacacgcatcgcgtccgcctcccaccacctcgccattctccccctcccgcgccccgagaagcgctgcgggcctcacctgcccgtcctcctgcctctcaggaaccgcggttcaggaaggaagggaaggcaagtgcctgccggggctcagcaccgatggcgtacagggcggaggacgactacgactacctcttcaaggtcgttctcatcggcgactctggcgtcggcaaatccaacctgctctccaggttcacgcgcaacgagttcagcctagagtccaagtccaccatcggggtcgagtttgctaccaggagcatcagggtcgacgacaaggtcgtcaaggcccagatctgggacactgctggccaggagaggtatcgggcaattacaagtgcgtactatagaggggctgttggagcacttgtcgtgtatgatgtgacacgccatgtgacctttgagaatgtggagaggtggttaaaggagctccgggatcacactgatgcaaacattgtcatcatgcttgttggcaacaaagctgatctgcgacaccttagagctgtatccgtggaggatgccaagggcttcgccgagagggaaagcacattcttcatggaaacatccgcactggagtccatgaatgtcgagagcgctttcaccgaggtcctaactcagatctatcgtgtggtcagcaagaaggcccttgacattggcgatgaccccgctgctccaccaagagggcaaaccatcaacgttggtggcaaggatgatgtctctgctgtgaagaagtcagggtgctgttcatcctaaatcacttatgaccatgaaaaggaaccatatactctccgatcatatgattggtaactgaaaataggactctcttgtgcttcctaacctgttggttatgagattatgttggtgctccagagaaatgattagatgttaagaatttgattccaagctgggacaagaacgttctttccgtggtgtcattgatattcatggtttctttctatggtttatagtgttccacactaattgacattagaatcctccccacacctcacagcttaacataccttgctaaacatgttgtaattggagctactgatgtttccttactgggagcaaagagtgtaactttttctttttatgtcacgagggattatgttccactcggtaaatgcccatctatcgttggtaggcagcaagtgttttagagtgttatatcatgtaattctcacagatgtacaaaatttgggttggaagtttatgttctgcaacagcttatttatcgacatgttcag

SEQ ID NO: 3102 - DNA, 1245 bp, Elaeis guineensis
ccgagatacgtcgtccgtttttcggctcctctgttccctcaaaaagcttcaaatcttctctccctctcccttgctctcgacgccaagaatcctcgcgacaacgacgacccgttccttcttcttctgagacaagcgaagggcggcggagggagctccgatctggtcgctggaggagggcaggaaggcggcgacggcgccggcggcgaggcggaagaggtggttttggaggaggaggaatggcgtatagggcggacgacgactatgattacctcttcaaggtagtgctgatcggagactcgggggtggggaaatcgaacctgctatcgaggtttacgaggaatgaattcagcctcgagtcgaagtccaccattggcgtcgagttcgccacccggagcatccacgtcgacgacaaggtcgtcaaggcccagatttgggacaccgccggccaagaaagataccgagctatcacaagtgcatattatcgaggagctgttggtgctctccttgtctatgatgttactcgacacgtcacgtttgagaatgtggaaagatggttaaaggagcttagggatcacacagattccaatattgtaatcatgcttgttgggaataaagctgatttgcgccaccttagggcagtttcaactgaagatgcaaaggctttcgctgagagggagagcaccttcttcatggagacatctgctctggaatcaacgaatgtggagaatgccttcactgaagtgctcactcagatatatcatgtagtcagcaagaaggcacttgatattggcgatgatccagcagcattgcccaaggggcagacgattaatgtgggaaccaaggatgatgtatctgctgtgaagaaagttggttgctgttcagcttaggtctgggaaacaaggtagttgattttgtgatctagggaaactctggagaattttgaatgctgccagacctgttgatacaaggatgttgttgggatgacacttaaaagacacttctccttgcacagttttgctggtcatgacatggttttgaggggttttagacttttttgcctgagatggctgaagcttaggatttcatatttgcagtttgttagtttgttgcattcagactattgcttctcatttgatgtactgctattacttttggtccacacaagcttctgttgcattcagttattggattccagataccctgtaatcactaaaatttttatctatagctaaattattggttggt

SEQ ID NO: 3103 - DNA, 1383 bp, Oryza sativa
gggtgcataaaaaaaaaacagaagggcgaaacagccatcagcagggaaacctgattaactgacagctccaccccgttttgctattccaggggggccctctgcaacaacacaaggtttgcctccacctctcttgcatttcctattctctcaaatactaggacgcgcaccccgcgcgccattccgcttccccctcccctcctctcgctctcgcttgcggccgcgcgcgcgggcccccggtggtgcgagcagtcgtcgtcgtcgtcgtcatcgtcttcgtccggggccaggtggtcggggggcgaggcgatggcgtacagggcggaggacgactacgactacctgttcaaggtggtgctcatcggcgactccggggtcggcaaatccaacctcctctcccgcttcacccgcaacgagttcagcctcgagtccaagtccaccatcggcgtcgagttcgccaccaggagcatccgcgtcgacgacaaggtcgtcaaggcccagatctgggacaccgccggccaggagaggtatcgggcgattacaagtgcatactatcgaggggcagttggcgcacttgtcgtgtacgacgtgacacgccatgtcacctttgagaatgtagagaggtggttgaaggagctccgggatcacacagatgcaaacatcgtcatcatgcttgttggcaacaaggctgatctgcgtcaccttagggccgtatcggttgaggacgccaagggcttcgccgagagggaaagcaccttcttcatggaaacgtccgcgttggagtccatgaatgtagaaagtgccttcactgaggtgctaactcagatctatcgcgtggtcagcaagaaggccctcgacatcggcgatgaccctgctgctccaccaagaggacagaccatcaatgttggtggcaaagatgatgtttctgctgtgaaaaagtctggatgctgttcatcctaaatccattatgtccatgagaaggaaccatatgctcacctgattatatcatgagtaattaaaaggataactttcttttgctgcctaacctggttgcctgtgagattttagtgttacatcaagaaggttggggctgttaaacccaggttgggaaaaagctaactttgaagtgtcagtggttttatggtttgcatttgtggtttcttcattggtgtactattgttccatgtaaattgacaggatttgagatcctccccacctttcactgcataacatatcccagtaaaatgttgttgtaattggatatcagactgtagctgattggcagcaagagttctaattagaagggctattatattctgtaactcctactcacaaatgtacaaaagtttgcatccttgaacttcttaccagcctgtatattacggt

SEQ ID NO: 3104 - DNA, 1269 bp, Secale cereale
cctctcccttcccttcccttccctcggcgaccgccccaggaagcgctgccccgcccgcctccgccaggaaggaagggggccgtcgtcgggtcgggtcgggccggccatggcctacagggcggaggacgactacgactacctcttcaaggtcgtgctcatcggcgactccggggtcggcaagtccaacctcctctcccgcttcacccgcaacgagttcagcctcgagtccaagtccaccatcggcgtcgagttcgccaccaggagcatccgggtcgacgacaaggtcgtcaaggcccagatctgggacacggcagggcaggagaggtatcgggcaattacaagtgcatactatcgaggggccgttggtgcgcttgtcgtgtacgatgtgacacgccatgtgacctttgagaatgtggagaggtggttgaaggagctccgggatcacacagatgcaaacattgtcatcatgcttgtcggcaacaaagctgatctacgccaccttagggccgtatcagtggaggatgccaaggcctttgctgagagggaaagcaccttctttatggaaacatctgcgttggaggccatgaacgttgagaacgccttcactgaggttctgactcagatctaccgtgtggtcagcaagaaggccctcgacataggcgatgaccctgctgctccaccgagagggcaaaccatcaatgttggtggcaaggatgatgtctctgctgtgaaaaaggcagggtgctgttcatcctaaattcgttttgcttgtgaagagggaccatacgctcacctgattatatgggtaactgcaaatatgacatcctttttgcctcctaacctggttgtttgtgagattatactggtgcaccaagaattccgtttagatatcaagatttaaccccaggttgataaggggggaaatgctaaccttggaatgtcagtgattttgtggttgccatttatggtttcttagctgctgtattgtcccacctcaattgacacaagaatcctctcaacatttcactgtgcagccttatctgataaaggttgtaatgggagctatggttcattacttctcttggctttcctgctgaatggatgtgtactatgtagccctcagagattatactgtatcttctatatcacaataggttatgtccacttggtaaatgtcatctgtaactggtagccagtatgagttttacactgttatattgtgtatcttccttcccagatgtacagaatttgcattgaagatccatgttt

SEQ ID NO: 3105 - DNA, 1238 bp, Sorghum bicolor
aaggcaagtgcctgcctctgcctgcctgcctgccggggctcaagcagcgcagcgatggcgtacagggcggaggacgactacgactacctcttcaaggtcgttctcatcggcgactccggcgtcggcaaatccaacctgctctccaggttcacgcgcaacgagttcagcctcgagtccaagtccaccatcggggtcgagtttgccaccaggagcatcagggtcgacgacaaggtcgtcaaggcccagatctgggacaccgcaggccaggagaggtatcgagcaattacaagtgcgtactatagaggggctgttggcgcacttgttgtgtacgatgtgacacgccatgtgacctttgagaatgtggagaggtggttaaaggagctccgggatcacaccgatgcaaacattgtcatcatgcttgttggcaacaaagctgatctgcgacaccttagagctgtatccgtggaggatgccaagggcttcgccgagagggaaagcaccttcttcatggaaacatccgcactggagtccatgaacgtcgagagcgctttcaccgaggtcctaactcagatctatcgtgtggtcagcaagaaggcccttgacattggcgatgaccctgctgctccaccaagaggccaaaccatcaacgttggtggcaaggatgatgtctctgctgtgaagaagtcagggtgctgttcatcctaaatcacttatgaccatgaaaaggaaccatatactcagccgatcttatgattggtaactgaaaatatgactctctctaacctggtggttatgagattatgttggtactccagagaaatgatctagaggttaagaatttgattccaagttgggacaaaaactaacttttcaccgtgtcattggtattcatggtttctttttggttcatatgcactacactgttccacactaattgacattagaatcctccccacacctcactgcgtaacgtaccctgctaaaagtgttgtaattggagctactgatgtttttcttactgggagcaaagagttttacgttgtctttaatgtaacgaggggttatgttccactcggtaaatgcccatctgtcattggtaggcagcaagtgttttagagggttatatcatgtaattctctcagatgtacaaaatttggattgaaggtttatgttctgcaccaggctatttattgtcatgttcatacatgtctatatttactgttcatgatggttaagct

SEQ ID NO: 3106 - DNA, 1242 bp, Sorghum bicolor
gttccatacgcatgatatagcagtagttggtagtccccaacatttttgttgcattcatctgggatgattaatcgctcctgtcctgggcatcatcatcatcatcatcatcatcatcatgtgaaggcatgcctgttgcctgccatggccatgtgagggtttaccctcgccggccggcgtcgtatgcccgggtggacgcctgtccctgggccggccgcatgtgttgggtgttgggtgcagacgagacgacaccgaggccaaacggcaacctgacgcaggcggccagcgaggcagctcggcgcggcgcgtcgtccgccccgcagccgcttgctatttttccggcgccccgccccctttggccctcgtggccacaacgttctcttctccccacctccgcttcgtcctcttcttttcttatacgcgccacccacacgccccgcgtccgcctcccgtcctacacctcgccatcctccccccgagaagcgctgcgggcctcacctgcccgtcctcctgccccaagaaccgccggttcaggaaggaaaggcaagtgcctgcctctgcctgcctgcctgccggggctcaagcagcgcagcgatggcgtacagggcggaggacgactacgactacctcttcaaggtcgttctcatcggcgactccggcgtcggcaaatccaacctgctctccaggttcacgcgcaacgagttcagcctcgagtccaagtccaccatcggggtcgagtttgccaccaggagcatcagggtcgacgacaaggtcgtcaaggcccagatctgggacaccgcaggccaggagaggtatcgagcaattacaagtgcgtactatagaggggctgttggcgcacttgttgtgtacgatgtgacacgccatgtgacctttgagaatgtggagaggtggttaaaggagctccgggatcacaccgatgcaaacattgtcatcatgcttgttggcaacaaagctgatctgcgacaccttagagctgtatccgtggaggatgccaagggcttcgccgagagggaaagcaccttcttcatggaaacatccgcactggagtccatgaacgtcgagagcgctttcaccgaggtcctaactcagatctatcgtgtggtcagcaagaaggcccttgacattggcgatgaccctgctgctccaccaagaggccaaaccatcaacgttggtggcaaggatgatgtctctgctgtgaagaagtcagggtgctgttcatcctaa

SEQ ID NO: 3107 - DNA, 1606 bp, Panicum virgatum
actacaaatcagcctatccattttgctcaagtaatcagatcaaatttcccaactgtagagacaccattagtaatatataggccaagagctacttggttataaaaaacaatgcgtgagctgacgctggtttttaagaggcctgcgtgcatgcacgttcatgtttagcttgctattttccggcgtccccccctgctgtcctcaacgttctccccacctcccacctccgccccctcctcttatacgcgccacccacgcctggccctccgccctcccctcccgcggcagccccgagaagcgctgcgggcctcacctgcccgtcctccttgccccaagaaccgcggttcaggaaggaagggagggaagcgcctgcctgcctgctgccggggctgacctgcaaccatggcgtacagggcggaggacgactacgactacctcttcaaggtcgtgctcatcggcgactccggggtcggcaaatccaacctgctctcgcggttcacgcgcaacgagttcagcctcgagtccaagtccaccatcggggtcgagttcgccaccaggagcatcagggtcgacgacaaggtcgtcaaggcccagatctgggacaccgccgggcaggagaggtatcgggcaattacaagtgcgtactatcgaggggctgttggcgcacttgtcgtgtacgacgtgacgcgccatgtgacatttgagaatgtggagaggtggttgaaggagctccgggatcacacggatgcaaacattgtcatcatgcttgtcggcaacaaggcggacctgcgacaccttagggctgtatccgtggaggatgccaagggctttgccgagagggagagtaccttcttcatggaaacctctgcgctggagtccatgaacgttgagggtgccttcaccgaggtcctcactcagatctaccgtgtggtcagcaagaaggccctcgacattggcgacgaccctgctgccccaccgagaggacagaccatcaatgttggaggcaaggatgatgtctctgctgtgaagaagtcagggtgttgttcatcctaaatccctcgtgaccatggaaaggaaccatatatatgctcatcccttatgactcccttgtgctgatgcctagcctgctggttggttacgagattatgttaacgttggtacaccagaaaaatgcatggtttagaggttaagaatttgataccagctaggtttgggacaaaactaacttttcgcagtgtcgttgacattcatggtttccttgtatggtttgtatgcaccactgttccacactaataggccttagaattctctccccacctcactacgtacgtaacatacccggcctgctaaagtgttgtaattggagctactgatgatgtttgcttgctgggagcaaagagtttaactttgttttttatgtcacgaggggttatgttccactcggtaaatgtccatctgtcattggtaggcagcaagtgtttttagagggttatatcatgtaattctcacagatcgatgtacaaaatttggattgaaagtttatgttcctcgtcagcctattcattttcatgctcagaaatacacatttacagttgctgttcatgatggt

SEQ ID NO: 3108 - DNA, 1022 bp, Triticum aestivum
agggagatggcgtacagggcggaggacgactacgactacctgttcaaggtggtgctgatcggggactcgggggtgggcaagtccaacctgctcacccgcttcacccgcaacgagttcagcctcgagtccaagtccaccatcggcgtcgagttcgccacccgcagcatccacgtcgacgacaaggtcgtcaaggcccagatctgggacaccgccggccaggagaggtaccgggcgatcacgagcgcgtactaccgcggggcggtgggcgccctggtggtctacgacgtcacgaggcacgtcaccttcgagaacgtcgagaggtggctgagggagctcaaggaccacacggacgccaacatcgtgatcatgctcgtggggaacaaggcggacctgcgccacctcagggccgtcccgtccgaggacgccaaggccttcgccgagcgcgagaacaccttcttcatggagacgtccgccctcgaggcgatgaacgtcgaggacgccttcaccgaggtgctctcccagatctaccgcgtggtgagcaagaaggccctcgacatcggcgacgaccccgccgcgccccccaagggcaagaccatcaacgtcggctccaaggacgacgtctccgcggtgaagaaatccaactgttgttcgtcttagctcaagatggtggcttggcatcttatactgtaggggagggcactatgttattgcagtcatagtcctcgtttgtattcatgcgccatcaaccatatcccagtgttcattttgccatgtttgatacatttgattcgttcaggactacagcttttgctggtatagtttagggatttgaaagtgtgagtgaggttatcgtgaatttcttacaggcctttccttggatgttttctacctcttggatctgtgtattcctgagtctgcttgtttacacagttccatttcgttcaggggatttgtcatggtaaaactgttactgtaccaaatatttttgcagactcccatcatgaaaactacagttaaaagcc

SEQ ID NO: 3109 - DNA, 1341 bp, Triticum aestivum
cttcctgccccttgccattccaagaacgttctccggggcgtctcctcctcctcccaccaccccatcccgttgctgtaactccgataagcgcgcgccgccgccgacggccccagaagccacctccgagctgccatccgcgggaagagcgggtggcttgaccgattctgcgaggacgaagaggaggacgaacgtacgagggcgtggcctacacgtgaccaccgcggcgaaaccaaagaatggcgtaccgggcggacgacgactacgactacctcttcaaggtggtgctcatcggcgactcgggcgtcgggaaatccaacctcctcacccggttcacgcgcaacgagttcagcctggagtcaaagtccacaatcggggtcgagttcgccaccaggagcattagggtcgacgataaggtcgtcaaggcgcagatctgggataccgctggccaagagagatatcgtgcaattacaagcgcatattacagaggagctgtcggtgcgcttgttgtgtatgatgtgacacgccatgtgaccttcgagaatgtggagaggtggctgaaggagctcaaggaccataccgatgctaacattgtgatcatgctagtcggcaacaaggccgacctgcgccacttgcgggctgtctctgtggaggatgccaaggcatttgcggagagggaatacacctttttcatggaaacctctgccctggagtccatgaatgtagaggacgctttcactgaggtgttaacccagatctaccgagtggtcagcaagaaagctcttgacatcggcgacgaccctgccgctccaccacgagggcagaccatcaacgtagggtccaaagacgatgtctctgccgtaaagaaggctggatgctgctcatcctaatccgtagactttgaaaagtataccgggcccttgtttatcattgatggatgggtagctgtgtcttgggcgtgcttttggaggcccatacttaacccagggggttggaaacgatataaaacactaacagtaatagaactagcagccgttttttggaggcagtcatggtatcctaattgttgcagtcttggttcatatcggacgccaaggatcccttccacaatcgattatgtatgtaccctattaagtatgtgtaactgaagctttcatccttttctcctttcttttgagagaaactgttgttatcttgtttgtatgattcttcacattttgctaatcagtgacataatgtaaatcttatggaggaatactattattacctgtcgcccgatgactcggctaattatttttcccgcacaagtcggtttgactgaaggcggatgctatctcgagcgct

SEQ ID NO: 3110 - DNA, 923 bp, Allium cepa
tttctttttaatagccatccgtcgaattcaaactctcgttctttctctacggaatcaaccgggagggagattgtcaaaatttactcgtatattaagatctgatacataagatacaatggcgtatagagcagatgacgattatgattatctgttcaaggttgttctgatcggcgattctggtgttggtaaatcgaatttgttgtctcgatttacaagaaatgaattcagtcttgaatctaagtctaccattggggttgagtttgctacgaggagtattcacgttgatgataaggttgtcaaggctcagatttgggatactgctggccaagaaaggtatcgtgcaatcactagtgcatactatcgaggagccgtaggtgcactgctggtctacgacgtgaccaggcacgtaacatttgaaaacgtagagagatggctaaaagaactaagagaccacaccgatgcaaacatagtgataatgctggtaggaaacaaggcagatctccgacatctcagagcagtgacgaccgaagatgcaaaagcgtttgctgaaagggagaatactttcttcatggaaacgtctgccttggagtcgttaaacgttgaaaatgcattcactgaagttttgtcccagatttaccgtgtcgtgagcagaaaagctcttgatgttggtgatgaccctgctgctttgcctaaaggccagaccatcaacgtcgggtccaaggatgatgtttcggctgtcaagaagtcaggttgttgttcgtcttagattgaattttctgtattatattttaattgggatcaaatttgttgtgaattatgttatgattgtgtggttgtcagttgttggttattatgttcaagtgttacttgtttctgtgatgtatattatggagggtaggggatatgtaaaatactgaaatata

SEQ ID NO: 3111 - DNA, 1382 bp, Brachypodium distachyon
ctccccctcgacgttctccccacctctcttcctcctctcccttctcatatacaccaccgcgccgcgcgcctgcccgtccccttctcctcttcccttccccccaccgccgcagccagccccgcgaagcgctgcggccctccctccccgtcccgcctccgccaggaaggaaggaagggggtcgtcggtggacccatggcgtacagggcggaggacgactacgactacctcttcaaggtcgtgctcatcggcgactccggggtcggcaaatccaacctgctctcgcgcttcacccgcaacgagttcagcctcgagtccaagtccaccatcggggtcgagttcgccaccaggagcatcagggtcgacgacaaggtcgtcaaggcccagatctgggacaccgccggccaggagaggtatcgggcaattacaagtgcttactaccgaggggctgttggtgcgcttgtcgtgtatgatgtgacacgccatgtgaccttcgagaatgtggagaggtggttgaaggagctccgggaccacacagatgcaaacattgtcatcatgcttgtcggcaacaaggctgatctacgccaccttagagctgtatcagtggaggatgctaaggcattcgctgagagggaaagcaccttctttatggaaacatctgcactggaggccatgaacgttgagagtgccttcactgaggttctaactcagatatatcgtgtggtcagcaagaaggcccttgacataggggatgatcctgctgctccaccgagaggacaaaccatcaacgttggtggcaaggatgatgtttctgctgtgaagaaggctgggtgctgttcttcctaaattcattttgctgtgaagaggaaccatatgctcacctgattatgtgatgggtaactgcaaatatgacttcgttttgccacctaacctggttatttgcgatattatatcggtacaccaagaaattcattagatatcaagatttaacctcaggttgggaaagaaaaaagcgctagccttggaatgttggtgaatttcatggttgccttttatggtttcttaactgctgtattgtcccacctcaattgacatgaggatcctctccacattttaatgcacagcgtagttttgtaatgggagttatcattcattacttctgttgttggatggatcagtactatagccctcaaagatggtaatgtatctatattgtgtgataggttatgttctactcggcaaatgtcatacgtaactggtagccaatatgagttttacacggttattctgttatattatgtacttcccccagatgtacagaacttgaattgaagaaccatgtttcttatcaccctatgttttcacatgctaccattttaagccta

SEQ ID NO: 3112 - DNA, 1365 bp, Brachypodium distachyon
cccctcgacgttctccccacctctcttcctcctctcccttctcatatacaccaccgcgccgcgcgcctgcccgtccccttctcctcttcccttccccccaccgccgcagccagccccgcgaagcgctgcggccctccctccccgtcccgcctccgccaggaaggaaggaagggggtcgtcggtggacccatggcgtacagggcggaggacgactacgactacctcttcaaggtcgtgctcatcggcgactccggggtcggcaaatccaacctgctctcgcgcttcacccgcaacgagttcagcctcgagtccaagtccaccatcggggtcgagttcgccaccaggagcatcagggtcgacgacaaggtcgtcaaggcccagatctgggacaccgccggccaggagaggtatcgggcaattacaagtgcttactaccgaggggctgttggtgcgcttgtcgtgtatgatgtgacacgccatgtgaccttcgagaatgtggagaggtggttgaaggagctccgggaccacacagatgcaaacattgtcatcatgcttgtcggcaacaaggctgatctacgccaccttagagctgtatcagtggaggatgctaaggcattcgctgagagggaaagcaccttctttatggaaacatctgcactggaggccatgaacgttgagagtgccttcactgaggttctaactcagatatatcgtgtggtcagcaagaaggcccttgacataggggatgatcctgctgctccaccgagaggacaaaccatcaacgttggtggcaaggatgatgtttctgctgtgaagaaggctgggtgctgttcttcctaaattcattttgctgtgaagaggaaccatatgctcacctgattatgtgatgggtaactgcaaatatgacttcgttttgccacctaacctggttatttgcgatattatatcggtacaccaagaaattcattagatatcaagatttaacctcaggttgggaaagaaaaaagcgctagccttggaatgttggtgaatttcatggttgccttttatggtttcttaactgctgtattgtcccacctcaattgacatgaggatcctctccacattttaatgcacagcgtagttttgtaatgggagttatcattcattacttctgttgttggatggatcagtactatagccctcaaagatggtaatgtatctatattgtgtgataggttatgttctactcggcaaatgtcatacgtaactggtagccaatatgagttttacacggttattctgttatattatgtacttcccccagatgtacagaacttgaattgaagaaccatgtttcttatcaccctatgttttcacatgcta

SEQ ID NO: 3113 - DNA, 998 bp, Lolium multiflorum
gtcgggtcgggggaacacgcgcgcgccaccatcgatggcgtacagggcggaggacgactacgactacctcttcaaggtcgtgctcatcggcgactccggggtcggcaaatccaacctgctctcccgcttcacgcgcaacgagttcagcctcgagtccaagtccaccatcggggtcgagttcgcaacaaggagcatcagggtcgacgacaaggtcgtcaaggcgcagatctgggacaccgcggggcaggagagatatcgggcaattacaagtgcgtactatcgaggggctgtcggcgcgcttgtcgtgtatgatgtgacacgccatgtgacctttgagaatgtggagaggtggttgaaggagctccgggatcacacagatgcaaacattgttatcatgcttgtcggcaacaaggctgatttgcgccaccttagggctgtatcagtggaggatgccaaggccttcgctgagagggaaagcacctactttatggaaacatctgcgttggaggccatgaatgttgagaacgccttcactgaggttctaactcagatctatcgtgtggtcagtaagaaggccctcgacataggtgatgaccctgctgctccgccaagagggcaaaccatcaatgtcggtggcaaggatgatgtctctgctgtgaagaaggcagggtgctgttcatcctaaattcgttttgctcgtgaagagggaccatatgctcacctgattatacgatgggaacttcaagtatgacttcatttttgccacctaacctggatgtttgtgagaagattatattggtgcaccaagaaattcatttagatatcaagatttaaccccagattgggaaggttgtatactatatagccctcagagatggtactgtatcttctgtatcacaataggttatgttctacttggtaaatgtcatctgtaactggtagccagtatgaggtttacatggttataccgttatattgtgtattttccccagatgtac

SEQ ID NO: 3114 - DNA, 1509 bp, Zea mays
ctccttcccggtcccggctacccacaggccgcagtgccccgcttgctattttccgccgccaacgttctccctcctccccgcccccacctccgcttcctcctacgcgccacccacacgcctcgcgtccgcctccccgcctacacctccccattctccagcgtcccgcgccccgagaagcgctgcaggcctcaccttcccgtcctgctgccccaggaaccgcggttcaggaaggaaggaaggaggaaaggcaagtgcctgccggtgccggggctcagcagcgcgcgatggcgtacagggcggaggacgactacgactacctcttcaaggtcgttcttatcggcgactccggcgtcggcaaatccaacctgctctccaggttcacacgcaacgagttcagcctcgagtccaagtccaccatcggggtcgagtttgccaccaggagcatcagggtcgacgacaaggtcgtcaaggcccagatctgggacaccgccggccaggagaggtatcgggcaattacaagtgcgtactatagaggggctgttggtgcacttgtcgtgtatgatgtgacacgtcatgtgacctttgagaatgtggagaggtggttaaaggagctccgggatcacactgatgcaaacattgtcataatgcttgttggcaacaaagctgatctgcgacaccttagagctgtatccgtggaggatgccaagggcttcgctgagagggaaatgaccttcttcatggaaacatccgcgctggagtccatgaatgttgagagcgctttcaccgaggtcctaactcagatctatcgtgtcgtcagcaagaaggcccttgacattggcgatgaccctgctgctccaccaagagggcaaaccatcaatgttggtggcaaggatgatgtctctgctgtgaagaaggcagggtgctgttcatcctaaatcacttgtgaccatgaaaaggattaaaggaactatatactcaccccggtcatatgattggtaactgaaaatatgactcttgtgctgcctaacctggtggctattagattatgttggtactccagagacatgatttagaggttaagaatttgattccaagttgggacaaaaaacttacttttcacggtgtcattgatattcatggcttcgttgtatggttcatatgcgctactgttccacactagttgacattagaatcctcccaatccctcactgcgtaacataccctgctaaaagtgttgtaattggagctactgatgttttcttactgggagcaaagagtctaaccttttctttttttatgtcacaatgggttatgttccactcggtaaatgcccatctctcattggtaggcagcaagtgttagagggttatatcatgtaattctctcagatgtacaaaatttggattgaaggtttatgaggctatttactgtcatgttcagacatatacacatgtttatacttgctgttcatgatggttaagctaatcttggtgttgtgtaacttctcgg

SEQ ID NO: 3115 - DNA, 1027 bp, Nuphar advena
taattacagtctcaggatagaaggaaagaaaggagggagattcgattcaattttcttttcacatttctcctttatctgcggatcgagcggaaggagggggaagaagagaaagggagatggcgtacagagcggacgacgactacgattacttgttcaaggtggtgctgatcggcgactccggcgtcgggaagtcgaacctcctctccaggttcacgaggaacgagttcagcctcgagtccaagtcgacgatcggcgtcgagttcgcgaccaggagcatccacgtcgacgacaaggtcgtcaaggcgcagatttgggacaccgccggccaggagcgataccgtgctattaccagtgcatactatcgaggcgctgttggtgcactgattgtttacgacgtgacccgtcatgttaccttcgagaatgtggaaagatggttaaaggagctcagagatcacacagatgccaatattgtcatcatgcttgttggaaacaaggcagaccttcgtcatctacgggctgtttctacagaggatgcaaaaggatttgctgaacgggaaaacacctttttcatggagacatctgcattagaatcgttgaacgtggaaaatgcttttaccgaagtcctcacccagatctaccgcgtcgtcagcagaaaagctcttgatatcggcgacgacccggctgccttgcccaagggacagaccatcaatgtgggcaacaaagatgatgtatctgccgtgaagaaagttggatgttgctctgcctagggcctggccctggaacccaccccgtgccgttaaccactctctctctctctcttttgtgctacttgacttgataaccgggttgcagtttgtccatgccttctaacccatcatcttgcctcatttttttcgtgcacccttggtgcttgtattctctttggtccacttaagggtgcttgtattctctttggttcagctttgcctttttttgtagtgaacattttagtgtggtaatgttttgataacacgatttgtaattgtct

SEQ ID NO: 3116 - DNA, 865 bp, Ananas comosus
agagagagagagaaagagctaaacataaaacaccgcgcccacactcagagacaccgccatttctccgtctctgcacgcctcctccgatccgaatcgaagagaacgaagaagacgaagacgaagaggggatagagagaggtagagagaaggaggcgtccatggcggggtatagagcggaggacgactacgactacctcttcaaggtggtgctcatcggggactcgggggtggggaaatcgaacctcctttcccggttcacgcggaacgagtttagcctcgagtcgaagtccaccatcggggtcgagttcgccaccaggagcatacgcgtcgacgacaaggtcgtcaaggcccagatttgggacaccgcggggcaagagagataccgagcaatcacaagtgcgtactaccgaggtgctgtgggcgctcttttagtctacgatgtaacacgccacgtcacctttgagaacgtggagagatggttgaaggagctccgtgatcacaccgatgccaacatcgtgataatgcttgtggggaacaaagccgacctgcgccacctcagggccgtctccaccgaggatgcgacagctttcgccgagaaagagaacaccttcttcatggaaacttccgctttggaatctatgaatgtggaaaatgccttcaccgaagtgctcacacagatttaccgggtcgtcagcaggaaggcactcgacatcggcgatgatccgtcggcgccgccaaaggggcagacgatcaatgtgggctccaaggacgacgtgtccgctgtgaagaaagtcggttgctgctcagcttaaggtaaaaaatgattaaaaggaagaaaaagtccttcaccttaatgatagcaaca

SEQ ID NO: 3117 - DNA, 922 bp, Humulus lupulus
tgattcattcaaatcctgcaataaatacatctttgcctcttttagtttaaacccaacttacccttttcgattttcgattagagggttgttttagacagaaaaagataagatttttgagaaaattttctctgactttctaccccaccaatcaatcttaagaaaaaaaggaaaactagtaattgtgtcgaaaacaacatgggggcgtacagaacagacgatgattatgattatttgttcaaggtggtgttgatcggagactctggggttgggaaatcgaacctgctgtcgagatttaccaggaacgagtttagcctcgaatccaaatccaccatcggtgttgagttcgccactaggagtattcgagtcgatgataaggtggtcaaggcccaaatttgggacactgctggacaagaaaggtatcgagcaatcaccagtgcatactatcgaggtgctgttggtgctctactagtctatgatgttactcgtcatgtgacatttgagaatgtagaaagatggttgaaggagcttagggatcacacggatgccaacatagtgatcatgctagtcggaaacaaggctgatctgcgtcacctgagagcagtttccaccgaagatgccaaagctttcgctgagaaagagaacacctttttcatggaaacatctgccctcgagtccatgaacgtcgagaatgccttcactgaagttttgactcaaatctatcgcgtggttagcaggaaggccctcgacattggtgaggaccctgcagccttgcctaaaggacagacgatcaatgtcgggggcaaggacgatgtatcggctgtgaagaaagccagttgttgctcagcttaacttaccatacaaaaaaagggttttagattgtgtttttgaagaccatgctttggtcaattgtttatacagaggt

SEQ ID NO: 3118 - DNA, 1114 bp, Thalictrum flavum
attctaaacaacagaacagaacagatcgaataaaaccgcgtatttcaatctactcaactctttgaattagaaaagaattgaatcgagattttgaaatggcggcatatagagctgacgatgattacgattatttgttcaaagtcgttttgatcggagattcaggtgtcggtaaatcgaatcttctttctagatttacaagaaatgagtttagtcttgaatctaaatccactattggtgttgaatttgctactagaagcattcatgttgatgataaggttgttaaagctcagatttgggatactgctggtcaagaaagataccgtgcaatcacaagtgcatactatcgaggagctgttggtgcactgcttgtgtatgacgttactcgtcatgtaacattcgagaatgtggaaagatggttaaaggaacttcgggatcacactgatgccaacatcgtgatcatgctcgtggggaacaaggctgatctgcgccatctgcgtgctgtgtccaccgaggatgcaaaagcctttgctgagagagagaataccttctttatggagacatctgctctggagtccttgaatgtcgaaaatgcttttacagaagtgctcacccagatctatcgcgttgtaagtaggaaggctcttgatattggagatgatcctgctgccttgccgaagggacaaacaatcaatgtgggtaaggatgatgtatcggctgtgaaaaaagttggatgctgctctacctaaggatatcaaagtgatctcaaggatttcttctcttgtataggattccttgttctacgagtgttggtgcctattctgttggcacatcaccgatggaatttttttctttactaaatgcacggttgccgcatcatgagatccaggggattttaaatgtgttatgttacccagaggtgtaggcatagttatatgttgcggttgaatccgtttcagacttattgccatttgcttaggtttgaactttttttgctggatgtatttagtttaagattggaggggctagggttttattatatgtggttgctttgaaacttgaaagtataaatgtattctgattttttttttttccctgtattctgatagaattattt

SEQ ID NO: 3119 - DNA, 813 bp, Allium cepa
attaagatctgttacataagatataatggcgtatagagcggatgacgattatgattatctgttcaaggttgttctgatcggcgattctggtgttggtaaatcgaatttgttgtctcgatttacaagaaatgaattcagtcttgaatcgaaatcgaccattggggttgagtttgctacgaggagtattcatgttgatgataaggttgttaaggctcagatttgggatactgctggccaagaaaggtatcgtgcaatcactagtgcatactatcgaggagccgtaggtgcactactggtctacgacgtgaccaggcacgtaacatttgaaaacgtagagagatggctaaaagaactaagagaccacaccgatgcaaacatagtgataatgctggtaggaaacaaggcagatctccgacatctcagagcagtgacgaccgaagatgcaaaagcgtttgcagaaagggagaacactttcttcatggaaacatctgctttggaatcgctaaacgttgaaaatgcatttactgaagttctgtcccagatttaccgtgtcgtgagcaggaaagctcttgatgtaggtgatgaccctgctgctttgcctaaaggccagaccattaatgttgggtccaaggatgatgtttcagctgtcaagaaggcgggttgctgttcgtcttagattgaattttctgcattatattttaattgggatcaaatttgttgtgaattatgttatgattgtgtggttgtcagttgttggttattatgttcaagtgttacttgtttctgtgatgtatattatggagggtaggggat

SEQ ID NO: 3120 - DNA, 1371 bp, Aristolochia fimbriata
ccatctctcctcgtcaccggaatgtggagatttggaataacgagcccttgtgccttgtagaatcggcagagcggctcgtcatttcatcgctcctgccctagcctctttctcttctctttctttatttttctttttttttttttttttacctttcgtacaatggcttacagagccgatgacgattacgattacctcttcaaagtcgtcttgataggtgactccggcgtcggaaaatccaatctgctttccagattcacccggaacgaattcaatctcgaatcaaaatccaccatcggggtcgaattcgccacaaggagcatccacgtcgacgataaggtcgttaaggcgcagatttgggatacggctggccaagagagatatcgtgcaattacgagcgcgtactatcggggagctgtgggtgcattgctagtctatgatgtcactcgccatgtcacgtttgagaatgtagagagatggttgaaggaactccgagatcatacagactctaacattgtgatcatgcttgttggtaacaaagctgatctacgccacctgagagcggtttccactgaagatgcaaaagcctttgcagagagggagaacaacttcttcatggagacttctgcattagagtcaatgaatgtggagaatgccttcacggaagttctcactcagatttaccgagtcgtcagtagaaaagctctagatattggagatgatcctgcagccttgcctaagggacagaccatcaacgtggggtcgaaggatgatgtatcggctgttaagaaagttggttgctgctctgcttagaagaaaatggaggggggaaaaggggatgacatatctctggcctctctttgacctctctgcctggcgttctgttacaggtatcacacgcagagaatacgccactcgtttgaacccatgttgtgcatgaatgaggattttaaactcatctatcaaaaggaaagagtagggtctagaacatgctagaaattcatcattcactttgtatttgattgaagacttgttttgtttttaccccatttttgtttttggtttttccttactagcaactgtattactccagcctcctcttatactttggttggccttgtttaaagattgtactcggaaagcttcctccgattctctcatgtattgatagtagcgattggcttattccggctgctcgccgaggcttatggtgcagtttttgcatctttgtgcttttactctcgtcgtctctcgagtggcagaaggtgatgcccactaactgattcttgtaaaatttctgaaactagtgcggccaccgccaccgaccttaaaacaaaaaaattaagatattatattttcagtcttttagtagaa

SEQ ID NO: 3121 - DNA, 1119 bp, Eschscholzia californica
ccgactctttagtgtcgagattgcagtaatggagatccacatttgctagtaaaaagagagaaactgtcgagtttgacatcttgaaaaccctaaaatttgaccttttccataccttctcatctttgcttccccttttgatagacgatcgtaattcaaaacctaaaaggaaatggcatatagagctgacgacgattatgattatctcttcaaagtcgttttaattggtgattcaggagttggaaaatccaatcttttgtccagattcaccagaaatgagttcagtcttgaatcaaaatccactattggtgttgaattcgctaccagaagtattcatgttgatgataaggtcgtcaaagctcagatttgggatactgccggacaggaaaggtaccgtgcaatcacgagtgcatactatcgtggagcagttggtgcactacttgtctacgatgtcacgcgtcatgttacatttgagaatgtagagagatggttgaaagagcttcgggatcacactgatacaaatatcgtgatcatgctcgttggcaataaagcagatcttcgtcacttacgagctgtttcaactgaggatgccaaggcatttgcagagagagaaaataccttcttcatggaaacatcagcattggagtctatgaatgtagaaaacgctttcacagaggttctcactcaaatccaccgggttgttagccggaaagctcttgatgttggggacgacccagcagcattgcccaaaggacagacaattagtgtcggtggcaaggacgatgtatccgcagtgaagaaagtcggctgttgctctgcctaatcctcgacaaaaacgaccttaggaggtaattttctctgctgtcctaccaacggagcttccaattccatatcgtattcacagagtgttaactgatattttgtcgtgatatattaagacgtctgaagttgtgtaagttgaactgaaaagtaatttggttttattcatcatccatagcaacttcatgctatttagttagttcttcgtcgttttccttactgtattacttatatctatcgacaggcacaggattatgttatatttgattgttttcgactatgaatggattagaccaatctagt

SEQ ID NO: 3122 - DNA, 999 bp, Cocos nucifera
ggaggaggaaggcaggagaagaggaggagacagagatggcgtacagagcggacgacgactacgattatctgttcaaggtggtgctcatcggggactcgggggtgggcaagtcgaatttactctctcggttcaccaaaaatgagttcagcctcgagtccaaatctaccatcggcgtcgagttcgccacccgcagcatccacgtcgacgacaaggtcgtcaaggcccagatttgggacaccgccggccaagaaaggtatcgtgcaatcacaagtgcgtactatagaggagctgttggtgcacttcttgtctatgatgtctctcgccatgtcacatttgagaatgtggagaggtggctgaaggagcttagagatcacacagataccaacattgtgatcatgctcgtaggaaacaaggctgacctgcgccacctaagagccgtctccacagaggatgctaaggcctttgccgagagggagaataccttcttcatggagacatctgccctcgagtcaatgaatgtagagaatgccttcactgaagttctcactcagatctatcgtgtggtcagcaggaaggctcttgatatcggtgaagatcccgcggctttgccaaagggtcagaccatcaatgtaggcaccaaggatgatgtatcagctgtgaagaaagttggttgttgctccacttagctccctggagtgaggcaattgttcattgtgacttcagctaccatgggataacgacaagctgctttgcaatgcccacatgaagaggtttttggcatgatgcttttcaaagtgttttcctctgaagaaagtttaacattttctaggacacgctcaaggaggttgaacatcacttaggttttatagctatttagattagaagtttaaatttgggatggttgtcatcttcttccaattgacagaaatctttcttttcattattttcccttttttgagtttcaatctattgctttaattcagttaccacagtgttttg

SEQ ID NO: 3123 - DNA, 1254 bp, Vitis vinifera
atttacattcgcagatttcggatatctggcagggaacaacataggaacgacaaagcatccaacctaatcaaacgattcaaaccaaacgaaatcgaaggagatttggatcggatccctgaaggaaccacatctccctcgctaccttcattttcatctccatccaatggcctcttacagagccgacgacgattacgattacctcttcaaggttgttctcatcggcgactccggagtcggcaaatccaatctcctctcccgcttcactcgcaacgagttcagcctcgaatcgaagtctaccatcggcgtcgaattcgccacccgcagcattcgtgtcgatgataaggtcgtcaaggcccagatttgggacaccgctggccaggagagatatcgagcaattacaagtgcatattatcgaggagctgttggtgctttacttgtttatgatgttacccgtcatgtaacatttgaaaatgtggagagatggctgaaggagcttcgggatcacacagactccaacatcgtgatcatgctcgttggtaacaaggcagatctccgccacttgcgagctgtttccactgaagatgctaaggcttttgctgaaagagagaacaactttttcatggaaacatcagctctagagtccatgaatgttgagaatgccttcacagaggtgctgacccagatctatcgtgttgtcagcaggaaagctcttgacatcggggatgacccagcagctttgcccaagggacagaccatcaatgttggaaccaaggatgatgtatcggcagtgaagaaagtgggatgctgttctgcataatactgaagaaacaaggatctagttttgaagaacatcatgtttggagctttctatcctgttcatatttatatagagcatggccctgcatcgcacacgaaagctatgtcaacaaaacttttaactgttagaacatcatgttctggacacttgaacagatcttttgtttatggttagccaaaggtttaggatctaaaggaaacggagcagcacgctgacattttctttgattcattttagctttcaatttccattctttcccatcggtgtactgctataattgctccattaacatagcttcatatttgggtagctgttttgggttataatttgtactcaagtctttgaatttctgtttaaatgcttagctatttacttgattcataaaagtgacattattttcctctactcaatgtactcaactagttaagtttcgccta

SEQ ID NO: 3124 - DNA, 1218 bp, Aquilegia formosa
ctttgcctttgccaactaatcacaacgtttcttcccctttcagcctttctctctctctctctctcgtcttctctctccaaaatgtcgagatttgcagagaagaacagcgaaacctaaacaacagatcgattagaactctaaatcgttttctataataactttgaattgagatatttgaaatggcggcatatagagctgacgatgattacgattatttgttcaaagttgtattgattggagattcaggtgtcggtaaatctaatcttctatctagatttacaagaaatgagttcagtcttgaatctaaatctactattggtgttgaatttgctacaagaagcattcatgttgatgataaggttgttaaagctcagatttgggatactgctggtcaagaaagatatcgtgcaattacaagtgcatactatcggggagcagtaggtgcacttctcgtatatgatgtaactcgtcatgttactttcgagaatgtagaaaggtggttgaaagagcttcgggatcacactgactccaatattgtgatcatgttagtggggaacaaggcagatctgcgccatctgcgggctgtgtccactgaagatgcgaaggcctttgctgaaagagagaacaacttcttcatggagacgtctgcactcgaatcgttgaatgtcgagaatgccttcacagaagtgctcactcagatctatcgtgttgttagccggaaggctcttgacattggggatgacccagcagccttgcccaagggacagaccatcaatgttggcaaggatgatgtatcagctgtcaagaaagttggatgctgctcttcctagttaatgaaacaagaacaacaacagcaaggcatatatctcaacaatattttccccttatggagtcttttttgttatgtggtgtcaggtgactacagttatcaggatgttggcgcgacacctcatggtgcttcatcacaacatttagctttctatggctgcatgtattgcaatgtttaagcttgtctaaggtcagccaaacttttagaatctaaagaagggcatttatcattgtctttgcacctttggcagactccttgtttgtttgagtagtagaaatttcatgttacattacatttccttattaacccataggctctgtgatggattatgaatgtatgcaaaccattcttctcttctgtatctgattacttgactggttcgttatgtt

SEQ ID NO: 3125 - DNA, 1099 bp, Centaurea maculosa
aataaataagctaccaaaaaagcccttgaatgcttctcctccttccttcccaaattaacacttctttcacacgtattttctctctcccacttagtgccacaccacgcagcattgattaagatcattttcaacctcctacagatctccaaacttatctcccctttcttcttcatcaacacacaaacacattgctgctaaaaaaaaccctaatttcctttcattcactaccaaatgggcgcctacagagcagacgatgattacgattacttgttcaaagtagtcctcatcggtgattccggagtcggcaaatcgaatctcttgtctagattcactcgaaacgagttcagtctcgagtctaaatcgaccattggcgtcgaattcgctactcgtagcattcgagttgatgagaaggttgttaaggctcagatttgggacaccgctggccaggaaagataccgtgcaatcacaagtgcatactacagaggtgcagttggtgcattgatcgtctatgatgtaacccgccacgtgacctttgagaacgtagaacgatggttaaaggagctccgagatcatacagatgccaacatcgtcatcatgctggtaggaaacaagtccgatctgcgccatttacgggccgtgtcaaccgaagatgccaaggcatttgctgaaaaagagaacacttattttatggaaacatctgcactcgaatccatgaatgtcgaaaacgccttcacggaagtccttactcaaatctatcacgttgtcagcaaaaaagcgctcgaccttggagacgatccggctgctttgccaaagggacagacgattaacgttggtggcaaggatgacgtatcggcattgaagaaagtcgggtgctgttctacttagatggattgcattctttgtaagttttctaattttaccgagtttttcaggtagtttaagcccgattggccaaaaattaaatacggatgaggggcatatcaggaacaaatgatgttatgattgtttactatctttttatcgttatgttttaacgttgatgtattgttatagcataggtcgattgttcgaagtgtattcaagattctattgctatcca

SEQ ID NO: 3126 - DNA, 1601 bp, Chelidonium majus
agctgattcaacagatttccaaaatgggttggtttgaccaccaccaaacataaatcaatcactccacttctccttcaaatcttcttcctttttgagttaaagatatcttgataactccaaagattcaatctcaacaacagtgcacctgaaaactacaaaacattaaaaggctaataaatcactccacctgtcattaaaacccatttcacaaaactctgaaataatcaaaacccagcctccaaaatcagatcttttttcactaaaaaggtaacagtgatcagtagattcagtacaacttgcacagtgattgaaaagtagatcaatacttctctctatctctctctcatgtcgagattccttgtaatggagatcgacatctgttagtaaacacaaaaacctagataccaaaagacctacctgacctaaagattgaatctctgaaagctgttcccatttcaaattttgatttttttaaatcttagagagaaggaagagaaaaggaaatggcggcatacagagctgatgacgattacgattatctattcaaagtcgtattgattggagattcaggagttgggaaatccaatctcttgtccagattcaccaggaatgagttcagtcttgaatccaaatcaaccattggtgtcgaattcgctacaaggagtattcatgttgatgataaggttgtcaaggctcagatttgggatactgccgggcaggagagataccgagcaattacgagtgcatactatcgtggagccgttggggcactgcttgtctatgacgttactcgtcatgtaacgtttgagaatgttgagagatggctgaaggagcttcgggatcacactgattccaatattgtgatcatgctcgtgggaaacaaagctgatctgcgccacttacgagctgtttcaaccgaggatgccaaggccttcgctgagagagagaacactttctttatggagacatctgcgttggagtctttgaatgtggagaatgccttcacagaagtgctcacccagatctatcgtgtcgtcagcaggaaggctcttgatattggagatgacccagctgcactgcccaagggacaaacaatcaatgttggctccaaagacgacgtatcagccgtgaagaaggtcggatgttgctctgcatagtctttaagaaaggatgaggatggaagtgaacgtaaagatatttttttcatggaatttgagattctatgtggttttgcacttgttggtactcgtccggatgttggcatgtcagacatagaatgcattctcccagattctgtttcacagtcatgcgtttatggatgtttagagttgtgtaaggtgagctgaaggttaattgcaatggttgtttaacgttccgttttccattcattgcagttcatgctgtttagttagttttgcatttttcctttctgtattacttaaaattctcaagaccacagggcccagttatatttgattgcttttggttaccaaatgtatttagacaatctttttctcttgtatctgatgaaatggttagtctttcttgacaagtagaaaatgaccaagtttggtaaatctataaaatactagccaaaatga

SEQ ID NO: 3127 - DNA, 1104 bp, Avena sativa
cctctcccaacgccacggccccgaagaagcgctgccgcggcctccctccccctccccgcccgcctccgcctccgccaggaaggaaggggctgtcgccggttgccggtagggtcgggggacgatggcctacagggcggaggacgactacgactacctcttcaaggtcgtgctcatcggggactccggggtcggcaaatccaacctgctctcccgcttcacccgcaacgagttcagcctcgagtccaagtccaccatcggggttgagttcgccaccaggagcatcagggtcgacgataaggtcgtcaaggcgcagatctgggacaccgcgggacaggagagatatcgggcaattacaagtgcgtactatcgaggggctgttggtgcgcttgtcgtgtatgatgtgacacgccacgtgacctttgaggatgtggagaggtggttgaaggagcttcgggatcacacagatgcaaacattgtcatcatgcttgttggcaacaaggctgatctacgccaccttagggccgtatcagtggaggatgccaaggccttcgctgagagagaaagcatcttctttatggaaacatctgcgttagaggccatgaacgttgagaatgccttcaatgaggttctaactcagatctatcgtgtggtcagcaagaaggccctcgacataggtgatgaccctgctgctccaccaagaggacaaaccatcaatgttggtggcaaggatgatgtctctgctgtgaagaaggcagggtgctgttcatcataaattcattttgctcatgaagagggaccatatgctcacctgattagacgatgggtaactgcaaatatgacttcctttttgccaccttgcctggttgtttgtgagattacattggtgcaccaagaaattcatttagatgtcaagatttaaccccaggctgggaagggaagaaaatgctaattttggaatgtcagagattttatggttgccttctatggtttaaccgctgtatggtcccacctcaattgcacgtgaatcctcccaacatttcactacgcagcttaacctggtaaaggttgtaatgtgacgctatgcttctattagtccttcttctt

SEQ ID NO: 3128 - DNA, 1070 bp, Papaver somniferum
ccaacctccctcgacctcgagaaaccttcaatgtcgacattctggtaatggagatcaaagttgtcaaataaaaatcaaaacctagatttgatccttcataaaaatcttacatatttcgattatatcaccaaatagaaaagaagaagaaatggctgcatatagagctgacgatgattatgattatctatttaaagttgtattgatcggtgattcaggtgttggtaaatccaatcttctgtctagatttactcgtaatgaatttagtcttgaatctaaatcaaccattggtgttgaatttgctacaagaagtattcatgttgatgataaggttgttaaagctcagatttgggataccgctggtcaggaaaggtaccgagcaatcactagtgcatactatcgtggtgccgtcggtgcactgcttgtctatgatgtcacgcgtcatgttacctttgaaaatgttgagagatggttaaaggagctccgcgatcacactgattcaaatattgtgatcatgcttgttggaaataaagcagatctgcgccacctacgagctgtttcaactgaggatgcaaccgcctttgctgagaaagaaaatacctgctttatggagacatctgcgctggaatctatgaatgtggaaaatgccttcactgaagtgctcacccagatctaccgtgttgtcagcaggaaagctcttgatattggggatgacccagcggcattgcccaagggacagacaatcaatgttggctccaaggacgatgtatcagccgtgaagaaggttggatgttgttctgcctaatcttcttaagctcttgatcaatcattttgccacttcattttgtttagctagtttcttgccgcttttctttttcattttgtccatcttcctgtattacttaaatactcaatgacccacatggttcagttatattatattgcttccaaggtagaaatgtatttagacaattcttcttcttcgttgtgtagagatgtaaacacaatgacctagaatttcaatgcagcagctcttgtaatactgtagttgaaaattttgcaagaaccgtttt

SEQ ID NO: 3129 - DNA, 1249 bp, Prunus persica
gggaccggagtctttaatcataaccacaattttgccaactaagaaaccccacaattccagcttgcttcctgtcttcaacctccattttgctatttctctcgaaatcaaacaaaacccattcatcaccataactcacatacagacatagaccgccatgcttcttaatatttatacaacataattccaaaacccatttacccgtcaatccaacttgtttgatttctctcagaaacaaagaaaaagacaaacacaataaaaaagagaagacaaaaaaactcaccaggtaaaaactaaaatatattttctgcgaggagatgggggcgtacagagcagacgacgattatgattacttgttcaaggtggttttgatcggtgactcgggggtcggaaaatcgaaccttttgtccaggttcacgaggaacgagttcagccttgaatcaaagtccaccattggcgtcgagttcgctaccagaagcattcgggtcgatgataaggtcgtcaaggctcagatttgggacaccgccggccaagaaaggtatcgtgcaatcacaagtgcgtactatcgaggtgccgttggtgctttactagtctatgatgttactcgtcatgttacatttgagaatgtggaaagatggctgaaggagctaagggatcatacagatgccaacattgtgatcatgctagtcggaaacaagggagatctgcgtcacctgcgagccgtttccaccgaggatgctaaggcttttgctgaacgagagaacacatttttcatggaaacgtctgccctcgagtcgatgaatgtcgacaatgctttcacagaagtgctgacccagatctatcgggttgtgagcaggaaggcccttgacattggggatgatccagcagccttgcccaaaggacagacgatcaacgttgggggcaaggatgatgtatcagctgtgaagaaagtaggatgctgctcagcttaaattttgaggaatggttcaagtggctttcaaggttctatcccgaggtcatgtctatacagaggttgacctgactcgacgaaattgctttctgaacagaacatgaactctttgaaacattatgctttggatactcgaaagcttgcctatgttagccaaaactttaggatgttaagaatatgttactgttctttcctttgattcaatttgaactacttgcttccccttgtgtattattctccttcctcggttgagttttatataaagttcggttgtttgatcta

SEQ ID NO: 3130 - DNA, 1032 bp, Tripterygium wilfordii
ctatatatatcccttgccttctctggctgcgcgaaatgccggtgaaattatagattcaaacgacgacgttcattgattaccggcagatccacaatcggtagaatcgtaaacgacgcacggatagacagggagagagagagatagaggtgagaatcggaaggaaatgggggcttacagggctgatgatgactacgactacttgttcaaggtggtgttgataggggactcaggtgtggggaaatctaacctgctctctcgattcacgaggaacgagttcagcctcgaatctaaatccaccatcggagtcgaattcgccacccgcagcatccacgtcgacgacaaggtcgtcaaggctcagatttgggacaccgccggccaagaacgataccgtgcgattacaagtgcttactatcgaggagcagtaggtgcattgcttgtctatgatgttactcgacatgtcacattcgagaatgtggagagatggttaaaggagcttcgggatcacactgattccaacattgtgatcatgcttgttggaaacaaggctgatttacgtcatttgcgtgcagtttccactgaggatgccaaggcttttgctgagagggaaaacacctttttcatggagacctctgcacttgaatcgttgaatgtagagaatgccttcactgaagtgcttactcagatttatcgcgtggttagccgtaaggctcttgacatcggtgatgaccctgcagccttacccaaaggacaaacgatcaacgttggcactaaagatgatgtatcagctgtgaagaaagttggatgctgttcagcataatgtccctggaactagtggttttccaatcttagtttaatggggtttcaagaaaatggagtccacagcgtatcgttcacggagaaactacaaatcttgtcagattcatggtttcgactttcaaccgaagaggctttcccacatttagtgcaaacttatctgttacattttccctcccttttctggtttatgaattatggtttgtcttgcttgtttga

SEQ ID NO: 3131 - DNA, 1085 bp, Tropaeolum majus
aaaataaaatatgcagcctcccgcgatttccacacgcaaaacccacgcggtttcaatctcatctttatacttttgaattttgaataaacacatttgtttttagtaaatcaatcctctcaatttctctttgatttaaagaacaggtgaagatcagatagagagaaaagaaaataggggggagggattcattttactctgaatactttgcattctgtaatttttagtgttaattatcgatttaatataatatatatatagagagagagaggagtgggggcttacagagcagacgacgattacgattatttatttaaggtcgtgttgatcggtgattcaggggttgggaaatcgaatttgttgtcgcgattcacgaagaacgagttcagcctcgagtctaagtccaccattggcgttgagttcgctactcgaagcattcatgtcgatgataaggtcgtcaaggctcagatttgggataccgctggacaggaaagatatcgagccatcacaagcgcatattaccggggtgctgttggtgctttactagtctatgacgtgacgcgacacgtcacatttgaaaacgtggagagatggcttaaggagcttcgagatcacacagatgccaacatagtcataatgctcgtcggaaacaaagctgatctgcgacacctacgagctgtttccacagaagaggcgacggctttcgcagaacgagaaaacaccttcttcatggaaacatctgccctggagtctctgaatgtcgagaacgctttcaccgaagtgttgacccagatctatcgtgtagttagcaagaaagccctggacattggggaagacccagcagctttgccgaaaggacagacaatcaatgtgggaggaaaagatgatgtatcagctgtgaagaaagtaggatgttgttctgcttaaaagctttgggaaaaacaagtcttagagagagaggtgaactggactttatactatttctttatactttaggaaacctttttttttctcgatattgacattccagactatagatttttaaggacattcaacaggtttttgttaatgacattattgagtttgaa

SEQ ID NO: 3132 - DNA, 983 bp, Allium cepa
ggggcactaattaatttctttttaatagccatccgtcgaattcaaactctcgttctttctctacggaatcaaccgggagggagattgtcaaaattttctcgtatattaagatctgatacataagatacaatggcgtatagagcagatgacgattatgattatctgttcaaggttgttctgatcggcgattctggtgttggtaaatcgaatttgttgtctcgatttacaagaaatgaattcagtcttgaatctaagtctaccactggggttgagtttgctacgaggagtattcacgttgatgataaggttgtcaaggctcagatttgggatactgctggccaagaaggtatcgtgcaatcactagtgcatactatcgaggagccgtaggtgcactactggtctacgacgtgaccaggcacgtaacatttgaaaacgtagagagatggctaaaagaactaagagaccacaccgatgcaaacatagtgataatgctggtaggaaacaaggcagatctccgacatctcagagcagtgacgaccgaagatgcaaaagcgtttgctgaaagggagaatactttcttcatggaaacgtctgccttggagtcgttaaacgttgaaaatgcattcactgaagttttgtcccagatttaccgtgtcgtgagcagaaaagctcttgatgttggtgatgaccctgctgctttgcctaaaggccagaccatcaacgtcgggtccaaggatgatgtttcggctgtcaagaagtcaggttgttgttcgtcttagattgaattttctgtattatattttaattgggatcaaatttgttgtgaattatgttatgattgtgtggttgtcagttgttggttattatgttcaagtgttacttgtttctgtgatgtatattatggagggtaggggatatgtaaaatactgaaatatattccataaatcaagaaatttgacatagagttgctatacttgttcaac

SEQ ID NO: 3133 - DNA, 1348 bp, Amborella trichopoda
agccggaacatgctatccgcgctcacaagcaaatacatcccccaaattcgtccgatccacgtgcgaggaacttgcacagtgacagagccaggaggcagaaataacagaaatgggtttcaaaatcaaggcctactttcattgcaaagaaaagcagagagaaaataaaagatctcacctctcttctaggttttctttggtatcctctatccttttgatccactcttaaagagagacaaggagaaattttagagagagtaacagagaggaagagaggaagagagagaaatggcctacagagcagacgaggattatgattacctgtttaaggtggttttgattggggattcaggcgtgggtaaatcaaaccttttgtccagattcacgagaaatgagttcagtttggagtccaaatcgacaattggggttgagttcgcgacaagaagcattcacgtagacgataaggtcgtcaaagctcagatttgggacacagctggccaagaaagataccgtgcaatcacgagcgcctattaccgtggagcagtaggcgcgcttcttgtgtatgacgtgacacgccacgtgacattcgagaacgtggagcggtggctaaaggagcttcgcgaccacaccgactccaacattgtcataatgcttgttggcaacaaagctgacctccgccacctaagggccgtctccactgaagatgccaaggcctttgcagagagagagaacaatttcttcatggagacctctgccctcgaatcaatgaatgttgagaatgcattcactgaagtcctcacccaaatataccgagtcgttagccgaaaagcccttgacataggtgaagacccagccgctgcccctccctctaaaggtcagactatcaatgtgggttccaaggatgatgtttcagcggtcaagaaggttggctgttgctctgcctagaggagagatacagagattgatgcctacaatggtatatagagagagagagaaatcgagtagaaggtatttgtacggcatttttttggtgccccaccatgtgaatgcatgcttaattttttttctctggcgagcgtgttacgctctccctgcatggaggttttcaaccgagcaggtggggtagttagagacaagaagaagaggagaagaaaggtgttgtaaaagttttttggttgttttgtgtgtcacgatttagaattggttttaacagactcttagagtagatattatttgatttggttcattgacccccaaaggatttatggtttattgatttggtcgaattggattctgatacattcatcagcttcttttaattctatcaaagtgaagattgtttccgtggtct

SEQ ID NO: 3134 - DNA, 1105 bp, Catharanthus roseus
acctattacatacgactgcatttatctctaagtgggggcttacagagcagatgatgattacgattacttattcaaggttgtactgatcggtgattctggggtcggaaagtccaatttgctttcaagatttacccgcaatgagtttagtcttgagtctaagtctacaatcggagtggaattcgccacccgtagcatccgtgttgatgataaagttgttaaggcccagatttgggatactgctggccaagaaagataccgtgcaattactagtgcctattatcgtggtgctgttggagcattgcttgtatacgatgtcactcgtcatgttacatttgaaaatgtggagagatggttaaaggagcttagggatcacactgattcaaacattgttattatgctcgttggaaataaagcagatctacgtcatctacgagctgtttccactgaggatgccaaggcatttgcagaaagagaaaatacattttttatggaaacgtctgctttggaatctatgaatgtggaaaatgccttcacagaagtccttacccaaatatatcgtgtggtcagcaggaaagcgcttgaagttggagatgatccagcagcgttgcctaaaggacagacaataaatgttggcactaaagatgatgtttcagcagtaaagaaggttggatgctgctctgcttagatacataaatacacataatataggtggagctgtggaggcggaggaaaacaattctttccttttttttcctaatttccatgtggctgcagagtctgtcctttacaaaaatcttgaactacatggatgattagcaaatttacttagttggcatcttatataaggtgaatggctaaccagctatggctgataatatactttcagaagtgagtgctaaaatccccatttcgcgattctttgtccttacttttggttttcctcaatgtactattagtatgaacaatttagattactgttagatttgattgtatttgattgcttttgtttctttttttaatcaaagcacggattaagacatgatatctcagctttgtcttctgttactaaaattttttattcctaagaagaaacataggattaatt

SEQ ID NO: 3135 - DNA, 2142 bp, Cirsium arvense
cactcatccatccatccatccgaaattccaaatttcatttcttctgcaacaaaaatgaacaccggaccaggacttttctccgatatcggcaagaaagccaaagatctgttaaccagagactacctaaccgatcagaaattttccgtttcaaccactagtgcaaccggagttgcaataacatcatctgcaacaaagaagggcggtctgtcaaccggagatgtgggagctgtgtacaaatacaataatatattgttcgacgtcaaagtcgacacagaatcaaagattgctacgacattgactttcacagagcttgtgcctaaaacgaagaccattgcatcattcaaagtgcctgatttcaactccggcaaggttgaggttcaatattttcattgccatgctactttacaatcagcagttgctttcagccaaagccccacaattgatgtttcggccacagttggtactccgatgtttgttatgggcgcagaagcaggttacgagacgtcttctgggaaattcaccaagtacactgctggtataagtatcaacaaacccgagtctagtgcttccataatcttgggtgacaaaggggactcaataagagcatcatacatccaccatcttgaccaatccaaaaaaaccgctgcggtgggcgagatcatcagaaggttctcgttaaacgacaacaccttcacgatcggaggatcgtatgccgttgatcatctcacgatggtcaaggccaagctcaacaaccaggggaagctgggtgcactcttgcagcacgagatcattcccaaatcactcgtgaccctgtctagtgagttggacacgaaagcgttggacaaaactcccaaattcgggttggctcttgcgctcaaaccttgatcgaaaccattttccggtgagagtttcgatatacgatttttttgttgaatcaaattctgagtgtgggttcttttaactgtaattttgacatttttgtccctagattagccatttgaagggagcattcaatcaataagcagttgttgcattatttacattttggtggggttttcagatttctggatgtactgtttaaattattttcagttatgagattgaatgtattattattttctgagaaaaaagaagagtacatggatagcaatagaatcttgaatacacttcgaacaatcgacctatgctataacaatacatcaacgttaaaacataacgataaaaagatagtaaacaatcataacatcattcgttcctgatatgccctcatccgtttttatttttggccaatcgggcttaaactatctgaaaaactcggtaaaattagaaaacttacaaagaatgcaatccgtcttaagtagaacagcacccgactttcttcaatgccgatacgtcatccttgccaccaacgttaattgtctgtccctttggcaaagcggctggatcatctccaacatcgagcgcttttttgctgacaacgtgatagatttgagtaaggacttccgtgaaggcattttcgacattcatggattcaagtgcagatgtttccataaagtaagtgttttctttttcagcaaatgccttagcgtcttcggttggcacggcgcgtaaatggcgcagatccgacttgtttcctaccagcatgatgacgatattggaatctgtatggtctcggagctcctttaaccatcgttctacgttctcaaaggtcacatgtcgggttacatcatacacgattaatgcaccaactgcacctcggtagtatgcacttgtgattgcacggtatcgttcctggccggcggtgtcccaaatctgggccttgacaactttctcatcaactcgaatgctgcgagtagcgaattcgacgccgattgttgatttagactcgagactgaactcatttcttgtgaacctcgatagcagattcgatttcccaactccggagtcaccgatgagaactactttgaacaagtaatcgtaatcatcgtctgctctgtaggcacccattagctatggctatgcaaagaaagaaaaaaaagggtttaatagagcagcaatgtgttgttgatcaaaaaaggggagagatattgcagatctgtatattgaaaatgggggaggttggccatacagatctcaatgaat

SEQ ID NO: 3136 - DNA, 1405 bp, Brachypodium distachyon
ctgggtcattgctgtcattttggatttgggccttgttctccaaccgtccttccttcctccgccctccctttccaaaacgttctccgccgcgcttcctctctctccctttctcgcacaacctctcccacccctcgctggaattccgataagcgcgcgccgccgccgccgaccccagagaccaccacctccgaccccccattggcgggaagggcgtggccgctcgattcgattccacgaggacgaggggcgtggccgtacgtccgtccatcgatcgcgtgatcaccgccgcgggggaaccgaagaagaatggcgtaccgggcggacgacgactacgactacctattcaaggtggtgctcatcggcgactcgggcgtcgggaaatccaacctcctcacgcggttcacgcgcaacgagttcagcctcgagtccaagtccaccatcggcgtcgagttcgccaccaggagcatcagggtcgacgacaaggtcgtcaaggcgcagatctgggacaccgccggccaagagaggtatcgtgcaattacaagcgcatattaccgaggggcagttggggcgctcgttgtgtatgacgtgacacgccatgtgacctttgagaatgtagagaggtggctgaaggagctcaaggatcataccgatgctaacattgtcatcatgcttgtcggcaacaaagccgatctgcgccacttgcgggctgtccctgtggaggatgcgaaggcattcgcggagagggagtacacctatttcacagaaacctctgccctggaggccatgaacgtagaggacgccttcaccgaggttctaacgcagatctaccgagtggtcagcaagaaagctcttgacatcggtgacgaccctgctgctccacctcgagggcagaccatcaatgtcgggtcgaaggacgatgtctctgccgttaagaaggctggatgctgctcatcctaatccctgattatggtgaaaagtctttacattaccggatcatatggtgggtagctgaaacaagagaatgtcttgtttgggtatgcttttggaagcccatagttaacccagggttcgaaaagatgaacactaacagtaacactgaacttgcagccatttcttggtggcagtcctttttctggtatcctaattgctgcactgctgttgcatatctgacgcgagggattccttccacagttgattatgtaacataccctactaaatattgctgtaactgaagcttttattcttttcttctttcttcttctggagagagagcgttagtactattttcttcttgttgtatgaaaattcaccattcttctgctgagttgaaaatattgtaaatcttttggaggagaataattattgtaagcatcgagcaatgcgagttataatcttaaagagatag

SEQ ID NO: 3137 - DNA, 1262 bp, Daucus carota
atcgccttcatctgtactcaacatcagtatcagcgctgcgcctctgctctctccaaatgttgagatctgtacgataagccccctcaaaaccctccgatctgcacttactagttacttatacttacacatatacacacaaatttatccaccgcacaacacagttgagaatgggggcgtacagagcagacgacgattacgattacttgttcaaagtagtgctcatcggagactccggcgtcggcaaatccaatcttctctcgagattcacgcgtaatgagttcagtctcgagtccaagtctactatcggcgttgagttcgctactcggagtattcatgttgatgataaagttgttaaagctcagatttgggacactgctggccaagagaggtaccgtgcaattacaagtgcatactaccgaggagctgttggtgcgctgctggtatatgatgttactcgacatgttacatttgagaatgtagagaggtggcttaaagaactccgggatcatacagattccaacattgtgatcatgcttgtggggaacaaggcggatctgcgacatttgcgagctgtctccactgaggatgccaaggcgtttgcggagaaggagcgtaccttcttcatggaaacctctgccctggagtccatgaatgttgaggatgcttttacagaagtgcttacacagatacatcaagtcgttagcagaaaagctcttgaaataggagaggatcccacagccttgcccaagggacagacaattaatgttggtggcaaggatgatgtatcagcagttaaaaaatctggatgctgctcatcctagatttgtgcattgcgtttctaatcttcagtgacatactatatatgtgcggttgagcttttctgtatgaatcatggttttaggtttaatacatggaggttccagtcaacaaagttagagtttatggcatatgaaattaaaattcttggagtttactgtcattcaagtctgtaagtgaagaagttcaagtattggtcattttttcacctagtttcagtctttttagagccgctatatcaaagttaattatgggcaatccttcaatgtttctctttgattgcttagggctcttcatcttcctttatagtgcagcggcagcagcttttaatcatttctattagcgcagtaaagactgttatcttgtaacatagtgaggtaaccatgccagtatgtgtaatggttttctgtggtacaggatattgtttattaattagtataatgtat

SEQ ID NO: 3138 - DNA, 1102 bp, Daucus carota
gcaaacacacctcgagtccatcgccttcatctgtactcaacatcagtatcagcgctgcgcctctgctctctccaaatgttgagatctgtacgataagccccctcaaaaccctccgatctgcacttacttagttacttatacttacacatacacacaattttatctaccgcacaacacagttaagaatgggggcgtacagagcagacgacgattacgattacttgttcaaagtagtgctcatcggagactccggcgtcggcaaatccaaccttctctcgagattcacgcgtaatgagttcagtctcgagtccaagtctactatcggcgttgagttcgctactcggagtattcatgttgatgataaagttgttaaagctcagatttgggacactgctggccaagagaggtaccgtgcaattacaagtgcatactaccgaggagctgttggtgcgctgctggtatatgatgttactcgacatgttacatttgagaatgtagagaggtggcttaaagaactccgggatcatacagattccaacattgtgatcatgcttgtggggaacaaggcggatctgcgacatttgcgagcggtctccactgaggatgccaaggcgtttgcggagaaggagcgcaccttcttcatggaaacctctgccctggagtccatgaatgttgaggatgcttttacagaagtgcttacacagatacatcaagttgttagcagaaaagctcttgaaataggagaggatcccaccgctttgcctaagggacagacaattaatgttggtggcaaggatgatgtatcagcagttaaaaaatctggatgctgctcatcctagatttgataaactaatgtgtgcattgcgtttctaatcttcagtgacatcctatatatgtgcggttgagcttatctgtatgaatcatggttttaggtttaatacatggaggttccagtcaacaaagttagagtttatggcatatgaaattaaaattcttgaagtttactgtcattcaagtctgtaagtgaagaagttcaagtattggtcattttttcaactagtttcagtctttttagagccgctatatcaaagttaattatgcg

SEQ ID NO: 3139 - DNA, 824 bp, Daucus carota
gccttcatctgtactcaacatcagtatcagagctgcgcctctgctctctccaaatgttgagatctgtacgataagccccctcaaaaccctccgatctgcactcacttagtcccttatacttacacatatacacacaattttatctaccgcacagcacagttgagaatgggggcgtacagagcagacgacgattacgattacttgttcaaagtagtgctcatcggagactccggcgtcggcaaatccaaccttctctcgagattcacgcgtaatgagttcagtctcgagtccaagtctactatcggcgttgagttcgctactcggagtattcatgttgatgataaagttgttaaagctcagatttgggacactgctggccaagagaggtaccgtgcaattacaagtgcatactaccgaggagctgttggtgcgctgctggtatatgatgttactcgacatgttacatttgagaatgtagagaggtggcttaaagaactccgggatcatacagattccaacattgtgatcatgcttgtggggaacaaggcggatctgcgacatttgcgagctgtctccactgaggatgccaaggcgtttgcggagaaggagcgtaccttcttcatggaaacctctgccctggagtccatgaatgttgaggatgcttttacagaagtgcttacacagatacatcaagtcgttagcagaaaagctcttgaaataggagaggatcccacagccttgcccaagggacagacaattaatgttggtggcaaggatgatgtatcagcagttaaaaaatctggatgctgctcatcctagatttg

SEQ ID NO: 3140 - DNA, 1684 bp, Cocos nucifera
tttccatctgtttcctttccctcaaatcttcgaatcttctcttcctcttcctctctcttgatgccgagaatcctcacgacgctgacgatccattccttcttcttctgagtcaagagaagggcggcggagggagctcggatctgcttgccggaagaaggcagaggcggcggcggcgttggcggcggtggtggaggaatggcgtatagggcggacgatgactacgattacctcttcaaggtggtgctgatcggggactcgggggtggggaaatcaaacctgctgtcgaggtttacgaggaatgagttcagcctcgagtccaagtccaccatcggcgtcgaattcgccacccggagcattcacgtcgaagataaggtcgtcaaggcccagatttgggacaccgccggccaagaaagataccgagctatcacaagtgcatattatcgaggagctgtcggtgcactccttgtgtatgatgttactcgtcatgtcacatttgagaatgtggaaagatggttaaaggaacttagggatcacacagattccaatattgtaataatgcttgttgggaacaaagctgatctgcgccaccttagagctgtttcaaccgaagatgcaaaggcttttgctgagagggagagcaccttcttcatggagacatctgctctggagtcaatgaatgtggagaatgccttcactgaagtgctcactcaaatctatcgtgtggtcagcaggaaggcacttgaagttggagatgacccagcagcattgcctaagggccagaccattaatgtgggaactaaggacgatgtatccgctgtgaagaaagttggttgctgctcagtttaggtctgcgtacgaggtaattgatcttgtgaccttgggaaactctgaagaatttcacatgcctccaggcctcttggtatggggatgttgttcgcatggcgcttaaaagatgcttgtcctctcacacaaattttgctggtgattacatggtttgatagggggtttaaactttgcctgagatggttagagatcaggattttatttttgtagtttgtcatcttgttgcattcagactattgtttctcattggatgtattttattgcttttgatcaatacaggcttctgttggattcaatcattggattcttggaataccctgtacccattaaaaacttcttctatggctaaatgattggttggtcgctcgggcttgttatcgcccattaaacaattacacatttcaggtaaattgagttttttgatgcttgctagatgttctctttgaattctgaagttgtatgagcctgagaaacttaaggttcgatccccctccagcattagattttccagatgaagctgattatgttatacggttttggaagtttgtttttatacccccccccccccccccccccccccccccccccccccccccccccccccccccccccccccccccccccccccccattgagcgattgggtaaactctggtttacttgggggacaatggattcatagattgaatgtagtgggcagtttattgataagattcagttggaactgattaataagattattttgaagggtacctgaacaagtaggaaaatgttggacagaactgtggtttgttcgtggaagacgttgaagcgggagaaggggagcttgagactatcaagga

SEQ ID NO: 3141 - DNA, 922 bp, Cocos nucifera
agatagagagggataaggagggagatgtcgtacagggcggacgacgactatgattatttgttcaaggtggtgctgatcggggactcgggggtgggcaagtccaatttgctgtcgcggttcacgcgaaacgagttcagcctcgagtccaagtccaccatcggcgtcgagttcgccacccgcagcatccatgtcgacgacaaggtcgtcaaggcccagatttgggataccgccggccaagaaagatatcgtgcaatcacaagtgcatattacagaggagctgttggtgcacttgttgtctatgatgtcagtcgccatgtcacatttgagaatgtggagaggtggctgaaggagctcagagatcatacagataccaacattgtgattatgctcgtaggaaacaaggccgacttgcgccacctaagggctgtctccacagaggatgctaaggcctttgcagagagggagaacaccttcttcatggagacatctgcactggagtcaatgaacgtagaaattgccttcactgaagttctcactcagatctatcgtgtagtcagcaggaaggctcttgatattggcgatgatcccacaactttgccgaagggtcagaccatcaatgtaggcaccaaggatgatgtatcagctgtcaagaaagctggttgctgctcgacttagatccctcaagtaacgcacctcatctttatgatccttagctaccttgaaattataacaatctgcctcgcatatctgcatgaagaagctttgggcaagatgcttttcaaagttcatttcctctgaagaaagttcacatctttgatgacatgggtgcgaacatctccaaggttttatagctattcagattagaagtttaaatttggggtggttgtcatcatcttcccagtggtgcaaatctttgttttta

SEQ ID NO: 3142 - DNA, 7954 bp, Brachypodium distachyon
tctaaagcctttctttctgtaagagcatgactgcttgaggtatgaattaaacctctccactgctttttgatctgttagcaggaggttttgtgttttgagcatcgagcgctcctccaaaactggaatcaagatgtgttatgtgtctgcagtctacatgtttttccttgcttatgtgtccgtcatatcaagtttgttcttgtttcacttcggttcttttatttgtgtgcgatagatggcaaggacatctagattactccctctgtaccataattattgtcgtgaatttgcactaaaatcacaacaagaattatgagacgcatggagtagttgagaagactagcttcttttttgtcttccacgtcatttcgagaggacaataaagcatattataaaaaagttatctcctagtgtgatattttgcaattgcacttaatgtttgaataaataaaattaagggagaacgttccgtacttatcttagcgtctaactccgtgcgtaccgttcgattgccaccctgatttgttttcccacccaacaacctcctcccctcgtatcccctctttccccaatctccttccgtgttgacaccgcctccagaccaaaacgaccacgcatccttcaacctcctcctctagcctatgtgccttcgctccaggaggtccaacactggtgttgcacacagcgggcaggcgcagcgagccggcgaggttggcggcgccctgcggcacggcggcgcgtgacgcggtgttgacgacaacggagaaattctgcaccatgaggacgacctcaggagtcagtccaattcccacggcttcctggtagacgcagagacggagcttggcgaggacgtgacaggagatgcggtgggagaagagcttgtgctcgcgttgaactctgatgccatcccgattggcagctgccgacgtaggagaccgcactctggcgtgggttgggtagggcttggagatgtgtgggcacccgacaccatcgcagtccagtgggactcgccctcgcgggacaccatcactggcttgctgccgtgtgccaaagtgtcgggtctaatggtggagggattgtatctgcgtcctgcgcaactgtctctcctcgggattttgctctctgcctcgacttcacctagcttcggtgtatggcaggttgagccaggtctctgcttcgtggtcctcctccgaggtctcgcatggggattggggatatagatggaggtggaattgacccggtggatggcgacaacacgacgtcctagctagcgaagggcaccggcaaaggcgatcgacttcgctgctgttaatgagtgatggctggcgagcgccgctgtgaacaacttgaagtggcagtacccaacatggggcagctcgccaatgctgcaagtagccctggcaaatggtttcgtatggaatggttacaatggtttggatcgtttaatgggtttcctctggacgggtgcgattgggctgagttcacaaaaagtctggtctggtttggttttttattcaaatgcggtttgattcggttcggtctggggccaaatggttcggtttaacgtgggttcaacccgtgggtgtagaacggtttcagcctgaatcagcccaatgccccagcgagtcccgaccctattcgggactccctgccaccgcctgcctccgtacgacggtactccgccgccgcccgtctcctccgggccactccaccgcacaccgcaacctcgtccacctcgagaagcaaggccgggacacaagcccggcgtgcggacgccggaggccgccctccccaattcggctggatcttggaggaggaggaggaggggcggccggcggcgaggccatatacaaggattcaacggcagcgcgcaggtcggtgctctccgtccctccttcccctcccttccgatctgtggacttcaaaccagaagctgggatatatgtgtgtaacagcacattacatagatgcaaactataagcttcataagaagattatttctttcaaaaatgtcaagtatcttcataccggtttagctattgaagatgcactttcaagatcagttgcagattgggggatcaaaaggaagttgctcacaatcactttggacaatgcatctaacaacaccaaggcagtgacatcatacttacagaatgaagatcatggtcttttgctagatggactagactttcatgtgaggtgttctgcacatattctgaacattttagtccaagacgggttagttcatgttaaggaagcaataaagaaaatcagggagttgtatagacatattgaaacttcaccttctcgcctgcaaacattcaattctattgctgatctgaagggactcccaaagaaggccggtttaactcttgatcttccacatcgctggaattctacctttgacatgatcgaagaagcttatccgtacaaacatgttttgaatagttatgcagatgaaactaaggaagtggttgcaccaactgaagaagaatgggctgctgcaatgtcaattgggaaagtccttaaagcatttgaagaggctacacttatagtatcaactgataggaaaccatcagcccatatgtttttgaatatggtgttgtgtataaaaaatgctttactagatgcagcatggcaaaccgatcatgtgttgaacaatctggctgatagtatggctacaaaattcagcaagtactgggctgaggcttcaatgaacacaacgcttgtgattgttgctattctggatccaacacaaaagatggattatgtggagttcttttatggaagtgtgtgtttgtccgaagatcgcattgaaagcaatatagaacgcacaatacaaaaattgaagcagtactatgacttgtatgcagaaaatgtgaagagaaccattgagaagtcaatgccttgtcaacctgaaattttgttgggttcaccggtgctaggaaaaaggaaacttgatgaggaatttataaggtacaaggctaggagaagagcgaggaaggagcccggttcagagcttgatgcttatcttgaggaaccagctttgcatactgtgaaggactttgatgtcttgggattttgggagcaaaacacggtaaaataccctgtacttgcagcaatggccagagacttcctcacaatacctctaagtacaatctcgtcggaatcggcattcagtcttggtggtcgcatccttggggacacacgagcctctctaaaacctgatagtcttgaggcccttgtatgtggaaaggactgactgaccaagcgtcggtgagtgagatggcctgacaatgtttacccgtaggcctatgggtaagtatcatgattagtttactgttatgtagtcataatcattgaatattttttgtggacatgattgaagttctcttgctaaaccagcttgcatagtcttaattacatcatcattatttagcttgtctagctctcttgctgaaccctgaataaaggggctcctaagagcaactcttaaacctgtgttgtaagatcttttgtttcaggtgaacagtgtttctttcttcaatttaatttgtttgtaagatgttcagtttgctttcttcaagctcagttccatcttcacatgtaccttaatttgtgctgaaagtagttatcaatctttgttgtcaattgtcagaacaagcaaaattaagccaccagatttgttcactaggtatataaatgacaacctcactccaaaagttactttgatgatgtttgattgacatgcctttgatgtttttacttggctgatgcttttagcttcagacctgtgagtttgattggcctgtctgcatgtgattatcttactctttgagtttgcagggtttgtccggggtgcagaacttcacaaaaaaatggcatgctctgtaaagtataacaaatgctatctttttaattgatcctcgaaggctagctcccactgcaggatcttttttcctagtctagtgtaagattttatcatgtttgctcttgtttattttgatttattattagcattttcttttattttgtactccaaacagaaatggagtactgaacctgaaactgttcatatcatttgccatcatgggcttccttaatgccttttgttttctatgcagaggatgatcgacacgggcagtcacggctagcagtttatggaatcattgttgtcttcgttgatagactcttgatgaacttcagaaggactatttatagtgactaatgtaataatactccgcatataaagtttgacaatgatttgcttgtagagcctgatttgcatgtatcaatcttgctgaaattaacatgcaattatcgatcaacaatgttcttgtttttttaccggaatagtattaatgggttgttacagcggcagctgcatttgcatgtaccaatcttgctgattgactcttcattagcttgtttgctcctatcgatagccaaatgttgttaaacaccaacccgtcccagctgcacgccaccatccatgggttcaaaccgcgtgcataaaatgggtttggtttggtccgggggaaaaactagtctggattggtgcggtttggattttgaggagtgagttttggtttggtgcagtttggttaattcacgtatgcttgaatggtttgggctggatacggggtgggtttcaaccatttaccaggcttagctgcaagtatgtaattaacgaatgttttaccgatgttatatgggttagattagccaatactttctaacaaagttacccatttgtttgggttagagctatcaccatatcccaatataattacccaactttctgggttagaataatcatcacaatgctgttatagttacccaattgtatgggtcacgtcgtaacaaagttacccatttgcttggttgagagttaccaccatatccccaatgtagttactcaactgtttgggttagaataaccatcatgatgctattatagttacccaattttttggattagaaaagtaatcatcatgcaccaacaaagttacccatttgtttggattagagttatcaccatatctccaatatagttacccagttgcctgggttagaataaccggcatgatgttgttatagttacccaattgtcatcttgaagagtaaccatcatgtcataacaaagttacccatgtgtatgagttagagtacccatcatatccctaatgtagttacccaactggttaggttagaataaccatcaagatgttgttatagttacccaaattatctaggttagaaaaagtaactaatgacaccctaacaaagttgctaatgtgttatttgggtgagagttaccaccatatccccaatgtggttacccaatcttttgtgttagagtaaacaacatgatgttggtatagttagctgtctaggttagaagagtaaccatgatgacctaacacagttatccatatgtcgggttagagtaaccaccttatccctaatatagttacccgccattttgggttagagtaaccatcatgtcacgcgttataactaccaccacaacactcgcatatagttacctcggctgttttcattagatttagttttcatgcctgtgactacgtatgaatatcctgataactcacatattaccatcaaataacccgtggactaaaaaacaagttgtcgaaacataccacgtgagatctagttttgaggttgataactacttgtgaatagccgataacacatgtgcttgaagataagtctcaaaagtgttccgaaatgagatccagttctgtagccggtaattgtttgtgaatatgttgataactcacatattactgatcggtaacttttgagccagaaaaaagttagcggtacatagccaagtgagatctagttttgtagccctcgtcgtaacgaattcaatagtgaaaatggattgtaaatcacacatctcatgaaaatgttaaaacttttcgaagtttgaacaaggagaatttttgttgacatcagcaattttggtttgcatgcattaaaatggatagcagtttgtgtaaaatgaaggtgcatgcatgtggagaggacaacgtaatttgagtttgcatgcaacgagagttctagcactaatcgatcagcctgttaattacggggctggattgacagagtgacaacccgtgctaaccagcgtgcgctcctgctttccgacggatcgttccgtacttacctcagatgcataacggttgccaaatagccattatgaaatatatatttgacgctgtacataatgttgatattttttcaaataccctacgttttcgaaaagtaggattatcttgtttgacttttccctcccttgaatgttttataggtttacctgatgatgtctgttgttgctgtttcatctgtgtccaggcaagcccagtgtggttgcaaagttcgatgtgcgtacatcagggtccaagaatacgccaaaatatcactgatccggttttttgtttaaagctatcaccgggtgattttttttttgtgttaaagctatcacccaggtgatggatgacgtgtagccgctggccgctgctgggtcattgctgtcattttggatttgggccttgttctccaaccgtccttccttcctccgccctccctttccaaaacgttctccgccgcgcttcctctctctccctttctcgcacaacctctcccacccctcgctggaattccgataagcgcgcgccgccgccgccgaccccagagaccaccacctccgaccccccattggcgggaagggcgtggccgctcgattcgattccacgaggacgaggggcgtggccgtacgtccgtccatcgatcgcgtgatcaccgccgcgggggaaccgaagaagaatggcgtaccgggcggacgacgactacgactacctattcaaggtggtgctcatcggcgactcgggcgtcgggaaatccaacctcctcacgcggttcacgcgcaacgagttcagcctcgagtccaagtccaccatcggcgtcgagttcgccaccaggagcatcagggtcgacgacaaggtcgtcaaggcgcagatctgggacaccgccggccaagagaggtatcgtgcaattacaagcgcatattaccgaggggcagttggggcgctcgttgtgtatgacgtgacacgccatgtgacctttgagaatgtagagaggtggctgaaggagctcaaggatcataccgatgctaacattgtcatcatgcttgtcggcaacaaagccgatctgcgccacttgcgggctgtccctgtggaggatgcgaaggcattcgcggagagggagtacacctatttcacagaaacctctgccctggaggccatgaacgtagaggacgccttcaccgaggttctaacgcagatctaccgagtggtcagcaagaaagctcttgacatcggtgacgaccctgctgctccacctcgagggcagaccatcaatgtcgggtcgaaggacgatgtctctgccgttaagaaggctggatgctgctcatcctaatccctgattatggtgaaaagtctttacattaccggatcatatggtgggtagctgaaacaagagaatgtcttgtttgggtatgcttttggaagcccatagttaacccagggttcgaaaagatgaacactaacagtaacactgaacttgcagccatttcttggtggcagtcctttttctggtatcctaattgctgcactgctgttgcatatctgacgcgagggattccttccacagttgattatgtaacataccctactaaatattgctgtaactgaagcttttattcttttcttctttcttcttctggagagagagcgttagtactattttcttcttgttgtatgaaaattcaccattcttctgctgagttgaaaatattgtaaatcttttggaggagaataattattgtaagcatcgagcaatgcgagttataatcttaaagagatag

SEQ ID NO: 3143 - DNA, 1092 bp, Theobroma cacao
aaaaaaaaaggaaaaatgttaccttaacacgtacccaataacaagaaaaaaaaaaaacgcgtttctttttccttttttctgtttattcttttttaaatattttgacgccaatcgaaaacaacatcggacgacaaagaaaaacaacaagaagagggaaaacaaaaacgaacataagagagaaatgggagcttacagggcggatgatgactacgattacttgtttaaggttgtcctgattggtgactccggtgttggaaaatccaaccttttgtctagatttacaagaaacgagtttagccttgaatctaagtctactattggggttgagtttgccacccgtagcattcatgttgatgataaggttgttaaagctcagatttgggatactgccggacaagaaagatatcgtgcaataaccagtgcatactaccgtggtgctgttggtgctttactagtctatgacgtcacgcgtcatgttacatttgaaaatgtagaaaggtggctgaaggaacttcgcgatcacactgatgccaacattgtgattatgctagttgggaacaaggcagacctgcgtcacttgcgagcagttgccactgaagatgcaaaatcttttgctgaacgagagaacaccttcttcatggaaacttctgcactggagtctctgaatgttgagaatgccttcacagaagtgctgacccagatttatcgtgttgtaagcaggaaagctctagatattggggatgacccagcagctttgcccaaaggccagacgatcaatgtaggatcaaaagatgatgtatcagctgtgaagaaagttggatgttgctcggcttaagcatggggaataagtctagagatatttatctttgaaatttaatgcctttgttcatatctacatagaagtttcctgacagcacaaagaagaaaacatcaacaatgtattaaccagttgacattgtgctctggatgctaaacacaactcatttatgttaattagcttaaactctaggacttaagattgatggttttatgttgtttttctttgttaatttcaaacattttgcttttaattccttttttgttcattgctct

SEQ ID NO: 3144 - DNA, 854 bp, Manihot esculenta
ccaaatcaaatgggagcttatagagcagatgacgattatgattacttgttcaaggtcgtcttgattggagattctggcgtcggaaaatccaatctcttgtctcgttttaccagaaatgaattcagccttgaatccaaatccaccatcggtgtggaattcgccacccgcagcatccacgtcgatgataaggtcgtcaaggcccagatttgggataccgccggccaagagagatatcgtgccatcacaagtgcatactacagaggtgctgttggagctttgctagtgtacgatgttactcgtcatgtcacatttgaaaatgttcagagatggctaaaggagctcagggatcacacagatgccaacattgtgatcatgctggtaggaaacaaggcagacctgcgtcacctgcgagctgttgccactgaagatgccaagggatttgctgaacgagagaatacctttttcatggagacatcagctctggaatctatgaatgtggagaatgcattcacggaagtgctgacccagatctaccgagttgtaagcaggaaggctcttgacattggagatgacccagcagctttgcctagaggacagacaatcaacgttggaggcagagatgatgtctcagctgttaaaaaggctggatgttgctcgtcttaagcatggataaattgcctcggaagaatctcatctttgaggatttcagggagcgtacctgtgaagagaagaggaggtctaaaggtcatcaaacttcagattctttgccctgttcatatcatagagatttgtctgacaacatgaaaatgttatcttaaaaaaaattgttaactctttgaagcttgtgttccaaa

SEQ ID NO: 3145 - DNA, 1071 bp, Euonymus alatus
aaccgccgacttacccaaatgagggcggcccataaatctccagctccgcaatcggcttccagaaacgcgtctctctttgttttttgaatctgtgtttctatctgttgagaatctaaacaatctctgtgtaggcacagtaattcaaaaaacaaaatttaacaatgggagcgtacagagccgacgacgattacgattacttgttcaaggtggtgctgatcggggactccggcgttggtaaatcgaatcttttgtctcggtttacgcggaacgagttcagcctcgaatccaaatccaccattggcgtcgagtttgccactcgcagcattcacgtcgacgataaggtcgttaaggcccagatttgggataccgctggccaggaaagataccgtgctattacaagtgcatattatcggggtgctgttggtgctttactggtctatgatgtcactcgtcatgtcacatttgaaaatgtggagagatggctgaaggagcttcgcgatcacactgattcaaacattgttatcatgcttgttgggaacaaggcagatcttcgtcacttgcgagctgtttccactgaagatgccaaggctttcgctgagcgagagaataccttctttatggaaacatctgctcttgagtcttcgaatgttgaaaatgcattcacagaagtgctgacccagatttatcgtgttgtaagcaggaaggctctcgatgttggggaagacccagcagcattgcccaaaggccagacaatcaatgttggaaccaaagatgatgtatcggctgtaaaaaaggttggatgctgttcctcttgatcatggagaaaaaactctcacctatagtttaatgcatttttccctatctttcagtttgcaagacctgttcgtcatggggcttgggccgctagggcaagtcttaatccctgctggtatattgataattggaatatgttgggtattcttgcatgaatttgattataacaattatatgattgagcctatgagggaaagatgcatcatgattttggaaattagaacagcctcatttggtaacttttcaatctacggactc

SEQ ID NO: 3146 - DNA, 1222 bp, Papaver somniferum
ccctcgacctcgagaaacctttcaatgtcgacattcaggtaatgaagatcaaaattttcaaataaacgtcaaaacctagatttgttccttcataaaaaccttacatattccaatcgattatatcaccaaataaaaaagaagaaaaaatggctgcatatagagctgacgatgattatgattatctatttaaagttgtattgatcggtgattcgggtgttggtaaatccaatcttctgtctagatttactcgtaatgaatttagtcttgaatctaaatcaaccattggtgttgaatttgctacaagaagtattcgtgttgatgataaggttgttaaagctcagatttgggataccgctggtcaggaaaggtaccgtgcaatcactagtgcatactatcgtggtgccgtcggtgcactgcttgtctatgatgtcacacgtcatgttacctttgaaaatgttgagagatggttaaaggagctccgggatcacactgattcaaatattgtgatcatgcttgtgggaaacaaagcagatctgcgccacctacgagctgtttcaactgaggatgcaaccgcctttgctgagaaagaaaatacctgctttatggagacatctgcgttggaatctatgaatgtggaaaatgccttcactgaagtgctcacccagatctaccgtgttgtcagcaggaaagctcttgatattggggatgacccagcggcattgcccaagggacagacaatcaatgttggctccaaggacgatgtgtcagccgtgaagaaggttggatgttgctctgcttaatcttctttaagctcttgatcaattctttccacttcattctgtttagctagttccttgccgtttttcctttctttttgtccaccttcctgtattacttaaatactcaatgacccacatggttcagttatattatattgcttccaaggtagaaatgtatttagacaattcttcttcgttgtttgccctgtaaacacaatgacctagaatttcaatgcagcaactcttgtaatactgtagttgaaaattttgcaagaactgttttggccttttttggtctacatttatctgatgcagcatcgttcttatttgtattggtttatttactggtatgttcacgcaaaggtttcctactcatgtctatagtggaaatatagacattgtatagaagcttcaatttgatgaaatgtaacatttggttaccg

SEQ ID NO: 3147 - DNA, 1296 bp, Prunus mume
ccaaaagggaaaagggttaagaaatttgtttgggaccggagtctttaatcataaccacaattttgccaactaagaaaccccacaattccagcttgcttcctctcttcaacctccattttgctatttctctcgaaatcaaacaaaacccattcaccaccataactcacatacagacatagaccgccatgcttcttaatatttatacaacataattccaaaacccatttacccatcaatccaactcgtttgatttctctcagaaacaaagaaaaagacaaacacaataaaaaaaagaagacaaaaaaattcaccaggtaaaaactaaaatatattttctgtaaggagatgggggcgtacagagcagacgacgattatgattacttgttcaaggtggttttaatcggtgactcaggggtcggaaaatcgaaccttttgtccaggttcacgaggaacgagttcagccttgaatcaaagtccaccattggcgtcgagttcgctaccagaagcattcgggtagatgataaggtcgtcaaggcccagatttgggacaccgccggccaagaaaggtatcgtgcaatcacaagtgcgtactatcgaggtgccgttggtgctttactagtctatgatgttactcgtcatgttacatttgagaatgtggaaagatggctgaaggagctaagggatcatacagatgccaacattgtgatcatgctagtcggaaacaagggagatctgcgtcacctgcgagctgtttccaccgaggatgctaaggcttttgctgaacgagagaacacttttttcatggaaacgtctgccctcgagtcgatgaatgtcgacaatgctttcacagaagtgctgtcccagatctatcgtgttgtgagcaggaaggcccttgacattggggatgatccagcagccttgcccaaaggacagacgatcaacgttggaggcaaggatgatgtatcagctgtgaagaaagtaggatgctgctctgcttaaattttgaggaatggttcaagtggctttcaaggttctatcccgaggtcatgtctatacagaggttgacctgactcgacgaagttgctttctgaacagaacatgaactctttgaaacattatgctttggatactcgaaagcttgcctatgttagccaaaactttaggatgttaagaatatgttactgttgtttcctttgattcaatttgaaccacttgcttccccctgtgtattattatccttcctcggttgagttttatatgaagttcggttgtttgatctaaaattgagccaagtga

SEQ ID NO: 3148 - DNA, 1243 bp, Prunus mume
caacagtagaggctcataaagtcgctgtcttcccctttttcacacgctccctcacaagtcctccttcattccatgtctccgagtccgagtcgctcttccaattgatataaatcggcgacccatttcggatccgacccggcaatcagaccgaacccgcgagtcgaatttggagcggagagggaggaggcatggcctacagagcagatgacgactacgactacctgttcaaggtggtgctcataggcgactctggtgttggaaaatccaaccttttgtccaggttcacgcgcaacgagttcagcctcgagtctaagtctaccatcggcgtcgagttcgccactcggagcatccacgttgatgagaagatcgtcaaggcccagatttgggacaccgccggccaagaaaggtaccgtgcaattacaagtgcatactacagaggagctgttggtgctttgcttgtctatgacgtcacccggcatgttacatttgagaatgttgaaagatggttaaaggagctacgggatcatacagactccaatatcgtgataatgctcgtgggtaacaaggctgacctgcgtcacttgcgtgctgtttctgttgaggatgctaaggcctttgctgagagagagaacaccttctttatggagacatcagcactcgagtctatgaacgttgaaaatgcattcactgaggtcctaacacaaatataccatgtagttagccggaaagcacttgaggttggggatgatcctgcagcactacctaagggacaaaccataaatgttggaaacaaggatgatgtttcagctgttaagaaagctggttgctgttctgcctaatcaccagggcgacaggtcaaagctcaaatatgtcgtcttctcattttgctagtatcgggatttctacctggctactcatggaatttctcatgaactttttactgtatggtcatgtcttccagtgcttgagtttttctggggttggcttatagttttggattcaaaagaaatctcacagcttccatcttatgtcaatttcttgattatttacccctgctcttcccccgtaaaatttctttgtttctttatcttttgttgtacttggttgctctagtttaggaagaattttctggataattttgtttttgtatctgattgatgattagttaaatcttaaatgtatgatgaattagctccccttttatggcttgaataaattgctggtcgtgtacttggaaatacaa

SEQ ID NO: 3149 - DNA, 905 bp, Prunus persica
cctccttcattccatgtctccaagtccgagtcgctcttccaattgatataaatcggcgacccatttcggatccgacccggcaatcagaccgaacccgcgagtcgaatttggagcggagagggaggaggcatggcctacagagcagatgacgactacgactacctgttcaaggtggtgctcataggcgactctggtgttggaaaatccaaccttttgtccaggttcacgcgcaacgagttcagcctcgagtctaagtctaccatcggcgtcgagttcgccactcggagcatacacgttgatgagaagatcgtcaaggcccagatttgggacaccgccggccaagaaaggtaccgtgcaattacaagtgcatactaccgaggagctgttggtgctttgcttgtctatgacgtcacccggcatgttacgtttgagaatgttgaaagatggttaaaggagctacgggatcatacagactccaatatcgtgataatgctcgtgggtaacaaggctgacctgcgtcacctgcgtgctgtttctgttgaggatgctaaggccttcgctgagagagaaaacaccttctttatggagacatcagcacttgagtctatgaacgttgaaaatgcattcactgaggtcctaacacaaatataccatgtagttagccggaaagcacttgaggttggggatgatcctgcagcactacctaagggacaaaccataaatgttggaaacaaggatgatgtttcagctgttaagaaagctggttgctgttctgcctaatcaccagggcgacaggtcaaagctcaaatatgtcgtcttctgattttgctgcccccaaagtatcgggatttcttcctggctactcatggaatttctcatgaactttttactgtatggtcatgtct

SEQ ID NO: 3150 - DNA, 993 bp, Solanum phureja
ccaaaaaaaaatcctttctgaaaaaatgggggcatacagagccgacgacgattatgattacttgttcaaggtggtgttgatcggtgattccggtgtaggaaaatctaatcttctctctagattcagtcgtaatgagttcagccttgagtctaagtccaccatcggtgttgagttcgctactcgaagcattcatgttgaggataaggttgttaaagctcagatttgggataccgctggtcaggaacgatatcgagcaatcacaagtgcttactatcgaggagctgttggtgcattgctggtttatgatgtcactcgtcatgtgactttcgagaatgttgagagatggttgaaggagctcagagatcatactgactcgaacattgtcataatgcttgtgggaaataaggccgatttgcgtcacttgcgggctgtttccactgaggatgccaaggcatttgctgagaaggagagtacttttttcatggaaacatctgctctggaatccatgaatgtggaaaacgccttcacagaagtgctcacacaaatataccgtgtcgtgagcaagaaagctcttgaagcaggagatgacccagcagcattacccaagggacagaccattaatgtcggaagcaaggatgacgtttcagcagtaaagaaagttgggtgctgttcttcttaaaacaaggactgatatgttctattccaactttttgagttcaaattttcatgtggcagtggtaattctcctattctgtacaatgaattgaccacatgaatctttacagatgctcaagtttgaatttgagctctcccttgagttcctcagcattctttatccttgtttctatatttatcttagcttagtgtatgattgtagtatagcttcttatgaatctcttggatagagtgaattttgattgcaaagattgaactgagacatgtttgaacagatgctgtcccactagatttatcaaaatcaatcatatgttattt

SEQ ID NO: 3151 - DNA, 1065 bp, Thalictrum flavum
atgtcgacatgtgcagagaactgaacagatcgaataaaaaccgcgtatttcaatctactcaactcattgaaaaaacttcaaatcgagactttgaaatggcggcatatagagctgatgatgattacgattatttgttcaaagtcgtattgatcggagattcaggtgtcggtaaatcgaatcttctttctagatttacaagaaatgagtttagtcttgattctaaatccactattggtgttgaatttgctactagaagcgttcatgttgatgataaggttgttaaagctcagatttgggatactgctggtcaagaaagatatcgtgcaatcacaagtgcatactatcgaggagctgttggtgcactgcttgtgtatgacgttactcgtcatgtaacattcgagaatgtggagagatggttaaaggaacttcgggaccacactgatgccaacattgtaatcatgcttgtggggaacaaggctgatctacgccatctgcgtgctgtgtccaccgaggatgcaaaagcctttgctgagagagagaataccttctttatggagacatctgctctggagtccttgaatgtcgaaaatgctttcacagaagtgctcacccagatctatcgcgttgtaagtaggaaggctcttgatattggagatgatcctgctgccttgccgaagggacaaacaatcaatgtgggcaaggatgatgtatcggctgtgaaaaaagttggatgctgctctacctaaggatatcaaggcgatctcaaggatttcttctcttgtataggattccttgttctctgtgtgttggtgcctattccgttggcacttaaccacttcaccgatggaatttttttcctttactaaatgcacggttgccgcatcatgagatccatgggattttaaatgtcttttgttaccccgaggtgtagacatagtgatatgctgtggttgaatccgttgcagacttatttccgtttgcttaggtttgaactttcattactggatgtatttagtttaagatttagaggggccagcgtttcattatatttggttgctttgaaac

SEQ ID NO: 3152 - DNA, 1135 bp, Solanum lycopersicum
gtattttgaatttgtagagaagaggaaagtcagagacttaaggaggggtttaagaaaaagtatagttaaattttttttttgaatacatctctctccctctctctttttaaaaaagcaaaacggtgcctctttcagatctcactttgtgccctccacatctgagaaaatgggggcatacagagccgacgacgattacgattacttgttcaaggtggtgttgattggtgattccggtgtcggaaagtctaatcttctttctagattcagtcgtaatgagttcagccttgagtctaagtctactatcggtgttgagttcgctactcgaagcattcatgttgaggataaggttgttaaagctcagatttgggatactgctggtcaggaacgatatcgagcaatcacgagtgcttactatcgaggagctgttggtgcattgctggtttatgatgtcactcgtcatgtgacttttgagaatgtggagagatggttgaaggagctcagagatcatactgactcaaacattgtcataatgcttgtgggaaataaggcagatttgcgtcacttacgagctgtttccactgaggatgccaaggcatttgctgagaaggaaagtacatttttcatggaaacatctgctctggaatccatgaatgtggaaaacgccttcacagaagtgctcacacaaatataccgtgtcgtgagcaagaaagctcttgaagcaggagatgacccagcagcattgcccaagggacagaccattaatgtcggaagcaaggacgacgtttcagcagtaaagaaagttgggtgctgttcttcttaaaacaaggactgatgttctattccaacttttgagttgaaattttcatgtggcagtggtaattctcctattctgtataatgaattcaccacatgaatcgtttactggtgctcaagtttggatttgagcttccccttgagttcctcagcattcttttatccttgtttctatatttatcttagcttagtgtatgaatgtagtatagcttcttatgaatctcttggatggggtgaattttgattgcaaagattgaactgagacgtgtttgaacagatgatgtcccactagatttatcaaaatcaatcatatgtttttcat

SEQ ID NO: 3153 - DNA, 896 bp, Tripterygium wilfordii
gggtgagaaacggaaggaaatgggggcatacagggcagatgatgactacgactacttgttcaaggtggtgttgataggggattcgggtgttgggaaatctaatctgttgtctcgattcacgaggaacgagttcagcctcgaatctaaatccaccatcggagtcgaattcgccacccgcagcatccacgtcgacgacaaggtcgtcaaggctcagatttgggacaccgccggccaagaacgataccgtgcgattaccagtgcttactatcgaggagcagtgggtgcattgctcgtctatgatgttactcgacatgtcacatttgagaatgtggagagatggttgaaggagctgcgggatcacactgatgccaacattgtgatcatgcttgttggaaacaaggctgacttacgccatttgcgcgcagtttccactgatgatgccaagggttttgctgagagggaaaacacctttttcatggaaacctctgcacttgagtcattgaatgttgagaatgccttcactgaagtccttactcagatttatcgcgtggttagccggaaagctcttgacatcggtgatgatcctgcagccctacccaagggacaaactattaacgttggcactaaagatgatgtatcagctgtgaagaaagttggatgctgttcggcatagttccctggaactagtagttttccaatcttagtttaatggggttttgtcagatttattgtttcacccaataggctttcccacatttagggcaacttatttgttacatttttttcctccctttttctggtttctggtttgtcttgcttttattgtattcttcagcactatatctggttctatgttgaaaatggtgttctctcctccttgattaatctgactagta

SEQ ID NO: 3154 - DNA, 1448 bp, Triticum aestivum
acagcgcggcgcgcacccgtcctctttctattttctgtcgcctcgctccccacaacgttctccccacctctcttccccccgggcctctcatatacgccaccgcgcgcgccccgctccgctcctcctctcccttcccttcccttcctcgacgaccgccccaggaagcgcctccccgcccgcctccgccaggaaggaagggggccgtcgtcgggtcgggtcgggtcggccatggcctacagggcggaggacgactacgactacctcttcaaggtcgtgctcatcggcgactccggcgtcggcaagtccaacctgctctcccgcttcacccgcaacgagttcagcctcgagtccaagtccaccatcggggtcgagttcgccacccgcagcctccaggtcgacggcaaggtcgtcaaggcccagatttgggacacggcagggcaggagaggtatcgggcaattacaagtgcatactatcgaggggctgttggtgcgcttgtcgtgtacgatgtgacacgccatgtgacctttgagaatgtggagaggtggttgaaggagctccgggatcacacagatgcaaatatcgtcatcatgcttgtcggcaacaaagctgatctacgccaccttagggctgtatcagtggacgatgccaaggccttcgctgagagggaaagcaccttctttatggaaacatctgcactggaggccatgaacgttgagactgccttcactgaggttctgactcagatctatcgtgtagtcagcaagaaggccctcgacataggcgatgaccctgctgctccaccgagaggacaaaccatcaacgttggtggcaaggatgatgtctctgctgtgaaaaaggcagggtgctgttcatcctaaattcgttttgcttgtgaagagggaccatatgctcacctgattatatgggtaactgcaaatatgacatcctttttgcctcctaacctggttgtttgtgagattataccggtgcaccaagaatttcgtttagatatcaagatttaaccccaggttgataaggggggccatgctaactttggaatgtcagtgattttgtggttgccttttatggtttctttgctgctgtattgtcccacctcaattgacacaagaatcctctcaacatttcactgcgcagcctaacctgataaaggttgtaatgggagctatggttcattacttctcttggctttcctgctgaatggatgtgtactatgtagccctcagagattatactgtatcttctgtatcacaataggttatgtctacttggtaaatgtcatctgtaactggtagccagttttacactgttatattgtgtatcttccttcccagatgtacagaatttgcattgaagatccatgcttcttatcaccctatgttttcatatgctaccattttatgcctgtagtattcactatgctgctgtt

SEQ ID NO: 3155 - DNA, 1002 bp, Actinidia deliciosa
ctctctctctctctccccctctctctctaaacattgagatctgtgtgccagcaaatctgcatatagatcgaaacaacaatccttctctctatatctatctatctatacatatctatataattgaaggtaaatgggagggtacagagcagatgacgattacgattacttgttcaaagtggtcctgatcggcgactcaggggtcggaaaatcgaatttgctctccagattcaccaagaacgagttcagcctcgagtctaagtccacaatcggcgtcgagttcgccactcgcagcattcacgtcgacgacaaggtcgtcaaggcccagatttgggacaccgctggccaagagcgatatcgtgcaatcacaagtgcatactatcgaggagctgtaggcgcattgcttgtttatgacgtcactagacacgtcacatttgagaatgtagagagatggttaaaagagcttcggggtcacacagattcgaacattgtgatcatgctcgttggaaacaaggcagatttgcgtcacttgagggctgtgtccactgaggatgccaaggcatttgctgaaagcgagagcaccttcttcatggagacctccgctttagagtccatgaacgtggaaaatgccttcaccgaagttcttactcaaatatatcatgtggtgagtaggaaagctctggacattggggatgacccagcggctttgcccaagggacaaaccatcaatgttggtggcaaggacgatgtatcggctgtgaaaaacgttgggtgctgctcagcatagcctaaaaggaacgaaaaatacttaaagctatctcttctcatcttccccaaaggagttccgaaattctaaatccttgtcaaacacaattggaatatgtcaatgcccatggagtgctgagaaggaaaattttcagttttatggaatattctgatgcatcgctctgaacatcctaaagcttttaactgaatttccaagggtgtaaggattcaactcatttc

SEQ ID NO: 3156 - DNA, 925 bp, Arabidopsis thaliana
gaaatttgaaactctctcttctttttttgttcttcttctcattggttgatcgatacgcgctaaatttctagaaatctcagatccataaaattttccgaggagagattctctaatcagagaacctcacaatggccgcatatagagccgacgacgagtacgattacctcttcaaagttgtgttaattggagactccggcgttggaaaatccaacctcctttctcgattcacgcgcaacgagttcagtctcgaatctaaatccacgatcggtgtagaattcgccactcgtagcatccatgtcgatgataagatcgtcaaagctcagatttgggataccgctggccaagaaagatatcgagcaatcacaagtgcatattacagaggagctgtaggagcgttgcttgtgtacgatgtcacaagacatgtgacgtttgagaacgttgaaagatggttaaaggagcttcgagatcatacagatgccaatatcgtcatcatgttcgttgggaacaaagcggatctccgtcacctacgagctgtttcgactgaagacgctaaggctttcgctgagagagagaacactttcttcatggagacatcagctctcgaatcgatgaacgtcgagaatgctttcactgaagtactttctcagatttaccgtgtggttagccggaaagcgttggatataggagacgacccggctgctcttcccaaaggacagaccatcaatgtcggatcgaaagacgatgtctctgcggtgaaaaaggttggttgctgctcaaattgatggtacgttcgactttcaagaatcggtctcacggtcgatcttgttcatttcttttttgttgttatatgtgaagatcttgttcatttatttgtataatcacacaccttaaaccatattgaataccactgcgtttccatatcaaa

SEQ ID NO: 3157 - DNA, 1195 bp, Lupinus angustifolius
aaaaaggttacctttttttaacattcttctgaatctggatcacaattttgaatacccaatcaaaacaaaaacggctcttttctttcattcataccaatccctttgatcctcttccacattcatcaaatcaaaatcacttttttttttgttatcaacatcacttttttattctccccaattttccctctggccaaaacacaaacacccacatagaaaataagagcaaaaaagtgtttgtatcaaatgggggcttatagagccgatgatgattacgattacctgtttaaggtggttctgattggtgactctggtgttggaaaatccaatcttctttcgaggttcaccaagaatgagttcagcctcgaatcgaagtccaccattggggttgagtttgctaccagaagcatcagggttgatgataaggttgtcaaggctcagatttgggacactgctggtcaagaaaggtaccgagcaattacaagtgcatattatcgaggagctgttggtgctttactagtctatgatgttacccgccatgttacatttgaaaatgtggagagatggctaaaggagctgagagatcatacagatgccaacattgtggtgatgcttgtaggaaacaaagcagatctgcgtcatttgcgagcagtttccaccgaagatgctacagcttttgctgaacgagaaaacacattttttatggaaacatctgcccttgagtccatgaacgttgaaaatgccttcacagaagtgctgacccagatctatcgcgttgtaagcaagaaggcccttgacattggcgatgatccagcagctttaccaaaaggacagacaattaatgttggatcccgtgatgatgtatcagctgtgaaaaaagctggatgttgttctgcttgaccatgtagtaaagtctctgttttgaactttaaagtctatgccttgtttataaccatgtagagatggcatggcagcatgaaaatgatcgtctagagagcatcaaactataatgtttctgctttggtctgtaaagatttatgttctatattagacaaatgtttaggaaactatcagtttattttgcttaactcctattattgtgtggattttaagatgttcaattatgtaattctgatttatcaacttggttatgtccttactccttagtattaaccatactcctatttgttcttatcta

SEQ ID NO: 3158 - DNA, 1186 bp, Tropaeolum majus
gttgttttccgtaaaccaaacgcgttttttcattgtgattttgattaatttgtttgtgttgaaaacaacagttttttttttttctgtttcagatcctctccatttctcgttaatccgagaaacgaagtagagtattcaaaagagaaagggaggattgatttggattattattattattttcgttttgttgatataccagtgattttccaaagattatgggtgcctacagagcagatgacgactacgattacttgttcaaggtggtgttgatcggcgactctggagtcgggaaatcgaatctgttgtccagatttacgaagaacgagttcagcctggagtctaaatctaccattggcgttgagttcgctactcggagcattcatgtcgatgataaggttgtcaaggctcagatttgggacaccgcagggcaagaaaggtatcgagctatcacgagcgcgtactatcgtggcgccgttggtgctttactagtctatgacgtgacgcgacacgttacatttgaaaacgtggagagatggctgaaggagcttcgagaccacaccgacgccaacattgtcataatgctcgtcggaaacaaggctgatctgcgtcaccttcgagccgtttccactgaagactcaacagcttttgcagaacgagagaatactttcttcatggaaacttctgcactcgagtcattgaacgtcgagaatgcattcactgaagtgctgacccagatctatcgcgtagtaagcaagaaagccctcgacatcagtgaggatccagcagctctacccaaagggcagacgatcaatgttggaggtaaagatgatgtatcagctatgaagaaagctggatgttgctcttcttgagctcctacgagaaaaaaggctacagaagtagaacactacgccttgttctcaaacgtgtagaacgcggacaagacgatatgatactcgagaaaacttgatctacatagcattcatacattcatactttagattttgaaagatgtttcaggaggtttttttttattctctttattcacttttgacatttggcctatatttcgtttttttaaagtaaattctacagatttaccacatccttgttgtttttgtgccatatatatgtgctagacacacgttttgtaattcgaatttgacctatttttaatcggtctgtttcg

SEQ ID NO: 3159 - DNA, 1035 bp, Glycine max
tttcaatttcaaatcccccaacaaagcatgcttcttttcttcttcaattgacgccaacccatttgagtttttctctctcctttctctcttccctaattttttcaacaacaaaaaaaaatgggggcgtacagagccgacgacgattacgattacttgttcaaggttgttctgatcggcgactccggcgttggcaaatcgaaccttctttctcggttcacacgaaacgaattcagccttgaatccaagtccaccattggcgttgagttcgccaccagaagcattcgcgtcgatgataaggtcgtcaaggcgcagatttgggacactgctggtcaagaacggtaccgagctattacaagtgcatattatcgaggagctgttggtgctttactagtttatgatgttacacgtcatgttacttttgaaaatgtggagagatggctaaaagagctgagagatcacacagatgccaacattgtggtgatgcttgtagggaacaaagcagacctgcgtcatctgcgtgcagtttccaccgaagatgctagaactttcgctgagcgagagaacacatttttcatggaaacatctgccctcgagtccttgaatgttgaaaatgccttcacagaagtgctgacccagatctatcatgttgtaagcaagaaggcccttgagattggagacgatccagcagctttgccaaaaggacagacaattaatgttgggtcccgtgatgatgtatcagctgtgaagaaatctggatgttgttctgcttgagtgtgtagtagaaaacagtctctgtatttttactttaaattatatgccttgtttataccatgtagagattggccgcctcacagcatgaagatgattgattatttagagcatcaaactttctgctttgatttgtagagaattatgttcaaaattagtcaaatgtttaggaaacaagcacattcattttgcattattcctatttttgagccattttaagatatttatttatctaatttccaatttatcagtttggttcttttataa

SEQ ID NO: 3160 - DNA, 1200 bp, Fragaria vesca
acccacatttccatatcttggttgctgtcttcaacctccattttgctatttctctctcaaaatctaacaaaacccattcaccatcatcaccccatttcaaaacccacatgcccaaactggttattctgtccccaaatttgagaacccattaaccaaaacagagcacccagtttgtgttttgtgtcagaagaaacagagaaagacagagacttttgagaacccattttataggaattgcccaatgggagcgtacagagctgatgatgattatgattacttgttcaaggtggtgttgatcggcgactctggggttggcaaatcgaacctgttgtccaggttcaccaggaatgagttcagccttgaatcaaagtccaccattggggttgagtttgccaccagaagcattagggtcgatgataaggtggttaaggcccagatttgggacactgctggtcaggaaaggtatcgtgcaatcacaagtgcatattatcgaggtgctgttggtgcattactagtctatgatgttactcgtcatgttacatttgaaaatgtggaaagatggttgaaggagcttcgggaccatacagatgccaacattgtgatcatgttggtgggaaacaagggtgatctgcgtcacctgcgagccgtttccactgaggatgcccaggcttttgctgaacgagagaatacctttttcatggaaacatctgcccttgagtccatgaatgttgacaatgctttcacagaagtgctgagccagatctaccgtgttgtaagcaggaaggccctagacattggggatgatccagcagccttgcccaaaggacagacgatcaatgttggtggcaaggatgatgtatcagccgtcaagaaagtcggatgttgctccaattaatcatggagggaacactccaaagtacctcccagacttccatccccaatatcatgtctatacagaagctgacccaacaacatgaaattgctttgtcaagaggataaattttgagtctgaacattatgtttggatacttgaggttacttgaaatcttgtcttctctatgttagccaacatgtaggtttttaaaaatctgttgtgttctttcctttgattcaatttgaactccttgcttccccttgtgtattacaacattatcctttcttagttgagttttatataaaatttggttggtttgagctgaa

SEQ ID NO: 3161 - DNA, 969 bp, Tabernaemontana elegans
ctgcattatctctaatgggggcatatagagcagatgatgattacgattacttattcaaggtggtgttgatcggtgattctggggtcggaaagtcgaatttgctttcaagatttacgcgcaatgagtttagtctggagtctaagtctaccatcggagtcgaattcgccacccgtagcatccgtgttgatgataaagttgttaaggctcagatttgggacactgctggccaggagagataccgtgcaataacaagtgcgtattatcgtggtgctgttggtgcattgcttgtctatgacgtcactcgacatgttacatttgaaaatgtcgagagatggttaaaggagcttcgggaccacactgattcaaacattgttattatgttggttggaaataaggcggatcttcgtcacttacgagctgtttccaccgaggatgccaaggcatttgctgaaagagaaaacgccttttttatggagacatctgctttggaatctatgaatgtggaaaatgccttcacagaagtccttacacagatatatcgtgttgtcagcaggaaagctctcgatgttggagatgatccggcagcactgccaaaaggacagacgataaatgttggcactaaggatgatgtttcagcagtgaagaaggttggatgctgctctgcttagacaggtaaatataggctgaggaaaacaaattctttctatttcagtacttattcccatgtggctgcggagtttgtcctttctgagtcttggactacgtggatctttagattattatggaatttacttcgttggcatcttatgtaagaaatagccaacggttatccaagtatgggtgataccttcagtagccagtgtcgaaaaaatgatttcacgattctttgtcctcatttcatctttttggttttcctcaatgtactattaggatgtaacaaagttagaaatccattagatttgattgtat

SEQ ID NO: 3162 - DNA, 1079 bp, Valeriana officinalis
attattatctctctaaaaataaaaatactagggagtattatgttgtgttgagatccgtacggtaaaagacagatcggaaatctgtctagtttcgatctgcacctggactcgtcggatctctacaatttcctaacttaaatgggggcctatagagctgatgatgattatgattatttgtttaaagtcgtcctgattggcgattctggtgtcggaaaatcaaatcttctatctagattcaccaaaaacgagttcagccttgaatccaaatccacaattggcgtcgaattcgctactcgtagcattcgcgtcgacgacaaagttgtcaaggctcagatttgggataccgccggacaagagagatatcgcgcaatcacaagcgcttactaccgaggagcggtcggcgctctactggtgtacgatgtaacacggcacgtgacattcgagaacgtagagagatggctaaaagagctgcgagaccacacagattccaacatcgtaatcatgctcgtgggaaacaaagccgatctgcgccacttgcgcgccgtatctgtagaagacgccaaagcctttgctgaaagagagagcaccttcttcatggaaacttcagctctcgagtcaatgaacgtcgagaattccttcaccgaagttctgacacaaatctatcacgttgtcagcaaaaaggccctcgatatcggcgatgatccggccgccttgcccaaaggacagacgatcaatgttggcaacaaggatgatgtttccgaggttaaaaagggaggttgctgctcatcttaaacaatttgtttcgagaatcatggagatgttctgtaggtagattctatttaattgccttaggatccctttttcttttctgaggaaaaaaagaagaatgatttggtaggtggtgttttattgaaagagaaaaaaagaagaatgtatgaaggtggttttgttattgtattcctcctactttggttgattagttcttgtgactaccaagccaaggagttcatcaatttatctgcgtatttatttattcaaatattgttttatttggactactactactatttccggtgtct

SEQ ID NO: 3163 - DNA, 998 bp, Euonymus alatus
tccgcaatcggcttccagaaacgcgtctctctttgtttttgaatctgtgtttctatctgttgagaatctataaacaatctcagtgaaggcacagtaattcaaaaaacaaaatttaacaatgggagcgtacagagccgacgacgattacgattacttgttcaaggtggtgctgatcggggactccggcgttggtaaatcgaatctcttgtctcggtttacgcggaacgagttcagcctcgaatccaaatccaccattggcgtcgagtttgccactcgcagcattcacgtcgacgataaggtcgttaaggcccagatttgggataccgctggccaggaaagataccgtgctattacaagtgcatattatcggggcgctgttggtgctttactggtctatgatgtcactcgtcatgtcacatttgaaaatgtggagagatggctgaaggagcttcgcgatcacactgattcaaacattgttatcatgcttgttgggaacaaggcagatcttcgtcacttgtgagttgtttccactgaagatgccaaggctttcgctgagcgagagaataccttctttatggaaacatctgctcttgagtcttcgaatgttgaaaatgcattcacagaagtgctgacccagatttatcgtgttgtaagcaggaaggctctcgatgttggggaagacccagcagcattgcccaaagggcagacaatcaatgttggaaccaaagatgatgtatcggctgtaaagaaggttggatgctgttcctcttgatcatggagaaaaaactctcacctatagtttaatgtatttttcgactatctttcagtttgcaagatctgttcgtcatggggcttgggccgctagggcaagtcttaatccctgctggtatattgataattggaatatgttgggtattcttgcatgaatttgattataacaattatatgattgagcctatgagggaaagtggcatcatgattttggaaattagaacagc

SEQ ID NO: 3164 - DNA, 1387 bp, Malus domestica
atcagcagcagaaaatctcaaatttgccgtccttccgttttcacacaatcctccctcccttcgttccatgcctccgagtccgagtcgctcttccaattgaataaatccggcgacccaattcggatccgacccggaaaccagaacccaaccaaacccaaccgccgagtcgaatttggatttgtgagggaggagggcagccatggcgtacagggctgatgatgactatgattatctgttcaaggtggtgttgattggcgactccggcgtcggaaaatccaaccttttgtcgagattcacgcgcaacgagttcagcctcgagtcgaagtcgacgatcggcgtcgagttcgccactcggagtatccacgttgatgagaagatcgtcaaggcccagatttgggataccgctggccaagaaaggtaccgtgcaattacaagtgcatactaccgaggagctgttggcgctttgcttgtctatgacgtcacccggcatgtgacatttgagaatgttgagagatggttgaaggagctacgggatcacacagactccaacattgtgataatgctcgtgggtaacaaagctgacctgcgtcacctgcgtgctgtttctgttgaggatgctaaggcttttgctgagagagaaaacaccttctttatggagacatcagcactcgagtctatgaacgttgaaaatgctttcactgaagtcctaacacagatataccatgtagtctgccggaaagcactagaggtcggagatgatcctgcagcattgcccaagggacagaccataaatgtcggaaacaaggatgacgtttctgctgttaagaaagatagttgctgttctgcctaatcgtgagagcgataggtcaagctgaagggtcttctcattttgctgcccctggagtttcaagatttgtacctgtcaacacaaggaatttgtctttaagtttttactgtatggtattgcttgagttttttggggttggcttttagttttggagtcaaagaaatgtcacagcttccgtcttatgtcaatttcttgattatttacctacggccctctctctcttaaaatctcgttcatcttttgttgttactttcgtttgctctagtttaggaacagtttctggataattttttttgtatcggatggatgattagttgaatgtatgatgatttagcttcttcccttttatggctcaaataagtacattgccagtcgaaaaggttttacaccatgacacgaggcggttttaaggactccgagacattattcgagttacgggaccaaagtatacctagcggacacttttagcgaccatagttacaattaagtcaaaatcttttatgccatttttagaaaacattaacgaaaagttttgggtac

SEQ ID NO: 3165 - DNA, 996 bp, Solanum tuberosum
catacagagccgacgacgattatgattacttgttcaaggtggtgttgatcggtgattccggtgtcggaaaatctaatcttctctctagattcagtcgtaatgagttcagccttgagtctaagtccaccatcggcgttgagttcgctactcgaagcattcatgttgaggataaggttgttaaagctcagatttgggataccgctggtcaggaacgatatcgagcaatcacgagtgcttactatcgaggagctgttggtgcattgctggtttatgatgtcactcgtcatgtgactttcgagaatgtggagagatggttgaaggagctcagagatcatactgactcaaacattgtcataatgcttgtgggaaataaggcagatttgcgtcacttgcgggctgtttccactgaggatgccaaggcatttgctgagaaggagagtacttttttcatggaaacatctgctctggaatccatgaatgtggaaaatgccttcacagaagtgctcacacaaatataccgtgtcgtgagcaagaaagcccttgaagcaggagatgacccagcagcattgcccaagggacaggccattaatgtcggaagcaaagatgacgtttcagcagtaaagaaagttgggtgctgttcttcttaaaacgaggactgatctggatgttggaagatgttctattccaacttttgagttcaaattttcatgtggcagtggtaattctcctattctgtacaatgaattgaccacatgaatcgttagccgtgagcgctctagtttacagatgctcaagtttgaatttgagctctcccttgagttcctcagcattctttatccttgtttctatatttatcttagcttagtgtatgattgtagtatagctttttatgaatctcttggatagagtgaattttgattgcaaagattgaactgagacatgtttgaacagatgctgtcccactagatttatcaaaatcaatcatatgttttcttt

SEQ ID NO: 3166 - DNA, 1324 bp, Eucalyptus grandis
aaggtttcaattttctctctctctctctctctctctctagcttcgagcatcgcgatttgattcagtcgaagctgaaaatctgacaaaatcctctccccgcggccgtttccgttcttgagcttcgatccgcagggaaggggagctccgagcaatggccggcggctacagggcggacgacgactacgactacttgttcaaggtggtgctgatcggcgactccggcgtcggcaaatccaacctcctgtccagattcacgcggaacgagttcagcctggagtccaagtccaccatcggggtcgagttcgccaccaggagcatccgcgtcgacgacaaggtcgtcaaggcccagatttgggacaccgccggccaagagagatatcgtgcaatcacaagtgcctattacagaggagcagttggtgcattgcttgtttatgacgttacgagacatgtcacttttgagaatgtcgaaagatggttgaaggagctgcgggaccacacagactctaatatcgtgataatgctggtaggaaacaaagcagatctgaggcacttgcgtgccgtgtctacggaggatgccaaggcctttgcagaaagagagaacacttacttcatggagacttccgctcttgaatctatgaatgtagagaattcattcaccgaagtgctcacacaaatataccacgtggtgagtcgaaaagcacttgatgttggggaagatccggcagcacctcccaagggacaaactatcagtgtcggttcaaaggatgatgtttccgctgtcaagaaagtgggctgttgctccgcttgaagttaagagtaacagaatgaagattttgggggaagtctttattcaatcctaatctgctgcccggagaattggaagatgttacgcgggaattgcagaccttctttacaacctgtcaccatcatctccatgcatggcgatgcttaagcttttgccggatcaatttaagtttgaagtccaaggaaaccggatgttagggcttcgtgtatttcatttgtttcagttccagatgcttaattttctattcccatcccgtgttgatttgtttgttgggttctctaggtttttgagctgaattggtcatgtcacacagggaactgtcttcgggcgagtttaatcatgtatctgatttacgatcggtgttgtgaacgtcggatcctgagaagatacagggaaactttacttttgaatgatgggaactgtgcgagaccggtgtcactccatacccttaagatgttcatactctattcagtaatactgtgcctgcgatcttgtttgtgtgatgtcgccccagaggaa

SEQ ID NO: 3167 - DNA, 750 bp, Cyclamen graecum
ctctctctctccctcagatctcgccgagatctgtctctcccccaaacacaagcacagatccaaaccctaacacgcactgaaacacacagtaatgggtgcttacagagccgacgacgactacgactacctcttcaaggtggtgctcatcggcgattccggcgtcggaaaatccaacctcctctccagattcacccgcaacgagttcagcctcgagtctaagtccaccatcggcgtcgaattcgccaccaggagcattcacgtcgacgataaggtcgtcaaggcccagatttgggacaccgctggtcaggagagatatcgggcaatcacgagcgcatattaccgaggagcagtaggtgcattgcttgtttatgatgttactcgacatgttacattcgagaatgttgagagatggttaaaggagctccgtgatcacactgattcgaacatcgtaatcatgcttgttggaaataaggcagatctacgtcatttgcgtgcggtctcaactgaagatgccaagtcttttgcggagagagagaatacctttttcatggagacgtctgctctggagtctttgaatgtcgaaaatgccttcactgaagttcttactcaaatacaccgtgttgtgagcaggaaggctctagaggttggtgatgaccctgcagctttgcccaagggtcaaactattaatgtcggtggcaaagatgacgtgtctgctctgaagaaggcgggatgctgctcttcatagtgagc

SEQ ID NO: 3168 - DNA, 1162 bp, Avena sativa
gggcggaggacgactacgactacctcttcaaggtcgtgctcatcggggactccggggtcggcaaatccaacctgctctcccgcttcacccgcaacgagttcagcctcgagtccaagtccaccatcggggtcgagttcgccaccaggagcatcagggtcgacgacaaggtcgtcaaggcgcagatctgggacaccgcgggacaggagagatatcgggcaattacaagtgcgtactatcgaggggctgttggtgcgcttgtcgtgtatgatgtgacacgccacgtgacctttgagaatgtggagaggtggttgaaggagcttcgggatcacacagatgcaaacattgtcatcatgcttgttggcaacaaggctgatctacgccaccttagggccgtatcagtggaggatgccaaggccttcgctgagagagaaagcatcttctttatggaaacatctgcgttagaggccatgaacgttgagaatgccttcaatgaggttctaactcagatctatcgtgtggtcagcaagaaggccctcgacataggtgatgaccctgctgctccaccaagaggacaaaccatcaatgttggtggcaaggatgatgtctctgctgtgaagaaggcagggtgctgttcatcataaattcattttgctcatgaagagggaccatatgctcacctgattagacgatgggtaactgcaaatatgacttcctttttgccaccttgcctggttgtttgtgagattacattggtgcaccaagaaattcatttagatgtcaagatttaaccccaggctgggaagggaagaaaatgctaattttggaatgtcagagattttatggttgccttctatggtttaaccgctgtatggtcccacctcaattgacacgtgaatcctcccaacatttcactacgcagcttaacctggtaaaggttgtaatgtgagctatgcttcattagtcctcttcttggttttcctgctgattggatgtgtactatatagccctcagagatggtactgtatcttctgtatcacagtaggtctacttggtaaatgtcatctgtaactggtagccagtatgagttttacacagttatactgttatattgtgtatttaatccagatgtacagaatttgcattaaagatcaatgtttctcat

SEQ ID NO: 3169 - DNA, 762 bp, Ananas comosus
gatggcgtatagggcggacgacgactacgactacctcttcaaggtggttctgatcggggactcgggcgtggggaaatcgaacctcctctcccgcttcacgcgcaacgagtttagcctcgagtcgaaatccaccatcggcgtcgagttcgccacgaggagcatccatgtcgacgacaaggtcgtcaaggcccagatttgggacaccgcgggacaagagagataccgagcagtcacgagcgcatactaccgaggggctgtgggtgccctagtagtctatgatgtaacccgccacattacattcgagaatgtggagaggtggctgaaggagttacgggaccacacagatgccaacatcgtgatcatgctggtgggcaacaaggcggacctgcgccatttacgggccgtgtccaccgaggacgccaaggcctttgccgagaaagagaacaccttcttcatggaaacttccgccctggaagcgttgaacgtggaggctgccttcaccgaggtgctcacgcagatctaccgcgtggccagcaggaaggccctggacatcagcggcgacccatcagctccaccgcgggggcagaccatcaacgtggggtccaaggatgatgtatcggccgtgaagaaggtcggctgctgctcagcttagataccctgaatgtgtttttacagtctatggcattgttattactgatggatatggcttacaaaaacccttttttcggaatgcattgaggagcttaagacgcactgaaatat

SEQ ID NO: 3170 - DNA, 1531 bp, Ricinus communis
agtgaaagccctaatctgagtgggacgttaaacaacacaaatggcattaaaactttgaaaaataatatgtaacttaccatttacacaagtgttttactttctctgtctctctctatatctctctcctgcaaatctaagctcttgtttctatgcaaatcacaagcggcgcccactatctctctctctatatatcgaaaagtaaacaatgtcgccatttttaaattcaaataacaccaccaccaccaacagcaccaacaacaacatttcctggtagatttcttagatatagatagactcatttcaacttcctcatcgaatatttcaagaaacgaagaccaacccatttcattttgatcttcatttcacaaaacccacattttcagatttttcaaaatattatagaaatcaagacttacccatttcattttgatctccattttcaaaactccatattaaaaagagcgactttagctcaaaaatgggggcttatagagcagatgatgattatgattacttgtttaaggttgttttaataggtgattctggtgttgggaaatcaaatctgttgtctagattcacaaggaatgaattcagcttggaatccaaatccaccattggtgttgaatttgctactcgtagtatccatgttgatgacaaggttgttaaggcccagatttgggacactgctggtcaggaaagatatcgtgcaatcactagtgcatactacagaggagctgttggtgccttgcttgtctatgatgtcactagacatgttacctttgagaacgtggaaagatggttgaaggagcttcgagatcacactgattccaacattgttattatgcttgtgggaaacaaggcagatttgcgtcacttacgtgcagttacaactgaggatgccaaggcatttgctgagagagagagcaccttctttatggaaacctctgcgctagaatccttgaatgtcgaaaatgcctttactgaagtgctaactcagatctatcgtgttgtcagccggaaggctcttgatgtaggggatgaccctgcagccttgcctaagggacagactattaatgttggcaaagatgatgtatcagctgtgaaaaaagttggatgctgctcagcatagtcagaataaatgaagtcttagtggtagtatattctcctgctaaagattgtgcacttcagtgatttgaagatgcctttgtttctctcagatatgtccaaaagaggccacgtttgatagcatgctttagagagtagtaacttgtataagttgagagacggcttaagcgttcagatctgagagactatctcattttgttggcattccgtgtttcattttcttgttattcttttggctgcttcttttcttggagtgttgttgtaatctgtactagccagatccaaccctctaggttagattatacttattgcttggatttgggaattatgttaagacaatggtgtttttacttgattgattaattaatttattagcttgttggggtttatagttgcattcgaacat

SEQ ID NO: 3171 - DNA, 1416 bp, Ricinus communis
ttctctgtctctctctatatctctctcctgcaaatctaagctcttgtttctatgcaaatcacaagcggcgcccactatctctctctctatatatcgaaaagtaaacaatgtcgccatttttaaattcaaataacaccaccaccaccaacagcaccaacaacaacatttcctggtagatttcttagatatagatagactcatttcaacttcctcatcgaatatttcaagaaacgaagaccaacccatttcattttgatcttcatttcacaaaacccacattttcagatttttcaaaatattatagaaatcaagacttacccatttcattttgatctccattttcaaaactccatattaaaaagagcgactttagctcaaaaatgggggcttatagagcagatgatgattatgattacttgtttaaggttgttttaataggtgattctggtgttgggaaatcaaatctgttgtctagattcacaaggaatgaattcagcttggaatccaaatccaccattggtgttgaatttgctactcgtagtatccatgttgatgacaaggttgttaaggcccagatttgggacactgctggtcaggaaagatatcgtgcaatcactagtgcatactacagaggagctgttggtgccttgcttgtctatgatgtcactagacatgttacctttgagaacgtggaaagatggttgaaggagcttcgagatcacactgattccaacattgttattatgcttgtgggaaacaaggcagatttgcgtcacttacgtgcagttacaactgaggatgccaaggcatttgctgagagagagagcaccttctttatggaaacctctgcgctagaatccttgaatgtcgaaaatgcctttactgaagtgctaactcagatctatcgtgttgtcagccggaaggctcttgatgtaggggatgaccctgcagccttgcctaagggacagactattaatgttggcaaagatgatgtatcagctgtgaaaaaagttggatgctgctcagcatagtcagaataaatgaagtcttagtggtagtatattctcctgctaaagattgtgcacttcagtgatttgaagatgcctttgtttctctcagatatgtccaaaagaggccacgtttgatagcatgctttagagagtagtaacttgtataagttgagagacggcttaagcgttcagatctgagagactatctcattttgttggcattccgtgtttcattttcttgttattcttttggctgcttcttttcttggagtgttgttgtaatctgtactagccagatccaaccctctaggttagattatacttattgcttggatttgggaattatgttaagacaatggtgtttttacttgattgattaattaatttattagcttgttggggttta

SEQ ID NO: 3172 - DNA, 1041 bp, Coffea canephora
ctgctttcccattcctttctctctctatatctccaaacaatctacgctaataaaataatagtatttagttagagatagaggattaattttctggtgataatgggggcgtatagagcggacgacgattacgattacttgttcaaggtggttctgatcggcgattccggcgtcggaaaatccaatttgctgtcgagatttactcgcaatgagttcagtctcgagtccaaatccaccatcggcgttgaattcgccacccgcagcatccgcgtcgatgataaagtcgttaaggctcagatttgggacactgctggtcaagagaggtatcgtgcaatcacaagtgcctactatcgtggtgctgttggagcattgttagtctacgatgtcactcgtcatgttacatttgaaaatgttgagagatggttaaaggagcttcgggatcacacagattcgaacattgtcattatgcttgtgggaaacaaggcagatttgcgccacctaagggctgtttccacggaggatgcgaaggcatttgctgaaagggaaaacacgttttttatggaaacctctgctctggaatctatgaatgtggaaaatgccttcacagaggtgctaactcagatatatcgagttgtcagcaggaaagctcttgaggttggagaggatccagcagcactgcctaaaggacagacaattaatgttggcactaaggatgatgtttcagctgtaaaaaaggttggatgctgctctgcttagatagataaatctagtggaggaaaatggcgacattttttaagttctgatacccatatggctaagtaatatttcctcgacaagtgttgaatcacatagatctttcatggcaaagatattttcttcggtaccatatgttttctacttagcctttgttagcatattatgtaagagagtctacagctatcccatgtttggcagtaccaccaagagctagggtctcagtgatttcctcgttttgtcggcattgctctcatttattgcttttccacaatgtatcactaattagct

SEQ ID NO: 3173 - DNA, 1134 bp, Amsonia hubrichtii
tctctctctctatctatacatacaacttgcattatctctgatgggggcgtatagagcagatgatgattacgattacttattcaaggtggtgttgatcggtgattctggggttggaaagtccaatttgctttcgagatttactcgcaatgagtttagtcttgagtctaagtctaccatcggagtcgaatttgccacccgtagcatccgtgttgatgataaagttgttaaggctcagatctgggacactgctggccaggaaagataccgtgcaatcacaagtgcctattatcgtggtgctgttggtgcattgcttgtttatgatgtcactcgtcatgttacatttgaaaatgttgagagatggttgaaggagctacgggatcacactgattcaaacattgttattatgcttgttggaaataaagcagatctacgtcacttacgagctgtttctaccgaggatgccaagtcatttgctgaaagagaaaacaccttctttatggaaacctctgccttggaatctatgaatgtggaaaatgccttcacagaagtccttacccagatatatcgtgttgtgagcaggaaagctctcgaagttggagatgatccagcagcattgcctaaaggacagacaataaatgttggcactaaggatgatgtttcagcagtaaagaaggttggatgctgctctgcttagatagataaatataggcggaggaaaacaaattctttctttttcagtactaatttccatgtggctgctaagttggtcctttacaagttttcgactacatggatctttagatgattagagaatttacttcgttggcatcttatgaaagaaatggccaatgcctatccaagtatgggtgataccttcaggagctgagtgtctaaaattgatttggtgattcctcatgtccttatttcatcttctggttttcctcaatgtactattagtatgaacaatttagaaatccgttagatttgattgtatttgattgcttttgttttcaattaaggctcggattaagacatgatgtctctgcctgtatttggttgcttcacttatttttcattgcggaaggagaaacttgtgactaattatgagcttctatgcgattgtagttgactctc

SEQ ID NO: 3174 - DNA, 1227 bp, Malus domestica
attccagcttgctttggttgggttgctgtcttcaacctccattttgctatatatttctctcagaatctaacaaaacccattcaccccataactcacatacacacttccaccgccatgattcttcattatttatagactaattgccaaaaacccatcgaactcatcatcccaaaactccctctcattccttccaaatcgaaagaaaaaagacaaaacccaagaacaaaaggacgacaaagattcagcccatttttgcagtaattgaattttggggaaggagatgggggcgtacagagccgatgacgattacgattacttgttcaaggtggtgctgatcggcgactctggcgtcggaaaatcgaaccttttgtcccggtttacgaggaacgagttcagccttgaatccaagtccaccattggcgtcgagttcgccaccagaagcattcgggtcgacgataaggtcgtcaaggcccagatttgggacaccgccggccaggaaaggtatcgtgcaatcacaagcgcatactatcgaggtgccgttggggccttacttgtctatgacgttactcgtcatgttacatttgagaatgtggagagatggctgaaggagcttcgcgatcacacagatgccaacattgtgatcatgctagtgggaaacaagggagatctgcgtcacctacgagctgtttccactgacgacgctaaggcgtttgctgaacgagagaacacctttttcatggaaacgtctgccctcgagtctatgaacgtcgacaatgctttcaccgaagtgctgactcaaatccaccgtgttgtgagccggaaggcccttgacattggggatgacccagcagccttgcccaagggacaaacaatcaatgtcgggggaaaggacgacgtatcagctgtgaagcaagtcgggtgttgctctacgtaaaatttgccggaattttacgagtgccttttgacgttctatcgggcgaggtcatgtccatacacagaggttgacctgactctacgaaattgctttctcgacgggatattaactctttgaacagtatgcttcggatgctcgaaagcttgtctctatgtttagcgcaaaatttaggatgttaaggatatgttcttgttttttcctgtgattcgatttgaactacttgcttccctctgtgtagtattattctttcttggttgagtttagtataaagtttggttgtttttgagctgaaa

SEQ ID NO: 3175 - DNA, 889 bp, Arabidopsis lyrata
aaatttgaaactcttttcttcttcttcttctccttggttgatcaaaacgcgctaaattaccagaaatctcagatccataaaattttcaaggagggcgaaaaacctcacaatggcggcatatagagccgacgacgactacgattacctcttcaaggttgtgttaattggagattccggtgtcggaaaatccaacctcctttctcgattcacgcgaaacgagttcagtctcgaatctaaatccacgatcggtgtcgaattcgccactcgtagcatccatgtcgatgataagatcgtcaaagcccagatttgggataccgccggccaagagagatatcgagcaatcacaagtgcatactacagaggagctgtaggagcattgcttgtgtacgatgtcacaagacatgtgacatttgagaaccttgagagatggttaaaggagcttcgagatcatacagattctaacattgtcatcatgtttgttgggaacaaagccgatctccgtcacctacgagctgtttccactgaagacgctaaggcttttgcggagagagagaacactttcttcatggagacatctgctctcgaatccatgaacgttgagaatgctttcactgaagtgctttctcagatttaccgtgtggttagccgcaaagcgttggatataggagatgacccggctgctcttcccaaaggacagaccatcaacgttgggtctaaagacgatgtctctgccgttaaaaaggttggttgctgctcaaattgatgctactttcgactttcaagaatctgtctcttcatttctttttgttgttatacgtgaagatcttgttcatttagttgtataatcacacaccttataccatattgaataccactgcgtttccatttc

SEQ ID NO: 3176 - DNA, 1032 bp, Fagus grandifolia
ggatctcaatccccatatttccagctcgcatttcttcccagcttctttggttttttgaaagcaacaatatttgacaacaaatcaaaacccatctcttaaaattcaaaacaaaagattactgcttttataacaattttttctttcttaccaaacagagagagttgtgtaggaaaatgggggcgtacagagcagatgatgattacgattacttgttcaaggtggttctgatcggggactccggtgtgggcaaatcgaatctgttgtccaggttcacgaagaacgagttcagcctcgaatccaagtccaccattggggtcgagttcgccaccagaagtattcgtgtcgatgagaaggttgtcaaggcccagatttgggacactgctggccaagaaaggtatcgtgcaatcacgagtgcctattatcgtggtgctgttggtgcgttactagtctatgatgttacccgccacgttacatttgaaaatgtggagagatggctgaaggagcttcgggatcacacagatgccaacattgtgatcatgcttgtaggaaacaaagcagaccttcggcacctgcgagcagtgtccactgaagatgccaaagcttttgccgaacgagagaacacatttttcatggaaacatcagcccttgagtccatgaatgttgagaatgccttcacagaggtgctgacccagatttatcatgttgtaagcaggaaggcccttgaaattggggatgacccagcaaccttgcccaaaggagaaacaatcaatgttggaaacaaggatgatgtatcagctgtgaagaaagttggatgttgctctgcttgagagcacgagaggagagatctaaaatatattatctttgaaattctatgccatgttcatatctttgtagaggtcagcaaccgaatgaaaaaatgctgtgtcaataggatatttactgtgtgaactcatctaccttagcggaaaagttaggatccaaaagatatgtgcctgttattttctttgattcaatttgaagtacctgcatccc

SEQ ID NO: 3177 - DNA, 680 bp, Manihot esculenta
atataccaaatgggagcatacagagcggacgatgattacgattacttgttcaaggtagtcttgattggagattctggcgttggcaaatccaatctcttgtctcgttttaccagaaatgaattcagccttgaatccaaatccaccattggcgtcgagttcgccacccgcagcatccacgtcgatgataaggtcgtcaaggctcagatttgggataccgccggccaagaaagatatcgagccatcacaagcgcatactatagaggtgctgtgggagctttactagtatatgatgtaactcgccatgtaacatttgaaaatgttgaaagatggctaaaggagcttagggatcatacagataccaacattgtgataatgctggtaggaaacaaggccgacctgcgtcatctccgagctgttgccactgatgatgccaaaggatttgcccaacgtgagaatacctttttcatggagacatctgctcttgaatccctgaatgtggagaatgcattcactgaggtgctgacccagatctatcgagtcgtaagcaagaaggctcttgacattggagatgatccagcagctttgcctagaggacaaacaattaatgttggaggcagagatgatgtgtcagctgttaaaaaggctggatgttgctcatcttaatttttgaaacttttcct

SEQ ID NO: 3178 - DNA, 1408 bp, Cicer arietinum
atgattgccatttgcaaccattccccaaaacaaaacaatttgccaagtaaaaacctcttcccacataacattgctgtttcattcaattattagcttctctctcgttgttttttttttcttcttcttcttattacgttattattccaaatctggaaaaacaaaaacaatgtttctttgattattattaatacattcaaatctcatcaaaccatttgaatctcatacataacaaactcatcaaaatcttttgtttttcttcatccaatctttgattctctctctagccaaacaccacatagaaaaaaagggtgtgtgtgggggcaaatgggggcatacagagctgatgatgattatgattatctgttcaaggttgttctgattggtgattctggtgttggaaaatccaaccttttgtctagattcaccaagaatgaatttagccttgaatcaaaatccaccattggtgttgaatttgcaaccagaagcattagggttgatgataaggttgtcaaggctcagatttgggatactgctggccaggaaaggtaccgagcaattacaagtgcatattatagaggagctgttggtgctttactagtgtatgatgttacacgccatgttacatttgaaaatgtggagagatggttgaaggagctgagagaccacacagatgccaacattgtggtgatgcttgttgggaacaaagcagacttgcgtcatttgcgagcagtttcaactgaagatgcaacggctttcgctgaaagagagaacacatttttcatggaaacttctgccctcgagtccatgaatgtcgaaaatgccttcactgaagtgctgacgcagatctaccgtgttgtgagcaagaaagcccttgagattggtgatgatccagcagcactaccaaaaggacagacaattgatgttggatctcgggatgatgtatcggctgtgaagaaatctggatgttgctctgcttgagtttacaataaaagtttctgtatttttactgtaaacctctatgccttgtttatatcgatgtagagatcagtcttacgcccttacagcgtgaaaatgattgtctaaactctaaagagcatcactctgagctttcggcgtagaaaaatttgttcaatattagttagatgtttaggaaacatgctctttaattttgttttgttcttgtctctgttgaagaagttcatttatctaatttcaggtttattgaatatttacaatgactcgtttggattagtttgttctttgttgtatatcagcatttttagctgagataagtatttggttgggaaaagtaagtgagtttttcaaaaagttgaggtacaaaagtcaatttcagcattaatccttagtgtaacatcattttaatttttcttgttttacactatttgct

SEQ ID NO: 3179 - DNA, 1126 bp, Cynara scolymus
caacaataaggctttgaagcttctccttccccaattgacacctctttaccgtatttacttagtgacacaccacgcagcattcattaagatctgtatggcaacctcccccattttcaacacacagatctgcaatatctctcccattttttgatcaacaaacttaacaccacattgctgctcatataccccaatttctttttcttttttctttgcatagcaaatgggtgcgtacagagcagacgatgattacgattacttgttcaaagtagttctcatcggtgattccggagttgggaaatcgaatctgttgtccaggttcacacgaaacgagttcagtctcgagtctaaatcaaccatcggcgtcgaattcgccactcgtagcattcgagttgatgagaaagttgtgaaggcccagatttgggacaccgctggccaggaacgataccgagcaatcacaagtgcatactaccgaggtgcagttggtgcattgatcgtgtatgatgtaacccgacatgtgacctttgagaacgtagaacgatggttaaaggagctccgagatcatacagattccaacatcatcatcatgctggtaggaaacaagtcggatctgcgccatttacgggctgtaccaactgacgatgcaaaggcgtttgctgaaaaagagaacacttactttatggaaacatctgcacttgaatccatgaatgttgaaaatgccttcacagaagtccttactcaaatctatcacgttgtcagcaaaaaagcactcgatatcggagatgatccagctgctttgccaaagggacagacgattaacgttggtggcaaggatgacgtatcggcattgaagaaagtcgggtgctgttccacttagatggattgcattctttgtaagcttctaattaccgaaattttcagatagtttaagcccgtttggccaaaactacatcggatgaagggcatatcaggaacacatgatgcaaacgattgtttttttatggtttcattgttatgtttttactgtgatgtatggttatagcgtaggtcgattgttggaaatgtatcaagattctattgctatccatgtactcttcttatttatcagtaaagatttaccaaattctcc

SEQ ID NO: 3180 - DNA, 1247 bp, Euonymus alatus
ggacagtttcttcctatgcaaagcggcgctgtatcccttgcatgctctttgcgcgaaatgccggtgaaattttagattcaaacaacgacgttcactgattactgccacaatcggttgcatcagaaacaatacatagatagaaaaagagagggagggagaggggtgaggtacggaaggaaatgggggcatacagggcagacgatgactacgactacttgttcaaggtggtgttgataggggattcgggtgtggggaaatctaacctgttgtctcgattcacgagggacgagttcagcctcgaatctaaatccaccatcggagtcgaattcgccacccgcagcatccacgtcgacgacaaggtcgtcaaggctcagatttgggacaccgccggccaagaacgataccgtgcgattacaagtgcttactatcgaggagcagtgggtgcgttgcttgtctatgatgttactcgacatgtcacattcgagaatgtggagagatggctaaaggagcttcgggatcacactgattccaacattgtgatcatgcttgttggaaacaaggctgacttacgccatttgcgtgcagtttccactgatgatgccaaggcttttgctgagagagagaacacatttttcatggaaacctctgcactcgagtcattgaatgttgagaatgcattcactgaagtgcttactcagatttatcgcgtggttagccgtaaggctcttgacgtcggtgatgaccccgcagccttacccaagggacaaacaattaacgttggcactaaagatgatgtatcagctgtgaagaaagtcggatgttgttcagcttaatgtccctggaactagtggttttccaatcttagtttaatggggtttcaagatttctcggtcttcattgaatcctcagaaaatggaatccacagcatatcatgcactgagggtgagagactacagatcttgtcagatttattgtttcaacaagaggctttcccacacttagtgcaacttatttgttatagttttttctcccttttctggtttatggtttgtgttgcttgtgtgattgtgtactagtattctcaaagtgtgtaggatgtccgtaggttatattttattcttcagcactagatgtggatctatgttgatattggtgttattccctatttgattaatcttgccaaggagatttatatccttgcttgatcaactgataacaaaatccaagtctttgagctttgccttcac

SEQ ID NO: 3181 - DNA, 1048 bp, Euonymus alatus
ggggggagccgctccaactttaaaggcggcccatatctccatctccgcaagcaatcagaatcagaaacgcgtttttcgcttttgttttttgaatctgtgtttctctgtcgagaatccaaaacaatctcaggagatcacagcgattcgaagaacataagttaagaatgggagcgcacagagccgacgacgattacgattacttgtttaaggtggtgctgattggggactccggcgttggcaaatcgaacctcttgtctcggtttacacggaacgagttcagcctggaatctaagtccaccattggagtcgagttcgccactcgcagcattcacgtcgacgacaaggtcgttaaggcccagatttgggacaccgctggccaagaaagataccgtgctattacaagtgcatattatcgaggtgctgttggagctttgctggtctatgatgttactcgccatgtcacatttgaaaatgtggagagatggttgaaggagcttcgggatcatactgattccaacattgttatcatgctcgttggcaacaaggcagatcttcgtcacctgcgagcagtttccactgaagatgccaaggcttttgctgagcgagagaataccttcttcatggaaacatctgctctggagtctttgaatgttgaaaatgcattcactgaagtgctgacccagatttatcgcgtcgtaagcaggaaggcccttgatgttggggaagacccagcagctttgcccaaagggcagactataagtgttggaaccaaagatgatgtatcagctgtaaaaaaggttggatgctgttcatcttgagtatggagaaaagagttgaagaatattgtcttcgagagctaatgggctgttcatatctttatagaggtatgcttgaccatctgaaattgtatgttaacaaaattctttaactgcttgagcttggaaaagagaaattttatctactgtctccaccttaagggtctaaaagattgtagcagctatatttcgtttaatgatataattttaactatttgctcttttaatgaaat

SEQ ID NO: 3182 - DNA, 1209 bp, Lupinus angustifolius
aaacgactattaataaaccccacatttctagcgccatctgtttcaattattttctcattcaactgttctcaaaattattatttttttttaccttttttaaccttcttctaaatctgggtctcaattttgaacatacctaacaaaaatgattcctttctttcaatcacaccaacccatttgagccttttccacattcatcaaatcaaaatcacttttttattctccctctgtccaaaacacaaatacccacatacgataataagcaaaagtgtttgtggcaaatgggggcttatagagccgatgatgattacgattacttgtttaaggtggttctaatcggtgactctggtgttggaaaatccaatcttctttcgaggttcaccaaaaatgagttcagtcttgaatccaagtccacaattggggttgaatttgccactagaagcatccgggttgatgataaggtcgtcaaggctcagatttgggacactgctggtcaagaaaggtaccgagcaattacaagtgcatattatcgaggagctgttggtgcattactagtgtatgatgttacccgccatgttacatttgaaaatgtggagagatggctaaaggagctgagagatcatacggatgcaaacattgtggtcatgcttgtaggtaacaaagcagatttgcgtcatctacgagcagtttccactgaagatgctacatcttttgctgaacgagagaacacatttttcatggaaacatctgccctcgagtccatgaacgttgaaaacgccttcacagaagtgctgacccagatctatcgtgttgtaagcaagaaggcccttgacattggtgatgatccagcagctttaccgaaaggacagacaattaatgttggatcccgtgatgatgtatcagctgtgaaaaaagctggatgctgttctgcttaaggacgtagtaaaagtctgtatttttaactttaaagttgataccttgtttataaccatgtagagattggcttgacagcattgaaaatggttctgtctggagagcatcaaactatgaagtttctgctttggtctgtagaaaactatgttccatgttagccagatgtttaggaaacaagtattctgttttgcataactcctatttttgtgtcattttaagatatccatttatctaatttcagatttatcaacttggttatctccttaatattcttca

SEQ ID NO: 3183 - DNA, 1029 bp, Carica papaya
tctctctctctctctctctctctctctcattcatgtcaccaacctccacaatctgattcattttttttcaaaacccatccgtttctatcgagaacccaagctaccaaagcggtccgggaagagagaatggcggcgtatagagcagatgacgactacgattacttgtttaaggtcgtattaatcggtgattcgggtgttggcaaatcgaacttgttgtcgcgatttacaaggaatgaattcagtcttgaatccaaatccacaatcggagtggaattcgccacgcggagcatccgtgtcgacgacaagatcgtcaaggcccagatttgggacaccgctggccaggaaagataccgggcgataacaagtgcctactaccgaggagctgttggtgcattgcttgtctatgatgtcacccgacatgttacatttgagaatgttgagagatggttaaaggagctacgggaccacacagatgctaatattgtgatcatgcttgtcggaaacaaagctgacctacgtcatttgcgtgctgtctccactgaagatgctcagtcctttgctgagagagagaataccttctttatggagacctctgctcttgaatccatgaatgttgagaatgctttcactgaagtgctaacccaaatatatcgggtggtcagccggaaaactcttgatataggagatgatccggcagcgttgcctaaaggacaaactattaatgttggaaccaaggatgacgtgtcagctgtcaagaaagttggttgttgttctgcctgaatttcaatttgaaatttgaggtatcatatcacatgctcctccgttctccctcacctgccatatatttatatcaaattattttcctgtgtaatggtccatcttcccatctttttcacgctttcattagtgtgttggatgccttttcacaatttggattcttgaacaaaatgcagaattcttcgaaaatacctcttttttttatttgtagtatactaaagtagttcacttatctctttctcatgtattact

SEQ ID NO: 3184 - DNA, 1225 bp, Cajanus cajan
aaataaagttcccttttttaccattgttctaaatctgggtttcctttctatgaacaaaacaaagcatggctcttttgttggattgacgccaccccatttgatttttctctctcctttctctcttctccctctccaaagacctcacagagcaaacaacagaaaatgggggcgtacagagccgacgacgattacgattacttgttcaaggtggtgctgatcggcgactccggtgtcggcaaatccaaccttctttctcgcttcacgcgaaacgagttcagcctcgaatccaagtccaccattggtgttgagttcgccaccagaagcattcgcgttgatgacaaggttgtcaaggctcagatttgggacactgctggtcaagaaaggtaccgagcaattacaagtgcatattatcgaggagctgttggtgctttactcgtgtatgatgttacccgccatgttacatttgaaaatgtggagagatggctaaaagagctgagagatcacactgatgccaacattgtggtgatgcttgtagggaacaaagctgacctgcgtcatttgcgagcagtatccaccgaagatgctacaagtttcgctgagcgagagaacacatttttcatggaaacatccgccctcgagtccttgaacgttgaaaacgccttcacagaagtgctgacccagatctatcatgttgtaagcaagaaggctcttgagattggggatgatccagcagctttaccaaaagggcagacaattaatgttgggtctcgtgatgatgtatcagctgtgaagaaaactggatgttgttctgcttgagtgtgtagtaaaagtcagtctctgtatttttactttaaaatttattccctgtttataccatgtagaaattggcttcacagcatcatgattatttagggagcatcaaacttttaagtttctgctttggtctgtagagaattctgttcaaaattagccaaatgtttaggaaacacgcacattgatttttgcataattcctatttttgtgccctttaagatatttatttatctaatttcctaggtatcagtttggttcttttctaatcttcatcatgcttttatttgttcttatctatgcctgcatttgaaaagcagatgttcaatctgggtcttcctttgcttagcttttctcttcataatgtagagaacattgaaaacttgactatattttatcttcccttttgaagcat

SEQ ID NO: 3185 - DNA, 1151 bp, Primula obconica
tgtctctctctccttaaaaacggtgatttccccttcccaactctctctctcaaaaatctttcgagatctgtctcccactgcagacagatctaatcaagacttatacatacatagatagatacatatagatatataaagagagaatgggtgcatacagagcagacgacgactacgactacctgttcaaggtggttctgatcggcgattctggcgtggggaaatcgaaccttctttctagattcacacgcaacgagtttagcctcgagtccaaatccactatcggcgtcgagttcgctaccagaagcatccacgtcgacgataaggtcgtcaaggcccagatttgggacaccgctggtcaagaaaggtaccgcgcaatcacgagtgcgtattatcgtggagctgtaggtgcattgcttgtttacgacgttacccgacatgtcacattcgagaatgtagagagatggttgaaggagttgcgtgatcacaccgatgcaaacatcgtgatcatgcttgtcggaaacaaggcagatctacgtcatctacgtgccgtgtccaccgaggacgccaagtcatttgcagagagagaaaatacctttttcatggaaacatctgctctcgagtctttgaatgttgaaaacgctttcactgaagttcttactcaaatacaccgtgttgtgagcaggaaggctctagaggttggtgatgaccctgcagctttgcccaagggtcaaaccattagcgtgggtggcaaagatgacgtgtccgctatgaagaaggcgggatgctgctcttcgtagtgagagaaagttatcgtagtcctcaaaggagatccaaaagtatgcatacatatttgggtatatttatgtctgatgcagtgggatttgagagaacaggcttcctttactatgagagttcttcgatgcgacgctgatctttacttgtacctttaagcaaaagtcacaaggtttagaatctgactcaatttctttgcaattttcagcttcatttgtttggattattcgtctattttgttggtgtgtaccattaaagttcagttcatagctacctttagataagttcatatttgtttgctacgactttagtttcgaaatgtattatgcttaatgacttttggattaccttattggtta

SEQ ID NO: 3186 - DNA, 857 bp, Carthamus tinctorius
ccattccacttctttccacgtattttctctctcacacttagtgccacaccacgcagcattgattgagatctgtatggccattttcaacctcctccagatctgcaaaatatctcccctttcttgatcaaccacaacacattgctgcccttatttcctttctttcattgttttaccaaatgggtgcctacagagcagacgatgattacgattacttgttcaaagtagtcctcatcggcgattccggagttgggaaatcgaatctcttgtcgaggttcacgcgaaacgagttcagtctcgagtctaaatccaccatcggcgtcgaattcgccactcgtagcattcgagttgatgagaaagttgttaaggcccagatttgggacaccgctggccaggaaagataccgtgcaatcacaagtgcatactaccgaggtgcagttggtgctttgattgtctatgatgtaacccgccacgtaacctttgagaacgtagaacgatggttaaaggagctccgagaccatacagattccaacatcgtcataatgctggtaggaaacaagtccgatctgcgccatttacgggccgtgccaaccgaggatgccaaggcatttgctgaaaaagagaatacttattttatggaaacatctgcactcgaatccatgaatgttgaaaacgccttcacggaagtccttactcaaatctatcacgttgtcagcaaaaaagcgctcgatcttggagaagatccagctgctttgccaaagggacagacgattaacgttggcggcaaggatgacgtatcggcattgaagaaagtcgggtgctgttctacttagatgggattgcattctttgtaagttttc

SEQ ID NO: 3187 - DNA, 1272 bp, Fragaria vesca
atctcataaaaatcatttcatatttatcgcaatcacaagattgaagagcgccctttctctctcccataaaaatcgctgtcctcctctcgtccatgtctccgaccccgagctcttccgattcataaatccgaggcccaccgaattcgatccgaccacaccggtgaccccgaccgtcggatttggatcagcggagacatggcctaccggtcggacgacgactacgactacctcttcaaggtcgtcttgatcggcgactccggcgtcggcaaatccaacctcttgtccaggttcacgcgcaacgagttcagcctcgagtctaagtccaccatcggcgtcgagtttgccacccggagcatccacgtcgacgataagatcgtaaaggcccagatttgggacaccgccggccaagaaaggtaccgagcgattacaagtgcatactatcgaggagctgttggtgctttacttgtgtatgatgtcacccgacatgttacatttgagaatgttgagagatggttaaaggagctacgagatcacacagattccaatatagtgataatgcttgtgggcaacaaggctgacctgcgtcacctgcgtgcggtttctgttgaggatgctaaagcctttgctgagagagaaaacaccttctttatggagacgtcagcacttgagtctatgaatgttgaaaatgcattcagtgaggtcttgacccaaatatatcaagttgttagccggaaagcactcgaggttggagatgatcctgcagccgtgcctaaaggacaaaccataaatgttggaggcaaggatgatgtttcagccattaagaaagctgggtgttgttctgcgtaatcagaagggtgatgggaacatgaccaaaacgaaaagggtgatagttcaagatcaatgtgctgtcctttaattttgctgcccctgtagtttgagggtttctacctcacaactcatggattttctagtgaacttttaatgtaatgatcatgttttctagtgcttgagttttcctggggttggcttatagttttggagtctaaagaaatctcacagctttcatcttatatcaatttctttgattatttgtgctctctaattaatctctatttatctttttctttgttctttgttgccgttcatggtcgatggtttgcttttctcttttggaaagggatgttagctttgttgttgtggctataagcccataattccatataggaaaatgtcgatcattgttggctataaatttaatgatggaaaatatta

SEQ ID NO: 3188 - DNA, 903 bp, Tripterygium wilfordii
ggcccatatctccagctcccaccaggaacgcctctcttttctttgaatctgtgtctcctctctgttgacaatccaaaacaatctcggaagatcacagtgatttgataatgggagcgtacagagccgacgacgattacgattacttgtttaaggtggtgctgatcggggactccggcgttggcaaatcgaacctcttgtctcgctttacacggaacgagttcagcctggaatctaagtccaccattggcgtcgagtttgccactcgcagcattcacgtcgacgacgaggtcgttaaggcccagatttgggacaccgctggccaagaaagataccgtgctattacaagtgcatactatcggggtgctgttggtgctttgcttgtctatgatgtcactcgccacgtcacgtttgaaaatgtggagagatggctgaaggagcttcgcgatcataccgattccaacattgttatcatgcttgttggcaacaaggcagatcttcgtcaccttcgagcagtttctactgaagacgccaaggcttttgctgagcaagagaataccttcttcatggaaacatctgctctcgagtctttgaatgttgaaaatgcattcacagaagtgctgacccagatttatcgcgtcgtaagcaggaaggcccttgatgttggagaagacccagcagctttgcccaaagggcagacaatcaaggttggaaccaaagatgatgtatcagccgtaaaaaaggttggatgctgttcttcttgagtgtggagaaaagagttgaagaatattgtctgagagccaatgccctgttcatatctttatagaggtatgcctgaccatctgaaattgtatgtcaacaaaattctttgactgctttgagcatggaaagagaaattttatctac

SEQ ID NO: 3189 - DNA, 1136 bp, Vinca minor
cactagtataataaaatgtctttgaatagatcttcctctccttcctctaccgttttcctcttcttttattttacttttcccccctctctatacctatagataggtacaagtacatataatgggggcgtatagagcagatgatgattacgattacttattcaaggtagtattgatcggtgattcaggtgtcggtaagtccaatttgctttcaagatttacccgcaatgagtttagtctcgagtctaagtctaccatcggagtcgaattcgccacccgcaccattcgcgttgatgataaagttgttaaggcccagatttgggacactgctggccaagaaagataccgtgctattactagtgcctattatcgtggcgctgttggggcattgcttgtctatgatgtcacacgtcatgttacatttgaaaatgtcgagagatggttaaaggagcttcgcgatcacactgattcaaacatagttattatgcttgttggaaataaagcagatctacgtcatttacgagctgtttccaccgaggatgccaaggcatttgctgaaagagaacacacttttttcacggagacctctgctttggaatctatgaatgtggaaaatgccttcacagaagtccttacccagatatatcgtgttgtcagcaggaaagcccttgacgctggagatgatccagcagcattgcccaaaggacagacaataaatgttggcactaaggatgatgtttcagcagtaaagaaggctggatgctgctcttcttagataggtaaacaaatataggcggaggaaaacaaattctttctaatttcagttctagtttccatgtggctgcggatactaagtcttggattacatggatctttgggtgattagaaacattttaaaagttggcatcttatgtaaggcgaatggctaacttcaagtatgagtgataccttcagggagggagcgagtgagtgcctaaaaatgatttccccactctttgtccttattttatcttttggctttcctcagtgtactactactatctactagtatgaacaattttaggacactgttagatttgattgcttttgtttttaatcggggaacagatcaagacattatgtctctgcttgtattttgt

SEQ ID NO: 3190 - DNA, 1068 bp, Euonymus alatus
atgcaaattgcaaaacggcgctatatccttcgccttctctgtctgcgcgaaatgctggtgaaattatagattcaaacgacgacgttcattgattgctggcagatccacaatcgggagcatcgaaaacaacacacggatagacagggtgagagagagagaggtgagaagcggaaggaaatgggtgcatacagggccgatgatgactacgactacttgttcaaggtggtgttgataggggactcaggtgtggggaaatccaacctgctgtctcgattcacgaggaacgagttcagcctcgaatctaaatccaccatcggagtcgaattcgccacccgcagcatccacgtcgacgacaaagtcgttaaggctcagatttgggacaccgccggccaagaacgataccgtgcaattacaagtgcttactatcgaggagcagtgggtgcgtttcttgtctatgatgttactcgacatgtcattcgagaacgtggagagatggttaaaggagcttcgggatcacactgattccaacattgtgatcatgcttgttggaaacaaggctgatttacgtcatctgcgtgcagtttccactgatgatgccaaggcttttgctgagagggaaaacacatttttcatggagacctctgcactcgagtcattgaatgttgagaacgccttcactgaagtgcttactcagatttatcgtgtggttagccgcaaggctcttgacatcggtgatgaccctgcagccttacccaagggacagacaattaacgttggcactaaagatgatgcatcagctgtgaagaaagttggatgctgttcaacataatgtctctggaactagtggttctccaatcttagtttaatggggtttcaactgcttgcctttttctatggctactttgtttaatatggagggatatgattgatggtctttgttcacgactccacgactgtgggtttctactgaaatcctcatctagattctcctttccttgctattcgttggttgtaaagaaaaataaacaatcctatttattttgctttaggcaatgatatataccattt

SEQ ID NO: 3191 - DNA, 1049 bp, Castanea mollissima
gggggtctctcatattttattttgtttaacacagagagagagagagagagagagagttgtgtatgaaatgggggcttacagagcagatgatgattacgattacttgtttaaggtggtgctgatcggggactccggtgttggcaaatcgaacctgttgtcgaggttcacgaagaacgagtttagccttgaatctaagtccaccattggggtcgagttcgccaccagaagtattcgtgttgatgaaaaggttgtcaaggctcagatttgggacactgctggccaagaaaggtatcgtgcaatcacaagtgcctattatcgaggtgctgttggtgctttactagtctatgacgttacccgccatgttacatttgaaaatgtggagagatggctgaaggagcttcgggatcacacagatgccaacattgtgatcatgcttgtaggaaacaaagcggacctgcggcacctgcgagcagtttccactgaagatgccaaagcatttgctgaacgagagaacacctttttcatggaaacatctgcccttgagtccttgaacgttgagaatgccttcacagaagtgctgacccaaatttatcatgttgtaagcaggaaggccctggaggttggggatgacccagcagctgtacccaaaggagaaacaatcaatgttggaaccaaggatgatgtatcagctgtgaagaaagttggatgttgctctacttgagcatggagagttttaaaatacattctctttgaacttctatcccatgttcatatctttgtagagatcagcaactgaacgaaaagtgttttctatagaatatttacagtgtgaacttgtctaccttagctgaaaatttaggatccaaaagatatgtgcctgttcttttctattattgaatttaaagtacctgtgtccccactttaccctttttgtatgactaaaattactcagcttcttcagttttatatcaagtttgatcattttgggctataaaagttcaaagactggtggtttaatggaaagtgaaaatgatcaatttttaaccctt

SEQ ID NO: 3192 - DNA, 1355 bp, Vaccinium corymbosum
ttcctctctcaaaactctaccccgccccttgccttcttccctccctcgctctctgcaatcctaccacatgcatcatttcttccaataagaatacataagaagaaatactaatacacatacatagttgcacagagagagagagagagagagagagagagagagatggcgtcgtacagagcggacgacgactacgattacctattcaaagtggttctgataggggactcgggcgtgggaaaatcgaatctgttatctaggtttaccaggaacgagttcagcctcgagtccaagtccacaatcggcgttgaattcgctactcggagtattcgcgtcgaggataaggtcgtcaaggcccagatttgggacaccgctggccaagagaggtatcgtgcaatcactagtgcatactaccgtggagctgtcggtgcattgcttgtctatgacgtcactcgccacgtcacgtttgagaatgttgaacgatggttaaaagagctccgtgatcacacggacgcgaacatagtgataatgcttgtagggaacaaggcggacttgcgtcatttgcgtgctgtgtccaccgaagatgcaaaggcctttgcggagagagagagcactttctttatggagacatctgcccttgagtcgttgaatgttgaaaatgccttcacagaagcgcttacacaaatatatcgagttgtcagcaggaaagcacttgatattgggaatgaccctgcagccttgcctaaagggcaaaccattaatgtgggaaacaaggatgatgtctcagctgtgaaaaatgttggttgctgctctgcctagttgagggagcaaggctgtgaatttggatcagggactcgtggtgggaatagaaaacatacaaagaagctggatttattcagttctttatgtttgtgataaagctgtcctcaaatctgtgatccaaacacagcctaaagaatggtagaaaaacattgttccttagaatatcaagaactctacattgcagctatcgggttcttcgtttctctctttttcggttgatacgttcattgcacagtttcaaagtcattgattgtggagctttgttggtgactagttcgtttctacgaagagaagcaacgtgcagattctcccttcttatgatgcttgtttcttatatcacttgtgctgttttccatctgtatcttttcattgtttattccggtaagtagcattgtatttggttgtgccttcttttcagtgtctctgggacaagttttggatcttgtatgactgatcaggtgttataccccacacatttgtttgatgcttcttagaaagtactatttctgaatctgtatacattctttggagatttt

SEQ ID NO: 3193 - DNA, 1338 bp, Citrus clementina
gacaaacaaacccctcgtttcaatttacaaagtagaaacaaagaaaacaaacgaaacaaaaacgtgctcgtttgacactaaaaactattaaatcccaaaacccgctcgtgttttacgtttttgtagaagcatttattaaaatctctttcgcgtcagatgatctgctaatcccaaaaaaaattaacacataagagaacacaaaaagagaaatgggtgcgtacagagcggacgatgactatgattatttgttcaaggtggttttgatcggcgactccggcgtcggaaaatcgaaccttttgtccaggttcacacgcaacgagtttagcctcgaatcaaagtccaccattggcgtcgagtttgctactcggagtatccgttgtgatgataagatcgtcaaggctcagatttgggataccgccggccaagaaaggtatcgtgcaatcacaagtgcatactatcgaggggctgttggtgctttgctggtctatgatgtcacacgtcatgttacatttgaaaatgtagagcgatggctgaaggagctccgagatcacacagattcaaacattgtgatcatgcttgttggtaacaaagcagatctgcgccacctgagagcagtttccactgaagatgccacagcttttgcagaacgagaaaacactttttttatggaaacatctgcccttgagtccatgaatgtggagaatgcattcacagaggtgctgacccagatatatcgtgttgtaagcaggaaggctctcgaaattggagatgacccagcagctttgcccaagggacagacaatcaatgttggaactaaagatgacgtatcagcggtaaagaaagtcggatgttgttcaaactaaataatgaggcaaggccgaaagaatattgtctttgacattctgcacgctctgttcatatcccataagaggtttgcctggtacatgacttaagtattaaccaaatttgaacggtttgaacttgtgactttaggtagtgaagagaagaaatctgttttcagcccatgatctaggatctgcgacatatttagctggtttattttattttctttgatgctgtttgaactagatgctatcttgtgcatttacatcaatcacccaactgctgtagatttagctcaacactgttgtcatgggttgtaaattatgaagattgactttaatgctacgaggagagataactttccactactatgtatactgtatactgtttttccggtctgttacatctgtttcacattctaatggaagagtgccttagcatccgggagggaaaaaatcctgatgctcgtgaccataaatgctatcattttatttc

SEQ ID NO: 3194 - DNA, 945 bp, Euphorbia peplus
aaatctcagagccctcaattttgaaaagaagaagaacccaaacccgacccgatccgaagttctgtaggaaaaatggcggcgtacagagcggaagatgattacgactatctgttcaagctggtgctaatcggagattctggagttgggaaatcgaatctactctctagattcactcgcaacgagttcagtcttgaatccaaatccactatcggtgttgaattcgctactcgtagcattcatgtcgatgacaagatcgtcaaggcccagatttgggatactgctggccaagaaagatatcgtgcaatcacaagtgcatactaccgaggagctgttggtgcattgctagtttacgatgtaacaagacatgtaacgtttgagaatgttgagagatggttgaaggagctacgggatcatactgatgccaatattgtgattatgcttgtggggaacaagtcagacttgcgccatttgcgtgctgtatcgactgaagatgccaaggcttttgcagagaaggagaacacatacttcatggaaacatctgccctggagtccatgaatgttgagaatgcattcacagaagtgctaactcaaatataccatgtggtttgcaggaaagcccttgatatcggggatgatccggctgctgtccctaaagggcaaaacatcaatgttaaggatgatgtttcggctgttaagaaagtcggttgttgttctgtttgaaataagaagattgagatggaccgacttgtaggacttcctcttgtgaagaaatggcaactctattatacaattagaatcatttgtgatgtgaggatgctaaagcttctatgggatttgtctgcatttttcatttgatgccagttattctattctatagttacttgagtttagccacttgtgaattgttttattttttagttgatgtaacctatgttgtatttgatt

SEQ ID NO: 3195 - DNA, 1256 bp, Panax ginseng
cccataacgtaaatcaaatccaagtgttgagatctgtacagtagaatttccatacagatcgactctctcacattgcgatctatactttgtatctctatatttggctatacataaacacatttatatatcagtaatttcaagttgagaagatcaaaaaatgggagcctacagagcagacgatgattacgactacttattcaaggtagtactgatcggcgactccggcgtcggaaaatcaaaccttctttctaggtttacccgtaacgagttcagcctcgagtccaaatccaccatcggcgtcgaattcgccacacggagcattcgcgtcgacgataaagtcgtcaaggcccagatttgggacaccgccggccaagaaagataccgtgcaatcacaagtgcttactaccgaggagctgtcggtgcattgcttgtatatgatgtcactcgaaatgtcacatttgagaatgtagagagatggttaaaagagctccgtgatcatacagattccaacatcgtgatcatgcttgtggggaacaagtcagatttgcgtcacttgcgagctgtctccaccgaaaacgccaagacatttgctgaaagagagagtaccttctttatggaaacctctgctctggagtccatgaatgttgaaaatgctttcacagaagtgcttactcaaatatatcatgttgtcagcagaaaagctcttgacattggagatgatccggcagccttgccaaagggacagaccattaatgttggcaacaaggatgatgtatcagctgtgaaaaaagttggatgctgctctgcttagaagttggtaaagcaaaggtgaaaattagtttcggtcatgagtaacttctaattttcttgtggctgaacttgtcccgatgagtcataggattagtcttgcatggagtttttggtcaccaaagcttcagttattgcatatgggactaaaatgcttgaaacttgttgagtcagattttttcgaaggttagtatctaagcacttatcattcttcttctgtattttcatcaattcttttaagtcattgtattttattgtagttcttagcaatgcttaggttctatttgattgcttaggactttttttggcctttttgaccagttccggtaatgtactaagataaatttctttggtttgtaccctgggtcatttagttgttttgtggaccgagaaatgtggaagatgagactatttaattgtacgtaatcacatattcaaatttatctgtg

SEQ ID NO: 3196 - DNA, 2918 bp, Vitis vinifera
atgcggaaaagggagaaaaatgggtacgaagatgttgttgctaagtgtagcaatgcgaagtttgatgttgggaaaattgttgacaatgttgattccgatgtttcattgaggcgcattaagagaattatattatcagtaaagaagccatcctatattcgtaggcttcgctcaggcttcctcattcttggcttgggaaccagaaacccggagctaaaagacagatttgcagttcaattggagtacatccttttttgtctcacacaaggtaatatcgaggaagcacaccaggctgctatatgcctcatgcaagaacgtgattttgggagtggcccaattttaaatttggttgttggattggcattttatcagctgtggtatttcactatcccaaaagagatgcagctgagagatttaggtgagtcgtgcacccctacggaatcagagatgtcagcaacaagattcagcaatactgttggaaactcagagggttatagtgcaattgatgttctcaaggaagagtactcctctgagagtgattcagaaacctctgttaggaatgataaaggaaatgctgttaatgctaatattgatctacatagagagctttccgaggggattaatgataacctacggagtgaaaaatcctttccccagcctcaagacttctacatgaattctgctggaaatactggacatgaagaaacctcttttccttatgatggtgacaatattacgcaacttgcttccattttctctggacatggcttttggtcttttgatcttctccaggagagggtcagatttcatgagttatttctttacttcagtgatcagtcttgcatactcatcaatctgagtatttggcaaggtggtagtagttttgaagtatttaaagcttgccctttactcaacgcctccgatattggctgcgctacttccattcatacaggtaatctcaatattctttttcattctatattgagggctagtgttctggagcattttgatcgtgaaaactgtgtggggctctcaacctgcttcgaggatattctgaagaaagatccaacatcttcctactcattggctaagcttatcagcattcatcaaaatggggactatgatgctgcgtcgctgttggaaatgatagctttacatttagatgctacctatgcagaattcgacatatggagagagtttgctttatgcttcctcaagctttctcaatgtgaggaagatcgaatgtcagtttgtcttgatggaaatgaaggcaaacacaagccgaagtatgctgttcgcttcaataggattcctaacatatttattgagggaaaatcaggaaagacttggagatttcgctgcagatggtggttgacacgtcactttggcaagaacataatcaattctgaagttgcagcaggcaagttggaactcctaacctacaaagcagcctgcgcattgcatatgtacggacaagggtttgaatatgttacccatatggctgcctacagagcagacgacgactacgattacctcttcaaagtggtgttgattggagactctggcgtcggaaaatccaatctcctctccagattcacccgcaatgagttcagtctcgaatccaaatccactatcggtgttgaattcgccacccggagtattcgggtggatgacaagatcgtcaaggctcagatttgggacactgctggccaggagagataccgtgcaatcaccagtgcatactaccgaggtgctgttggtgcactccttgtctatgatgtcacccgacatgttacatttgagaatgtggagagatggttaaaggagctccgggatcatactgactcgcatattgtgataatgcttgttggcaacaagggagacttgcgtcacttgcgtgcagtttccattgatgatgccaaggcatttgctgagagagaaaacactttctttatggagacatctgcccttgagtccatgaatgttgagaatgcattcactgaagtgctcactcaaatatatcaagtggttagccggaaagcccttgatattggggatgaccctgctgctttgcctaaagggcaaaccattaatgttggaaccaaggatgatgtttcagctgtaaagaaagctggttgctgctcctcctaatagcagacgtgaatgatcaggaagtaggaagtagcctaccttctcttccttgccataaaatttcaagatttcctcaaggcaactcatggactatgaccctctaattttgcttctaatagtgtcagtttgattgaatggtggagcttgactgagcttggccaaaacttttgagtctagaggaattcagctttcttccggattctcttttcatctggtgccaagaatttcataatatttactttagtttttgcccactttgtgtattgtttcacttactttttaactgctatagcttgtgctgtttttagttttttctagattagaaatgttgtgggacaagcagtaaaattttgtatctgattgaatgatagttgttcaatgctggaagatgaaattgatgaattatttcctccataatgtcttagtaaagaggctcctcaataaagcatctggaatttcatgcagtccctgaattgtgttttacaggcgatgataaatgctcaaactatgtgaccgtaactgtgcttcgtgcttgcactactatttcaaattatagcttgtctttctattgtttgttttttctttttcatttcttggattttctttctttctgttgtaagattctaccaggctagctaaggcagcaaagctttcttggcattgtctggaggtaggggcaaacactggcttcttcactctgctaatctcatctaacttccctgcaatattcagcattttgagtagcttttacaattctctttgatgcatct

SEQ ID NO: 3197 - DNA, 1093 bp, Humulus lupulus
cggccggggactttgaatgtctctccctcccgtgcgctgtacacaactctctctctctctctctctctgtttaaacggctcacattctctgtttctctctctaagaaaaactttgccaagatctgatttttgttattattcttcctccattttatatttcttccataaattttgcctaaaaataatcgaatccaagagactgaattgaataaaatgggggcatacaggacggacgacgactatgactaccttttcaaggtcgttttgataggagactccggcgtgggaaaatcgaatctcttgtctcggttcacccggaacgagttcagcctcgaatccaagtccaccattggtgtcgagttcgccactcgcagtattcaggtcgatgataaggtcgtcaaggctcagatttgggacaccgctggccaagaaaggtaccgtgcaataacaagtgcatactatcgaggagctgtcggtgcattgctcgtctatgatgttactaggcatgttacattcgagaatgttgagagatggttgaaggagctccgggatcataccgatgccaacattgtggtaatgcttgttggaaacaaggcagacttgaggcacttacgtgccatttcaacagaggatgccacagcatttgccgaaagagagaataccttcttcatggaaacctctgccttagagtccttgaatgttgagaattcattcactgaggtgctcactcagatatatcgtgtggtcagcaagaaagctcttgacattggagacgatccagcagccttgcccaaggggcaaaccattagtgttggcaaagatgatgtttctgctgtgaaaaaggttggatgttgctcctctgtatagtttgtggaatgaagagtcctggtgtcatgaacacttaatctctattttctggaatgtggtttagtaccaccacttaatggaaatatgagaaattggatcgaattgaatgtgcattctggtatcatgttctatctggaagacgctagaaaagtcattttaaggttcactgaagaccctgctttggacgaaagagattcatttatgtcgttggtcagtttcttttttt

SEQ ID NO: 3198 - DNA, 1234 bp, Lotus japonicus
ctcagtttctgttttcgcagaacaaaacaaccaacctagcacaaaacaaaaacatgctttatttctttccattctcaccgacccatttgatttgacattgttaccacccattcaaaaacacaaaaccagaatcaaagtcaaaactttcctcgaccccactagttttctctcccccatttgatagaaaataaattttcaaaaagtaagggtttgtgaatgggggcgtacagagctgatgatgattacgattatctgttcaaggtggtgttgattggggactcaggtgtgggaaaatccaatcttctttcaaggttcaccaagaatgagttcagccttgaatccaagtccaccattggggttgaatttgccaccagaagcattagggttgatgataaggttgtcaaggctcaaatttgggatactgctggtcaagaaaggtaccgagcaataacaagtgcatattatcgaggagctgttggcgctttactagtctatgatgttacccgccatgtaacattcgaaaatgtggagagatggctgaaagagctgagagatcacacagataccaacattgttgtgatgctcgtagggaacaaagcggatctgcgtcatttgcgagcggtttccactgaagattctacggcttttgctgaacgagagaacacatttttcatggaaacatctgcccttgaatcgttgaatgtggaaaacgccttcacagaagtgttgacccagatctatcgcgttgtgagcaagaaggcccttgagattggtgatgatccagctgctttaccaaaaggacagacaattaatgttgggtcccgtgatgatgtatcagctgtgaagaaaagtggatgttgttcttcttgagtatgtagtaaaagtccctgtattcttactttatctatgtcttgtttataccatgtagagaatgagctgacagcatgaagatgattgtttagatagcatcaaactataattttttttttgctttggtttgtgagaattatgcattctcattttgcataatccttatttttgtgttggcttgtgagagagggttagagagatctccatacacatttggcaaagagccaatcacactagtgaaccgggtactacatctttcacccataaccttaaggcacattggatgtatgagtccttttgcttataacaacactttcatttacatccaatgttggactctgactctcatttgagtttccaacat

SEQ ID NO: 3199 - DNA, 998 bp, Nicotiana benthamiana
taaaatctttgaatagggtgtccctctcctccttgtaccggtgctccactccgctcctctttctccatttcttcccaaacccatcatctgttcttctacacagacacacactgagagacctagaatagacagtaatgggcgcatacagagcggacgacgattacgattatttattcaaggttgtattgatcggcgattccggcgtcggtaaatccaacctcctctccagattcactcgcaatgagttcagtctcgagtcaaagtcaacgatcggcgttgaatttgccactcgtagcattcgtgtagatgataaagtcgtcaaggctcagatttgggataccgccggtcaagaacgatatcgtgcaatcacaagtgcctactatcgaggagctgtcggtgcattgcttgtctatgatgtcactcgtcatgtaacctttgagaatgtagagagatggttaaaagagctccgagaccacaccgactctagcattgtcataatgctggtgggtaataaggccgatttgcgtcatctgcgggctgtttcaactgaggatgccaaggcgtttgctgagaaggaaagtacgtttttcatggaaacatctgcattggagtccatgaacgtggacaatgccttcacagaagtgctcactcaaatacaccgcgttgttagcaggaaagctcttgaagtaggagatgaccctgcagcattgccgaaggggcagactattaatgttggagggaaggatgatgtttctgaagtaaagaaagccgggtgctgttcttcttagaacaaagagtaatacaaatggttgaagagattctctttgttttgagcgcaaaaattgacatggctgttgtacttcccgctatatactaggaagtaaccacatggattgcttatcaatgagagctttattaactggaccttttgggcattactgaattgagtgcagcccaagattgattatccaagtgacttcatagcattctttatcctt

SEQ ID NO: 3200 - DNA, 1302 bp, Quercus alba
atggggatcgccattataacaacaatattatctttgaacaaccaataataaactccatatttccagctcgcactgcgcagcccacaaatctataacacaaacacaaaagcaacaatatacttctcttcgaaacaaaaagtaaataaaaaacccatttcttaaaataataatactatactacttttcaacaattgtctctcatattttctttgtataccaaacagagagagagagagagagttgtgtatgaaatgggggcttacagagcagatgatgattacgattacttgtttaaggtggtgctgatcggggactccggtgtcggcaaatcgaacctgttgtcgaggttcacgaagaacgagtttagccttgaatccaagtccaccattggggtcgagttcgccaccagaagtattcgtgtcgatgaaaaggttgtcaaggctcagatttgggacactgctggccaagaaaggtatcgtgcaatcacaagtgcctattatcgaggtgctgttggtgccttactagtctatgatgttacccgccatgttacatttgaaaatgtggagagatggctgaaggagcttcgggatcacacagatgccaacattgtgatcatgcttgtaggaaacaaagcagacctgcggcacctgcgagcagttgccactgaagatgccaaagcatttgctgaacgagagaacacctttttcatggaaacatctgcccttgagtccatgaatgttgagaatgccttcacagaagtgctgacccaaatttatcatgttgtaagcaggaaggccctggaggttggggatgacccagcagccgtacccaaaggagaaacaatcaatgttggaaccaaggatgatgtatcagctgtgaagaaagttggatgttgctctacttgagcatggagagtttaaaatacattctctttgaaattctatcccatgttcatatctttgtagagatcagcaactgaatgaaaagtgatttctatagaatatttacagtgtgaacttgtctaccttagctgaaaatttaggatccaaaagatatgtgcctgttcttttctatgattgaatttaaagtacctgcgtccccactttaccctttttgtattactaaaattactcagctgcttcagttttttatcaagtttgatcgttttgggctataaaagttcaaagactggtggttgaatggaaagtgaaaatgatcattttttcccttattttatgtctttttagacatgtatgtgtaaacgtttgattgctgttattagattttgacccagctaatttg

SEQ ID NO: 3201 - DNA, 1327 bp, Quercus alba
ctcttccatcgtagtattttacaaatacaagcatcctctctccctctctctctctcaatctcaaatgcgaagaaattcaaaaaccatttcccgatcccattgaaatcaaatccaaacctattttcatattctgatccttcaaatcctcgtttcctacctcaaatttcaagctcaaaagacaaacgaacaaaataaaatgggggcgtatagagcggacgacgactacgactacctattcaaggtggtgctaatcggcgactcaggcgtcggcaagtccaatctgctttccaggttcacgcgaaacgagttcagcctcgagtccaaatccaccatcggcgtcgaattcgctacgcgtagcattcatgtcgatgacaaggtcgtcaaggcccagatttgggatactgccggccaagaaagatatcgtgcaatcacaagtgcatactacagaggagctgttggtgcattgcttgtctatgatgtcactagacatgtcacttttgaaaatgtggagagatggttaaaggagcttcgtgatcatactgattccaacattgtcatcatgcttgtgggaaacaaggcagatttgcgtcacttgcgtgctgtttcaactgaggatgccacagcttttgccgagagagagaatacctttttcatggaaacctctgccctagagtccttgaatgtggaaaatgccttcactgaagtgctctctcagatatatcgtgtagtcagcaggaaggctcttgatgttggggatgacccaggagccttgcccaagggacagactattaatgttggctctaaagatgatgtatcagccgtgaaaaaagttggatgctgctctgcatagcctctgcaaatggtgaaagccctgttggtataaaatagtatcttttgctttcaattttttttcttttttaatttttaatttctatgttggtttagaacatctaagtctttgttacacgatagaatgagaccacatgggaatgcttagtgaacaaatcatgtctatgacgtatcatgcaccaaggctttagaatcttgttggagttacgatgaaggccctggtatttagatgtaaagtattttttttccccctgcatttgttgcacgctcattctctcactttttgcttcttttcttttcacattctctcagagtattattctagttcatagctggtttgtgtctatttgattaggttacatttgattgtgcaatttggagttttgaggtttactacgatatttgtgttattgtatttaattgattgaccagatggtattgaaattcagtttgctttagttaaaaaaaaaaaaaaaaa

SEQ ID NO: 3202 - DNA, 1342 bp, Citrus sinensis
aaaaaaacccctcgtttcaatttacaaagtagaaacaaagaaaacaaacgaaacaaaaacgtgctcgtttgacactaaaaactattaaatcccaaaacccgctcgtgttttacgttttttgtagaagcatttattaaaatctctttcgcgtcagatgatctgctaatcccaaaaaaattaattaaggaatatacaaatacataagagaacaaaaagagaaatgggtgcgtacagagcggacgatgactatgattatttgttcaaggtggttttgatcggcgactccggcgtcggaaaatcgaaccttttgtccaggttcacacgcaacgagtttagcctcgaatcaaagtccaccattggcgtcgagtttgctactcggagtatccgttgtgatgataagatcgtcaaggctcagatttgggataccgccggccaagaaaggtatcgtgcaatcacaagtgcatactatcgaggggctgttggtgctttgctggtctatgatgtcacgcgtcatgttacatttgaaaatgtagagcgatggctgaaggagctccgagatcacacagattcaaacattgtgatcatgcttgttggtaacaaagcagatctgcgccacctgagagcagtttccactgaagatgccacagcttttgcagaacgagaaaacactttttttatggaaacatctgcccttgagtccatgaatgtggagaatgcattcacagaggtgctgacccagatctatcgtgttgtaagcaggaaggctctcgaaattggagatgacccagcagctttgcccaagggacagacaatcaatgttggaactaaagatgacgtatcagcggtaaagaaagtcggatgttgttcaaactaaataatgaggcaaggccgaaagaatattgtctttgacattctgcacgccctgttcatatcccataagaggtttgcctggtacatgactaagtattaaccaaatttgaacggtttgaacttgtgactttaggagagaagaaatctgttttcagcccatgatctaggatctgcgacatatttagctggtttattttattttctttgatgctgtttgaactagatgctatcttgtgcatttacatcaatcacccaactgctgtagatttagctcaacactgttgtcatgggttgtaaattatgaagattgactttaatgctacgaggagagataactttccactactatgtatactgtatactgtttttccggtctgttacatctgtttcacattctaatagaagagtgccttagcatccgggagggaaaaaatcctgatgctcgtgaccataaatgctatcattttatttc

SEQ ID NO: 3203 - DNA, 1096 bp, Capsicum annuum
tctctctcttccttctccaaattttcatcgtactccgtgcccccaccgccccccaaaaaaagttttttcctcttcaaaaatgggggcatacagagcggaagacgattacgattacttgttcaaagtagtattaatcggtgattctggtgtgggtaaatcaaacctgctttccagattcagtcgcaatgagttcagccttgagtctaagtccaccatcggagttgaattcgctacaaggagtattcatgttgaggataaagttgttaaagctcagatttgggatactgctggtcaggaacgatatcgagctatcactagtgcttactatcgaggagctgttggtgcattgctggtttatgatgtcactcgtcatgtgactttcgagaatgtagagagatggttgaaggagctcagagatcatactgactcaaacattgtcataatgcttgtgggaaataaggcagatttgcgtcacttacgagctgtttccaccgaggatgccaaggcatttgctgagaaggagagtactttctttatggaaacatctgctctggaatccatgaatgtggagaacgccttcacggaagtgctcacacaaatataccgtgtcgtgagcaagaaagctcttgaagcgggagatgacccggcagcattgcctcaggggcagaccattaatgttggaaacaaggatgatgtttcagcagtaaagaaagttgggtgctgttccgcgtaaaacaagctctattccaacttttgagcttcaaattttcttgtagcagtgttacttctcctattgaatagaccaaatgaatcgttagccgtgagaggctgagagctttagttttctcgtgctcaagtatggattggagctacccctcccacacacccatctttcctcgagttcctcaacattctttatccttgtctctatgtttgtcttagcttaagtgtatgattgtagtatagcttcttatggatgtcttggatagggtgtactgtgatggcaacgattgaaccaagactgctgcactagatttatcaaaccattcatatgttttttccaatgctattttccgtatacaatccatttttatct

SEQ ID NO: 3204 - DNA, 1180 bp, Citrullus lanatus
caacccatttcgccataacgtttgcgagtgatcgtcttcaacaatttcaaaacctttccctgtgtttcttcatgccttggagctccacctgctgatccgttttcagacccatcgaattccagagtcatcggatccgacctcaataagtatggcagcctatagaacggacgacgattacgattacctctttaaagtggttctcatcggtgactcgggtgtgggcaaatccaatcttctctcaaggtttacgcgtaatgagttcagtcttgagtccaaatccacaatcggtgttgaatttgccactcggagtattcgggttgatgacaagatcgtcaaggctcagatttgggacaccgctggccaagaaagataccgtgcaatcacaagtgcatactatcgaggagctgttggtgcattgcttgtctatgatgtcacacgacatgtgacattcgaaaatgttgagagatggttgaaagagcttagggatcacaccgattccaatattgtgataatgctagtcggcaataaggcagacttgcgacatctgcgtgctgtttcaactgaggatgccaaggcctttgcagagaaggagaacacattcttcatggagacatctgcccttgagtctctgaatgtcgagaatgcttttaccgaagtgctaacccaaatctatcgtgtagtctgcagaaaagcgctcgagattggtgaggatcctgcagcattgcctaaaggacaaaccattaacgttggaaacaaggatgatgtttctgcagtgaagaaagttggttgctgctcttcatgatatcgtcatttgaaaatgaggtacatcatcaaaaggagtaaaaggatgagttcatcatgctatgtcttgaatttccactcctggatttgctcaacaaacatttactttatggtcattttttatggtgctggagcttctcagagggttggattcatgtttggagtcttttgaaattgacacttcttattgtcaattccttatactttcttgtccgagctcactctataattgttttaatttttgtaatgtcccatagttttaatagtatcagattgttctagatagagagatctgttaaactgaaggttgtatgtaggtaaatgttcagttgttcaatgggagcagaattttttagtttcttcaattttgcatgttatg

SEQ ID NO: 3205 - DNA, 968 bp, Elaeis guineensis
caagaatcctcacgacgctgacgatccattccttcttcttctgaggcaagcgaagggcggcggaggagatcgtgctggccggaaaaggctgcagcggcggcggcggcggcggtggtggaggaatggcgtatagggcagacgacgactacgattacctcttcaaggtggtgctgatcggggactcgggggtggggaaatcgaacctgctgtcgaggtttgcgaggaatgagttcagcctcgagtccaagtccaccatcggcgtcgagttcgctacccggagcatccacgtcgaagataaggtcatcaaggcccagatttgggacaccgccggccaagagagataccgagctatcacaagtgcatattatcgaggagctgttggtgcactccttgtgtatgatgttactcgtcatatcacatttgagaatgtggaaagatggttaaaggaacttagggaccacacagattccaatattgtaataatgcttgttgggaacaaagctgatctgcgccaccttagagctgtttcaaccgaagatgcaaagggttttgctgagagggagaacaccttcttcatggagacatctgctctggagtcaatgaatgtggagaatgccttcactgaagtgctcactcagatctatcgtgtggtcagcaggaaggcacttgaagtaggagatgacccagcagcattgcctaagggccagaccattaatgtgggaaccaaggacgatgtatctgctgtaaagaaagttggttgctgctcagtttaggtctgcgaacaaggcttctgttggatacagtcattggattcttggaatactctgtacccattaaaaaattcttctgtggctaaatgattggttggtcactcgggctttttatcgcccattaaacaattacacatttcagtataactacaaaaaaaaaaactaagtaagaactacgtacgaacggaacgacaaacg

SEQ ID NO: 3206 - DNA, 1374 bp, Eucalyptus grandis
ttttgtttttttggctcgaaaagagagtagtccttgagacgaaggagaagctgcggtcacattcgacttcgacggtgtgcaagtccggacgggttcgggtcgaagcccgcccgcccgccccggaagaacgaaaaacagcggtccgctccgacccggcccgagcgtacacacctgaactcatttcacaatcgagcaccaccgtcggtcgccgagtcatcaaaattgacatcgcctctcctctaatgcctcggtcgtctctcttctcttccatttcgccctcgttctccacggccgttccaatccgacctcgccggaatctttgaatttccttttattgtttccgatcgaggggggtttcggccggcgggaggagctgcgaagatttccctcgcgcggcggatggcgggcgggtacagggccgacgacgattacgattacctgttcaaggtggtgctgatcggggactccggcgtcggcaagtccaatctgctgtccagattcacgcgcaacgagttcagcttggagtccaagtccacgatcggcgtcgaattcgccactcgcagcatccgcgtcgatgacaaggtcgtgaaggcccagatttgggacaccgccggccaagagaggtaccgagcaatcactagtgcatattaccgaggtgctgttggcgcattgcttgtctatgatgtaactcgtcatgtcacattcgagaacgtggagagatggttgaaggagctgcgggatcacaccgactctaacatcgttataatgcttgtggggaataaggctgatttgcgacatttacgtgctgtttctactgaagatgccacggcatttgcggaaaaggaaaataccttctttatggagacctctgcgctcgagtctatgaacgttgagaatgcgttcactgaagtgctcacccaaatacatcgagtagtcagtaggaaagcccttgaggctgggaatgaccctggagctcttcctaaaggacaaaccattaacgttggatcaaaggatgatgtctcagaagttaaaaaggtcggttgctgctcttcttgaggatttacccgtcaaacatttgaaggaaatgaaattttctccagtagtctcatgtgtccagatgctttagtttctctactctctttggttttcagttttctacttcatacttgttgtactctcacttgtataattctttccttttctctggctcttcccttcttttttctcttggggttgtgattgctctaaattattgggacaagctcgaaaattgtattctgatagcctagcttctgtatttgacttcatgagacgtgacttgcacggagaatagaacacaggcacatgatttcatttaagtccataggcattctt

SEQ ID NO: 3207 - DNA, 919 bp, Ricinus communis
aacaataatattgcattattaatccaagattctgatattcaagattaatacaaataggagaggaaaaaaaagcgtgaaataaatataaataaataattaaaaatgggagcatacagagcggatgatgattatgactatttgttcaaggtggtattgattggagattcaggtgttggcaaatctaatctcttatctcgttttaccagaaatgaattcagccttgaatccaaatccacaatcggagttgaattcgctacccgcagtatacacgttgatgataaggttgtcaaggcccagatttgggatactgctggccaagaaaggtatcgtgccatcacaagtgcatactatcgaggtgccgttggagctttacttgtatatgatgtcactcgccatgttacatttgagaatgtagagagatggctaaaggagctccgggatcacacggatgccaacattgtgatcatgctggtaggaaacaaggccgacctgcgtcatctgcgagctattaccatagaagacgccacagcatttgcccagcgtcagaatacctttttcatggagacatctgctctcgagtccatgaatgtggagaatgcattcacagaggtgctgacccagatataccgagttgtaagcaggaaggctcttgacattggagatgacccagcagctttgcccagagggcagacaatcaatgttggatcaagagatgacgtctcagctgttaaaaaggctggatgctgctcatcttaagtattgcctccgactccccaaaaaaacatatcatctttgaggatgttgtggagcttaattatgaagagaggtctaaagcctatcatactctgagattctttgccctgttcataccatacaagtctgcctgacaccatgaaaatgccatctcacaagatttatt

SEQ ID NO: 3208 - DNA, 984 bp, Trifolium pratense
tagctattatagcatcacgcacgcaccacaaaatcaatacaaaaataagttagtttctctgttttgttttccctcgtcgatagataatcatcaaatgggggcatatagagccgatgacgattacgattatctattcaaggttgttttgatcggtgattctggtgttggtaaatcaaatcttctttctagatttacaaaaaatgaattcagtctcgaatctaaatctaccattggtgttgaatttgctaccagaagcattcgtgttgatgataaggttgttaaggctcagatttgggatactgctggtcaagaaaggtaccgagcaattactagtgcttattatcgcggagctgttggcgctttgctagtttatgatgttaccaggcatgttacatttgaaaatgtggagagatggctaaaagagctgagagatcacacagatgccaacattgttgtgatgcttgtaggcaacaaagcagatctgcgtcatttacgagcagtttcgaccgaagattctacagcttttgcagaacgcgagaatacatttttcatggaaacatctgcccttgagtccttgaacgttgaaagtgccttcacagaagtgttgacgcagatctatcgtgttgtaagcaagaaggcccttgagattggtgatgatccagctgctttacctaaaggacagactattaatgttgggtcccgtgatgatgtatcagctgtgaagaaatctggatgttgttctgcttaagaatgttgtaaaagtctctgtatttttaccctgaaaatgatgtcatgtttataccatgtagagattgaactgacagcatgaagatggattgtttagagagttctgttcaatattagccaaatgtttaggaaacatacacatttattttaagtaatttatacttttggcattgtaagatattcattcattcatctaatttcaaaattttcatttctgacctaaaaaagaaaagagta

SEQ ID NO: 3209 - DNA, 1201 bp, Glycine max
tttcatttgcttgttgtttttcattttgatctgatatcatatcattcgagctctgaatgcttctctctccataataacaaaaccaacaccctctttctctttctctcttcttcatttccaatgctgcagcaatctgcaagcttcataggcactacgacagacccaattgaattcccgagaaagaattgaagagaaaaaaccgtaaagttaggatcttttgtgtgatttcgatgggtgcgtacagagcggacgatgattacgactacttgttcaaggtggtgttgatcggagactcaggcgttgggaaatcgaacctcttgtctcgtttcacgaagaacgaattcagcttggaatccaaatccaccattggcgtcgaattcgccacccgcagcatccacgtcgatgacaagatcgtcaaggctcaaatttgggacacggcaggccaagaaagatatcgcgcaatcacaagtgcatattatcgaggggctgttggtgcactgcttgtgtatgatgttaccagacatgtgacttttgaaaacgtggagagatggttaaaggagcttcgtgatcacacagatgccaacattgtaatcatgcttgtggggaacaaggcggatcttcgtcacttgcgtgctgtctccacagacgatgccaaggcatttgccgagagagaaaatacgtttttcatggaaacatctgctcttgagtccttgaatgtcgataatgccttcaccgaagtgctcactcagatataccgcgttgttagtaggaagactcttgagattggggatgaccctgcagccttgcccaaggggcagaccatcaatgttggcagtagggatgatgtctcagctgttaaaaagtctggatgctgctctgcttagtttcacaagccttttgcagcagaatagaataatatctatatgtgcatgattcaaccaattctcaacattttggagtccaagtgaaatcttttaatacctacacttctctttttatgtagtttttcccacatatcttggcaagtttattgttttctctttttctttttcttttcttttcatgtaagtgtttggtcataggaatgatgtcttgttgttcttaaatatacaaaatatactgtttgtattgagtgaaagtgatatttggttcttagattgatcagaagttacaatctcatcattcttcctcaaattttcca

SEQ ID NO: 3210 - DNA, 1134 bp, Malus domestica
aaaacccgttcaccacataactcacagacacacatacatccactgccatcgccatgattcttcattatttataaccaagtttcccaaaacccatcatcccagaactccctcagattccttccaaatcgaaagtaaaagacaaacccaagagcaaaaacacgacaaaaattcgctcctttttttgcagtatttgaattttggagaggagatgggggcgtacagagccgacgacgattacgattacttgttcaaggtggtgttgatcggcgactcgggcgtcggaaaatcgaaccttttggcgcggttcacgaagaacgagttcagcctcgaatccaagtccaccattggcgtcgagttcgccaccagaagcattcgggtcgatgataaggtcgtcaaggcccagatttgggacaccgccggccaggaaaggtatcgtgcgatcacaagcgcatactatcgaggtgccgttggggccttgcttgtctatgacgttactcgtcatgttacgtttgaaaatgtggaaagatggttgaaggagcttcgcgatcacacagatgccaacattgtgatcatgctggtgggaaacaagggagatctgcgtcacctgcgagccgtttccaccgatgatgctaaggcgtttgccgaacgagagaacacctttttcatggaaacttctgccctcgagtccatgaatgtcgaaaatgctttcaccgaagtgctgacccaaatccatcgtgttgtgagcaggaaggaccttgacatcggggatgacccagcagccttgcccaagggacagacgatcaatgttgggggcaaggatgacgtatcagctgtgaagcaagacgggtgttgttctacgtaaaatttgaaggaattgttccaagtgcctttcggagttctatcgggcgaggtcatgtctaattgtccatgcagatgttggcctgactccatgaaattgcttttctcgacaggatgctaactctttgaacattatgctttagatgctcgtaagcttgtccatgttacccaaaaatttaggatgttaagatcatgttgtttttttcctttgattcgatttgaacgacttgcttcccgttgtgtactattgttctttcttggttgagttttatataa

SEQ ID NO: 3211 - DNA, 1182 bp, Phaseolus vulgaris
ttttggaggcatgggtgtaacacattgtattcttttatggaactcgttgatttgttaacggttaacagttacaaaagtgaagttccccttcattttaccctacttctaaatctgggttttttcttttcaattccaattccaacaaagcatgcttctctttttcttccattcaccccaccgcatttgattttctctttctctctctcttctcttttacccctctccaaatccaaacatacacaacaaaagaggaggaacgataaatgggggcgtacagagccgacgacgattacgattacttgttcaaggtggtcctcatcggtgactccggcgtcggcaaatcaaaccttctttctcgcttcacgcgaaacgagttcagcctcgaatccaagtccaccattggcgttgagttcgccaccagaagcattcgcgtcgatgataaggttgtcaaggctcagatttgggacactgctggccaagaaaggtaccgagcaattacaagtgcatattatcgtggagctgttggtgctttactagtatatgatgttacgcgtcatgttacttttgaaaatgtggagagatggctaaaagagctgagagatcacacagatgccaacattgtggtgatgcttgtagggaacaaagcagacctgcgtcatctgcgagcagtttccaccgaagatgctacaagtttcgccgagcgagagagtactttttttatggaaacatctgccctggaatcattgaacgttgaaaatgccttcacagaagtgctgacccagatctatcatgttgtaagcaagaaggcccttgagattggagacgatccagctgctttaccaaaagggcaaacaattaatgttggttcccgtgatgatgtatcagcaatgaagaaagctggatgttgttctgcttgagtgtgtagtaaaagtcagtctctgtagtttttcttgaaaacacatgccttgtttataccatgtagagatttacctcacaacatgaatatgattgtttaaagagcatcaaactttaatgtttctgctttggtgtgtagagaattgtattcaatattagccagatgctttttaggaaacaagcacattcgtttttgcatttttcctatttttctgcattttaagatatttagttatttaatgtccaatttattggtatcgttctttt

SEQ ID NO: 3212 - DNA, 1256 bp, Beta vulgaris
atccaacctaccactcccaccatttagattttacatttacactctcactcttctctctctactttactccaattcatatctctactttctccagatcccaaacctctatttctcattctttctatattcaattcaattcaattaaatggggtatagagcagatgatgattacgattacttattcaaagttgtgttaattggtgattctggtgtcggaaaatccaacctactatctcgattcactcggaatgaatttagtctcgagtctaaatccaccattggcgttgaattcgcaactcgtagcattcacgttgatgataaagtcgtcaaagctcaaatttgggatactgctggccaagaaaggtaccgggcaattactagtgcttattatcgtggtgctgttggtgctttgcttgtctatgatgtcactcgtcacgtcacatttgagaatgttgagagatggttgaaagagctccgagaccatacagattctaatattgtaatcatgcttgtgggaaataaggcagatttacggcatttgcgggctgtttccaccgaagatgcacagacatttgctgagaaggaaaaaacctactttatggaaacctctgccctggagtcattgaacgtcgaaaatgctttcacggaggtgcttacacaaatatatcgagttgtcagcagaaaagctctggaggctggggatgaccctgctgctgtgccgaagggacaaaccattaatgtgaaggatgatgtatctgcggtgaaaaaagttggatgctgttccacatagtgtggagtgtcaatcgagttgagggtggtaaagtcatgtgtaatatgacacagggttacttcaaattgtgggtgttactggaagcatcaaacacacattagagagcttctttgcatattttagtgtcatgttttatctgttcatctcaggcttcaagaattagtttacttgattcaatgagatctgaggtggacctcatttctgcttccgtctcaccttaccaagatttttctcatatcaaagctgtatttttagcttccatattctgattaaatttaaaatctgaagattgagcttaattgtttcagttgattactgtaagttttctcatctactagggtcctgtttttacatgaagcccttgaaactgggatagtttgatatttgccattattacggacttgtttgttttgtactcattcttatgtattctctaccgcctagacatgcatttataagaaaaaac

SEQ ID NO: 3213 - DNA, 1256 bp, Theobroma cacao
ttaattgggccggatcaccaaattcattaccttacttgacccaatccttatcccctccggaatctaaccccgcatttcactttatttttgccaatgtcgaaatctctctctctccctctctaatgccaccgatctctgccatttgataaaaatttcctcgaaaaatccaattttttaaaataaatccgataaaaagattccaacccggtgacccgaaatggcggcatatagagcggatgacgactatgattatttgttcaaggtggtgctgatcggggattcgggtgtggggaaatcgaacttgttgtctagatttacgaggaacgagtttagccttgaatccaaatccacaatcggagtcgaattcgccacccgaagcattcgggtagatgataagatcgttaaggcccagatttgggacaccgctggacaagaaagataccgagcaattacaagtgcgtactaccgaggagctgttggtgcattgctcgtctatgatgttactcgacatgtcacatttgagaatgttgagagatggttgaaggagctacgagatcacacggactccaatattgtcattatgcttgttggcaacaaggcggacctgcgacacttgcgtgctgtttccactgaggatgctaaggcctttgccgagagagaaaataccttctttatggagacatctgcccttgagtcaatgaatgttgaaaatgcattcacggaagtgttaagtcaaatatatcgtgtggtcagtcgaaaagcactcgaggtaggggacgatcctgcagccttgcctaagggacaaaccatcaatgttggaagcaaggatgatgtttcggccatcaagaaagttggctgctgttctgcttaaatgtttgatgattttgggcatccaagtttcctccctttttcatctctttaagcgcaatacgttcctctttgtgttatggtccttgagcttcctctagccttgaatttgaaggcagagaagatgcagcatctcgcaattttccttttttttttttttcatttgatttcagttcctttttcatggttctttatttcttttagggtatttttcttcctcgtgtaatgttccattccatttccatagttttgatagtttttgttgtatttgattgctttagaatacatagtttgttcagacagatgtagttttggaatcttaaatgatttttattagttgtggatcataaaatttgaattagctatgataatatatattaattccttca

SEQ ID NO: 3214 - DNA, 1789 bp, Ricinus communis
tgtgtcattgtctctcaaaagaaaaaaaaaatgctctcatttataggttaataatgacaacaataatattgcattattaatccaagattctgatattcaagattaatacaaataggagaggaaaaaaaagcgtgaaataaatataaataaataattaaaaatgggagcatacagagcggatgatgattatgactatttgttcaaggtggtattgattggagattcaggtgttggcaaatctaatctcttatctcgttttaccagaaatgaattcagccttgaatccaaatccacaatcggagttgaattcgctacccgcagtatacacgttgatgataaggttgtcaaggcccagatttgggatactgctggccaagaaaggtatcgtgccatcacaagtgcatactatcgaggtgccgttggagctttacttgtatatgatgtcactcgccatgttacatttgagaatgtagagagatggctaaaggagctccgggatcacacggatgccaacattgtgatcatgctggtaggaaacaaggccgacctgcgtcatctgcgagctattaccatagaagacgccacagcatttgcccagcgtcagaatacctttttcatggagacatctgctctcgagtccatgaatgtggagaatgcattcacagaggtgctgacccagatataccgagttgtaagcaggaaggctcttgacattggagatgacccagcagctttgcccagagggcagacaatcaatgttggatcaagagatgacgtctcagctgttaaaaaggctggatgctgctcatcttaagtattgcctccgactccccaaaaaaacatatcatctttgaggatgttgtggagcttaattatgaagagaggtctaaagcctatcatactctgagattctttgccctgttcataccatacaagtctgcctgacaccatgaaaatgccatctcacaagatttattagccgtctaaactttgtgctctaaaactgaagagagcctgtcaggtaaaagatgtaggatctgataaaacgaaaaagtgcagttttattttctttctgtgtcattaatgttgtgaactacttgctttcccatttgtcctctttaataactcatttgctgcagttttatgtacagttgggttgtttgggttcaattacatgtaatatagctttctcaatcactgagcaatattgtgtttggactgaacaatgtattgcgatcttgctatttttctattacgttccatatgtgctccaaaattccagataggctgcaataacataaaagtgaatacatgcttttcttacttcatatatcatcatccaaacatttgccatctcctgttactctgctttcatcaggcaccttattctttccataatcagtacattcatgctagggttttggttatactggtttgtcgtacttcttgtatgaggttggggaaacattacagatctgtctcgcacacaggtactggtactggctaaccttaactagacaattgaaatgccattgtatagcatctctaatggaagattctcaagaacagacttcctcaacaatatcattcacgcttacttgaaagagaatttccttggacaaaatatcattttacaagcatgtaagcaatcttattttttaggatagacatgcccaaacatatcggactcaatttgataagattatgaagaacccaacatgactcaaattttatgaaactatacatcaaaaccgtcagaaagtttagctgtatacccgccgatgcagtg

SEQ ID NO: 3215 - DNA, 1450 bp, Citrus clementina
taattaattagttataaccagctgggggggtaattagtagttaatctcaaaaaagcattgaaaagtgaaagccttgctcccgtccctctcttccaccacccttcctaaaaggcaatgttaataacatcactcaaacaagaagaagaagaatagcgaaagcgttagattttcttgatctgttcccatcatcaacttcacctcacctgtcttgcacacacactcacacttatctctctctctctctctattgcgttaattgcataatacacaattcaataagagaggaggggaaaaaaagaagaagagagaaattgaaaaaaatgggagcatacagagctgacgacgactacgattacttgttcaaggtggtgttaattggagattcaggagttgggaaatcaaatctgttatctcgattcactaagaacgaattcagcctcgaatcgaaatccaccatcggcgtcgaattcgccactcgcagcattcgcgtcgacgacaaggtcgtcaaggctcagatttgggacaccgccggccaagaacgatatcgtgctatcacaagtgcgtactaccggggagctgttggtgccttgcttgtctatgatgtcacccgacatgttacttttgagaatgttgagagatggttgaaagagcttcgggatcacacagactcaaacattgtgataatgcttgtgggtaacaaggctgatttgcgtcacttgcgtgctgtttcaactgaggatgctcagtcgttcgctgagaaagagaacactttcttcatggaaacctctgccctagagtcgttgaatgttgaaaatgccttcaccgaagtgctcactcagatatatcgagttgttagtaggaaggctcttgatgtaggtgatgacccagcagccttgcccaagggtcaaactattaatattggtactaaagatgatgtatcggctgtgaaaaagactggatgctgctctgcataatctgcagcttcgaaggaaaatccaggtggtaaaaaatagtttctcctctttctagaacttacatttccatggcttggagacatcttggctttgatctgcttgccaggacgagacaacatggagtgcgggaagaaattatagttttacatttcatcatgtaccggtaatctcaaaatcttgcttgagttaggttaaagccataatcatttggatctgaaatctcatgtttgtgcaagagcctactgtttttctcttattgtattgtctctgtttgtctccaaaaaatattgtagtatgttatcagctcctaagctctaggatagtttatatttggtttctgaggactggaatttgggaagtatgttaagataattctgttcttaaacttgattgattgattgattattttgtactgaaatttatattcacatcattcatttgcaacccaactaggaaatcatcaatcttttctttga

SEQ ID NO: 3216 - DNA, 1234 bp, Citrus clementina
ctccacgtttcttcttcagttctctttctcatttgaacaaatctcactttcacatgtcactgtttcatttcaccatttcctaatccatttgccattgacccgacccgaataatttaaatggcggcttacagagcagacgaggactacgattatctatacaaagttgttttgattggcgattcgggtgtgggcaagtccaatttgctgtcgagattcacccgtaatgagttcagtttagaatccaagtcaacaatcggagtcgaattcgccacccggagcattcgggtcgaagataaaatcgtcaaggctcagatttgggacactgctggccaagaaagatatcgagcaattacaagtgcatattaccgaggagctgttggcgcattgcttgtctatgatgttacgcgacatgtcacatttgagaatgttgagagatggttgaaagaattgcggggtcacacagactccaatatcgtcattatgcttgtgggtaacaaagctgacttgcgtcacttgcgtgctgtttctacagaagatgctaaagcctttgcagaaagggaaaacacattctttatggagacatcagctctggagtctatgaatgttgaaaatgcattcacagaagtgctaacgcaaatctatcatgttgttagccgaaaagcacttgatatagggggtgatcctgcagccttgcccaagggacaaacgattaatgttggaggcaaggatgatgtctcggctgttaagaaagtgggttgctgcaatgcttaaatgaaggctaatgatggagtgtactgatcatatttcctcctatttcagtcatataaattcaagagtttcacatgtcatgaatcaagatgtggcccccttgcacttggatttggctgtgacacataataaccttcaatgaggcttatttatgggatggagttgaaagaagttgctgctgcaattgacacctgtttctcaatgctcaatgctcaatgctctttccttgtttgcattgttttagtagtttttgttgtattttggtttctatagaatagaaattttttttctttctgacaattttgcttttgtattctttaaattaagctgtcttctgctgattacatacctaatactattagttcatcatattcatccatatgtatgtacagtatatcagtgagaagagaacaacaatgacctgtcatcatcaaatgctctattttgctaagttcttattatattt

SEQ ID NO: 3217 - DNA, 1034 bp, Fagopyrum esculentum
ctcccttccctatctctaagctttctctctcttcccaccgctttccagtatccagatccatactcagatcttcactctctcttgaagatactctacttgcaactctgctagtaagcttcctctcccctatccatttccactgctttcagatctgaggaacttcgttcttcttaccagcagaaaacaagctgatggggttcagagcagacgacgattacgattaccttttcaaggtcgtgttgatcggcgactccggtgtcggtaaatccaacctcctctctcgattcactcgcaatgagttcagccttgagtctaaatcaaccattggtgttgaattcgctactcgtagcattcatgttgatgataaggtcgtaaaagcccaaatttgggacactgctggccaagaaagataccgtgccataacaagtgcatactaccgaggagcagttggtgcgctgcttgtctacgatgtcactcgtcatgtaacatttgagaacgtagagagatggttgaaggagcttcgagaccacacggactcgagcatagtgatcatgctggtgggaaacaaagcagatttacgccacttgcgagctgtatcaactgaggacgccacagcatttgctgagaaggagcaaacagtcttcatggagacctctgcactcgagtctctgaacgtggaaaacgccttcacagaggttctaacacagatatatagggttgttagcaaaaaggctcttgaaggtggggatgacccgggttctgtaccaaaggggcaaaccatcaacgtgggaagcaaggatgatgtctctgctgtgaagaaagctggatgctgctcctcttagtatcagcagttggaagattgaaatttaagatgagttggtgtgttatgccaggtattaggcagatttgttgtgttttagtagctaatgttatatttttatctatatgtaatgtttatttgttgcactttcgttgaccttcattgagactcttgaaacttaaaagttgaaagggtatatactacttccttagtt

SEQ ID NO: 3218 - DNA, 1083 bp, Panax ginseng
tacatttcttctctctctctctaaaatacatacatacatactatatgtatttacatctatatctcttaatttcgtttcgtcgttagagagtgaaaaagggtttgaattttgaaaacaaacggacagaaatttgatacttcctataactttctatggcggcgtacagagccgacgatgactacgattatctcttcaaggttgtgttgatcggagattcaggtgtcggaaaatcaaatcttctctccagattcactaaaaacgagtttagtttggaatctaaatctacaatcggtgttgaattcgccaccagaagtattcgcgtcgatgataagatcgtcaaggcccagatttgggacaccgctggccaagaaagatatcgtgcaatcacaagtgcatactaccgaggggcagttggtgcattggttgtctatgatgtcacccgacatgtcacgtttgagaatgttgagagatggttaaaagagctgcgagaccacacagatgccaatattgtgataatgctggtgggaaacaaggctgacttgcgtcacctgcgtgctgttgccactgacgatgcaaaggcctttgctgagagagaaagcactttctttatggagacatcagccctcgagtcgttgaatgttgagaatgcattcacggaagttctcagtcaaatatatcatgtagtcagccggaaagcacttgagattggggatgatcctgcagcattgcctaaggggcaaaccatcaatgttggcaaggatgatgtttcagcagtgaaaaaagttggttgctgctctgtctaactacaaaagtaaagcccatatttgagtgatataatttgaacttttcgagaactccacttagcagctctggtttgtcccaattatgtttcaatagttggaatggtttcagattatctgaggcttattactgattttggagtacgagtaaatgcatcatgagaaattttcatatatctaaggccagttcttcagtactattatctatcttaaagttttttttccttttttcccttgccctatctgtattgtttcattttggttacatcagttagtttgtatt

SEQ ID NO: 3219 - DNA, 1175 bp, Panax ginseng
tctctctctctctcaaatacatgcatacatactatatgtatttacatctatatctcttaatttcgtttcgtcgttagagtgaaaaagggtttgaattttgaaaacaaacggacagaaatttgatacttcctataactttctatggcggcgtacagagccgacgatgactacgattatctcttcaaggttgtgttgatcggagattcaggtgtcggaaaatcaaatcttctctccagattcactaaaaacgagtttagtttggaatctaaatctacaatcggtgttgaattcgctaccagaagtattcgcgtcgatgataagatcgtcaaggcccagatttgggacaccgctggccaagaaagatatcgtgcaatcacaagtgcatactaccgaggggcagttggtgcattggttgtctatgatgtcacccgacatgtcacgtttgagaatgttgagagatggttaaaagagctgcgagaccacacagatgccaatattgtgataatgctggtgggaaacaaggctgacttgcgtcacctgcgtgctgttgccactgacgatgcgaaggcctttgctgagagagaaagcactttctttatggagacatcagccctcgagtcgttgaatgttgagaatgcattcacggaagttctcagtcaaatatatcatgtagtcagccggaaagcacttgagattggggatgatcctgcagcattgcctaaggggcaaaccatcaatgttggcaaggatgatgtttcagcagtgaaaaaggttggttgctgctctgtctaactacataagtaaagcccatagttgagtgatatataatttgaacttttcaagaactccacttagcagctctggtttgtcccaattattccctattactgtttcaatagttggaatggattaagattatctgcgaggcttattgctgattttggagtaccgaggaaatgcatcatgagaatttttcatatatctaaggctagttcttcagtactattatctatctaaattttgtttttttcctttcccatctgtattgtttcatttggttacatctgtagtttgtattgtattttgttgcacggcattacattttggggctaggtttgaattttatacctacgcgtagttgaatgttggttctataaaatgagagttcctctagc

SEQ ID NO: 3220 - DNA, 813 bp, Carpinus betulus
cttaacttactgcacagcgattttctttctttccaaacggcttttaaagagagtttgtgcaggagatgggggcgtacagatcagacgatgattacgactacttgttcaaggtggtgttgatcggggactcgggtgtgggcaaatcgaacctgttgtcgcggttcacgaggaacgaatttagcctcgaatccaagtccacgattggcgtcgagttcgccacgagaagtattcgggtcgatgataaggtcgtcaaggcccagatttgggacaccgctggccaagaaaggtatcgtgcaatcacgagtgcctattatcgaggtgctgtgggtgctttactagtctacgacgttacccgacatgttacatttgaaaatgtggagagatggctgaaggagcttcgggatcacactgatgccaacattgtgatcatgcttgtaggaaacaaggcagacctgcggcacctgcgagccgtttccactgaagacgccacgtcttttgctgaacgagagggcacctttttcatggaaacatctgcccttgagtccctgaatgttgagaatgcattcacggaagtgctgactcaaatttatcatgttgtaagcaggaaggcccttgatgttggggatgacccagcagccttgcccaaaggaaaaacaatcaatgtcggagccaaggatgatgtatcagctgtgaagaaagtcggatgttgctctgcttgagcatggagaggagatgtaaaacttattatatttgaacttctatgccctgttcatatctttgtagaggtcagctgactgagcaaaagtgctgtag

SEQ ID NO: 3221 - DNA, 1184 bp, Lotus japonicus
ggatctgaagacagaaacagatatcattccagctttgaatgcttctccctcctcctcctcctcctgtaatcaaagaaattcaacgacccttttctctccaatgctgaaagtttcaagctttatacgcagttaccaaatcgaatgccttaaaaaccattaaccaaactgacccatttcattgaatctcagatcttttgaaacccctccatcaaagttcaaatccagctgaaggaagaagaaaaatgggtgcgtacagagcggatgatgattatgattacttgttcaaggtggttctgatcggagactctggcgttgggaaatccaatctattgtctcgattcaccaaaaatgagtttagcttggaatccaaatccaccattggtgttgaattcgccacccgcagtatccatgttgatgataagattgtaaaggcgcaaatttgggacaccgctggccaagaaagatatcgtgcaatcacaagcgcatattatcgaggagctgttggtgcattgcttgtgtatgatgttactagacatgtgacttttgaaaatgtggagagatggttaaaggaacttcgtgatcacacagatgccaacatcgtaattatgcttgtgggaaacaaggcagatcttcgtcacttgcgtgccgtgtccaccgatgatgccaaggggtttgctgaaagggaaaatacttttttcatggaaacctctgccctcgagtccttgaatgtcgacaatgctttcacagaggttctcactcagatatatcgagttgttagtaagaagacgctcgagatcggggatgaccctgcagccttgcccaaggggcagacaatcaatgttggcagtaaagatgatgtctcagctgttaaaaaggttggatgctgctcggcatagtttgagagagaatagaaaggaagctcttcacaacaaaacaacatatctatctgtgcatgattcaactaatcatcaatcctcaacattttgggatccatgtgaaatgttttaatacctacactttttgtcttttgtaatttttcccacatcttttgtcttgtttattactttctcaccttttttcccctctaagcattgtttggtctataggaatgatgtcattttacccttataggtatatgaaatttactctttgtattgaatgaaagggatatcctgttctaatct

SEQ ID NO: 3222 - DNA, 1199 bp, Medicago truncatula
tccccaaaacaaataaaatttgccaactaaaaacccccaacacaacacaacacaacacaacacacacattgctgtttcattcgattattagcttgtcgttgtgttgtaatgttaccttcgacgttattccaaatctggatttcatagtatgtttctctgattattaatacattcaaatcacagaaacccttttgaatctcaaacatacccaactcatcaaaatcattttttttcatccctgattgattctctctctgtagagaaaaagggggtgtgtttagcaaatgggggcgtatagagctgatgatgattatgattatctgtttaaggttgtgttgattggtgattctggtgttggaaaatccaaccttttgtcgagattcacaaaaaatgaatttagccttgaatctaaatccaccattggggttgaatttgcaaccagaagtattagggttgatgataaggttgttaaggctcagatttgggatactgctggtcaagaaaggtaccgagcaattacaagtgcatattatagaggagctgttggtgctttgctagtgtatgatgttacacgtcatgttacatttgaaaacgtggagaggtggttgaaggagctgagagaccacacagatgccaacattgtggtgatgcttgttgggaacaaagcagatttgcgtcatttgcgagcggtttcaactgaagattcgacagcttttgcagaaagagagaacacatttttcatggaaacctctgccctcgagtccatgaacgttgaaaatgccttcactgaagtgctgacacagatctaccgtgttgtgagcaagaaagcccttgagattggtgatgatccaacggcactaccgaaaggacagacaatcgatgttggatctcgggatgatgtatcggctgtgaagaaatcaggatgttgctctgcgtgagcttacagtaaaagtttctgtatttttacagtaaacatatccatgtctatattcttataaagagatcattctttctgcatgaaattgattgtctagactctagagagcatcactcctaactttcggcattggtctgtagcaaaatctgttcaatattagttagatgtttaggaaacgtgcactttcatttcgcttggttcgtgtttcttttgaaggtattcatttatctaatttcaggttttattgaatatttacggtggc

SEQ ID NO: 3223 - DNA, 1217 bp, Nicotiana benthamiana
agaatgaacgtgcctaagaatttgtaagtcataaaatctttgaatagctgtccctctcctcctggtagcggtgctccactccgctcctctttctgcatttcttcccaaacccatcatatctcctcttgtctttacacacacacactgagagacctagaatagacactaatgggcgcatacagagcggatgacgattacgattatttattcaaggttgtattgatcggcgattccggcgtcggtaaatccaacctcctctccagattcactcgcaacgagttcagtctcgagtcaaagtcaacgatcggcgttgaattcgccactcgtagcattcgtgtagatgataaagtcgtcaaggctcagatttgggataccgccggtcaagaacgatatcgcgcaatcacaagtgcctactatcgaggagctgtcggtgcattgcttgtctatgatgtcactcgtcatgtaacctttgagaatgtggagagatggttaaaagagctcagagaccacaccgactctagcattgtcataatgctggtgggtaataaggcagatttgcgtcatctgcgggctgtttcaactgaggatgccaaggcgtttgctgagaaggaaagtacgtttttcatggaaacatctgcattggagtccatgaacgtggacaatgccttcacagaagtgctcactcaaatacaccgcgttgttagcaggaaagctcttgaagtaggagatgaccctgcaacattgccgaaggggcagactattaatgttggagggaaggatgatgtttctgaagtaaagaaagccgggtgctgttcttcttagaacaaagagtagtaacacaaatggttgaagaggttctctttattttgagcgcaaaaattgacatggcagtggtacatctccctccatatagtaggaagtaaccacatggattgctcatcaatgagagctttattaactggaccactaggcattactgaattgagtgcagccccaagattgattatccaagtggcttcatagcattctttatcctcgtttctatattttacttcccttggtcaatgattatagtattagcttcttgtggacctccatgatagggtatatttgtttggaaaagatttgaactgatacatgtatgaacccattttatcctgccttgtacttgattgtttcattagttatggactgacgaatattttcaatttctcatg

SEQ ID NO: 3224 - DNA, 1060 bp, Nicotiana benthamiana
gtatctcttccttcaaatttatcctactctgtgcccccacccccacccccatccccacccccaatccttaaaattccttaaaatgggggcgtacagagcggatgacgactacgattatttgttcaaggtggttctaatcggtgattccggtgttggaaaatcgaaccttctgtccagattcagtcgtaatgagttcagcctggagtccaagtccaccatcggcgttgagttcgccactcgcagcattcgcgtcgaagataaggtcgttaaggctcagatttgggacaccgccggtcaagaacgatatcgtgcaatcacgagtgcctactatcgaggagctgttggtgcattgctggtttatgacgtcactcgtcatgtgacttttgagaatgtggagaggtggctaaaggagctcagagatcatactgactcaaacattgtgataatgcttgtggggaataaggcagatttgcgtcacttacgggctgtttccaccgaggatgccaaagcatttgctgagaaggagagtacttttttcatggaaacatctgctctggagtccatgaatgtggaaaatgccttcacagaagtgctcactcagatataccgtgtagtgagcaggaaagctcttgaagcaggagatgacccagtagcattgcccaaggggcagacaatcaatgttggaaataaggatgatgtttcagcagtaaagaaagttgggtgctgttctgcttaattcaaggactactctatatgttggaggatggttctttcttctttttgagttcaaattatcacgtggcagtggtatttctcctttttctgtacaaggaattaaccacatgaattgcttagccgtgagagctctagtttactggtgctcaacccaggatatgagctacaggtcccttcgagtgattcctcagcattctttctccttgtttctacatttgtcttagcttagtgtatgattgtagtatagtttcttatgaatctctaggaataggatgtattcgattacaaagattgaactgaagcgtgtttgaacagattatttcgc

SEQ ID NO: 3225 - DNA, 1207 bp, Cajanus cajan
tataaaagaagatgtagggaggagggtgaaaaaggtaaaaagaagcaaacccattgatttgctttgtttttgtgtgttgtgttagtttgtttgttttggatgtgaaggcattaaaagagaaatatcattctgaatgcttctccctccatatcatcatatccttctcttctgtcacattccaatgctgaaactcgcaacccccattggcaccgacccagttcaattcccgagaagcgattgaagaaaaaagcgcaaagttaggatctttggatcgaaagagaaggaagagggaaaatgggtgcctacagagcggacgatgattacgactacttgttcaaggttgtcttgatcggtgactccggcgtcggaaaatccaatctcttgtctcgattcaccaaaaacgaattcagcttggaatctaaatccaccattggcgttgaattcgccactcgcagcatccacgtcgatgataagatcgtaaaggcgcaaatttgggacactgcaggccaagagagatatcgtgcaatcacaagtgcatactatcgaggtgctgttggtgcattgcttgtgtatgatgttaccagacacgtgacatttgaaaacgtggagagatggttaaaggagcttcgtgatcacacagatgccaacattgtaattatgttcgtggggaacaaggcagacctccgccacctgagggcggtgtccaccgacgacgcgaaggcgttcgccgagagagaaaacacatttttcatggaaacatctgctctggagtccttgaatgttgacaatgccttcacagaagtgctcactcagatataccgtgttgttagtaggaagactcttgagattggagatgaccctgcagcccttcccaagggtcagaccatcaatgttggaggcaaggatgatgtctcagctgttaagaaggctggatgctgctctgcatagtttcacaacgtatctatagatgtgcatggattcaaccaattctcaacatcttttaatacctacacttgcctttttatgtaacttttcccacatgccttgccaagtttattgttttctcatttttttttttctgtaataggaatggtgtcatgttgcccttagatatacaaattttactgtttgtatttgaatgaaagtgatatctggttattagattgatcataagttacaatctcatcattctttctctaatattttg

SEQ ID NO: 3226 - DNA, 1881 bp, Plantago ovata
aaaaatcgtccaaatataaaaacgcctccagtagagatctccccctcttctctcccaggtccctctttccaaagcggggactcttaacaaaaccccatctacttacatttctacgcgcaaatccaaaaccctcgcaccagctaaatcttctcattccttctttcaattcactttctcccctcccctctgctgcaatgggcgcttaccgagctgacgacgactacgattacttgttcaaggtggtgctgatcggcgactctggcgtaggtaaatccaatttgctctccagattcactcgcaacgagttcagcttggagtccaagtccacaatcggcgtcgaattcgccacccgcagcatccgcgtcgacgataaagtcgttaaggctcagatttgggatactgctggccaggagcgatatcgtgcaatcacaagtgcctattatcgaggagctgtaggtgcgctgcttgtctatgatgttacacggcatgtaacatttgaaaatgtcgagagatggttgaaggaactcagagaccatacagattccaacattgtcataatgttagtcggaaataaggctgacttgcgtcacttgcgagctgtttccacagaagacgcgaaggcctttgctgaaagggagaaaacgtttttcatggaaacttcagctctggaatcaatgaacgtggaaaatgccttcacagaggttcttactcaaatacacggtgttgtaagccggaaagctctggaggtaggtgatgatccagctgctctacccaagggccagaccattagtgtcggaaaggatgatgtttcagcagtgaagaaagtcggctgctgttctgcttaaagaaaagagttttccattttcgttgcgtgttttaatatttcctgtgtcggttttcattagtgtcagttggttttattgtatacattgatgacttggatattgacagcccaggttttagttgttcgggatacaaaagtttgttcaggttaaaaccaattcttgcatgctctggagctttctctgtgacctggtcgcattgttgatcatctccatatgtttctattgtgtattagtattgtagatgaatacagttaacaattccttaaatcgtataatattcaggtttctggcaataacattgagaacagagttgggaccggtggcaggtgcagaagccatggcgaggcaagaagtggctcctgaggagctgcggatgatgaaattgtcttgaggcagtgtcatgttcatgccagaaaacatgaatgttatgctgggcacggtgattggcaccgtgtaacatgtgtcgaatcctcccagagatgacatggtggcgctccccatccggcgcctgaactcatctctcatggcagtgtatgccgagttcacgagactagtaaagacggtacctgaatcaaagactgttcctgctccagtgttggcatcaaatgcaaaggcactaggaggaatagtcacaaccttgctcccaaccattatgcccacaagattcacataataaaatgatgatctccttggattcttgagaattggggtagttttcatcacaataggctggctattaggccctaacctcaacgagcctgcgaaattgacggacttgtagcttggcaggcagtaggagaatgtagactggtagagactgttggactgggacactagtgataatggtcctcggcccaaccccaataagccttgtgcaggtagggatgaaccagtggctgtgttgacacagccgaaggtgtagctggtgacactatcggttgcgagggtgatgttgtcctgcacgagggtggcagtgatggcgagtttccgtatgtcgtgttgaacccacaagatttcccgttacaagttggttttg

SEQ ID NO: 3227 - DNA, 1258 bp, Populus trichocarpa
catcatttttctatacaaaacacacaagaagctccctccctcgctccctccctccctcgaagaaaaagcaaagaatgttcaacattttaaaattcaaaaactctacaacacagatccacatataaccccacaacaaggccaaacctttattactctccatttcatttcctttcccgtataacaaaaacaagaaatttagcgaagcagatgggtgcttacagggctgatgatgactatgattatctattcaaggtagtgttaataggtgattctggtgttggaaaatccaatcttttgtcaagatttacgaaaaatgaattcagtttggaatccaaatccactattggtgttgaatttgccacacgtagtatccatgttgatgataaagttgtcaaggctcagatttgggacactgctggccaagaaagataccgtgcaattactagtgcatattatcgaggagccgttggtgccttgcttgtctacgatgtcactcgacatgtcacttttgagaacgtggagagatggctaaaggagcttcgtgatcacaccgaatccaacatcgtgattatgcttgtgggaaacaaggcagatttgcgtcacttgcgtgcagttactactgaggatgccactgcatttgctgagagagagaaaacttttttcatggagacctctgccctggagtccttgaatgttgaaaatgctttcacagaagtgctcactcagatttatcatgtagtcagccggaaggctcttgatgttggggatgaccctgcagccttgcccaagggacagactattaatgttggcaaagatgatgtatcagctgtgaaaaaggttggatgctgctccgcatagtcagaatagatgaagaaaggaggtattggtggtaatattttctcctattttataatttgcttttttattatttgaagtcgcctttcagacaacaagaatgttcagatggatagttgtagtccaattgcttgcctagagacaagcaaacttgttgaagtcgagagaaagcttaagaagggggtatggatccaagaggcttttgcatttgattgccattcctttttctgattattcttttgtaagtttgttccttggagtgttgttgtaatttgtagacagtttcaaccctctagtttagattcaaatttattgcttgaatttggaagctgttaaggcaattgctcaacttgattgattgatcgattcttgatttattattttacaccattgacttccacca

SEQ ID NO: 3228 - DNA, 1502 bp, Glycine max
aaataaaagttcccttttttttttaccattcttctaattctaaatctggggttttctttaaatttcaaatcccccacaaagcatgcttcttttcttcttcttcttcaattgacgccaccccatttgattttttctctctcctttttctcttccctctcctaaacaaacacaacaacaacaacataaaatggcggcgtacaaagccgacgatgattacgattacttgttcaaggtggttctgatcggcgactccggcgtcggaaaatctaaccttctttctcggttcacgcgaaacgagttcagcctcgaatcgaagtccaccattggcgttgagttcgccaccagaagcattcgcgtcgatgataaggtcgtcaaggctcagatttgggacactgctggtcaagaacggtaccgagctattacaagtgcatattatcgaggagctgttggtgctttactagtctatgatgttacacgtcatgttacttttgaaaatgtggagagatggctaaaagagctgagagatcacacagatgccaacattgtggtgatgcttgtagggaacaaagcagacctgcgtcatctgcgtgcagtttccactgaagatgctacaactttcgctgagcgagagaacacatttttcatggaaacatctgccctcgagtccttgaacgttgaaaatgccttcacagaagtgctgacccagatctatcatgttgtaagcaagaaggcccttgaggttggagatgatccagcagctttaccaaaaggacagacaattaatattgggtcccgtgatgatgtatcggctgtgaagaaatctggatgttgttctgcttgagtgtgtagaagacagtctctgtatttttataaattatatgccttgtttataccatgtagagattggcctcacagcatgaagatgattatttagcgagcatcaaattttaaagtttctgcttagaattatgttcaaaattagccaaatgtttagaaaacaagcacattcattttgcattgtgcctatttttgtgccatttaaagatatttatttatcaaatttccaatttattagtttgattcttttctaatcttcatcatgcttctatttgttctcatctatgccgcatttgaaaagcagatattcaatctggttctttccttgcttagtttttctcttcctttctttccttgcttagcttttctcttcctttcataatgaagagtattgaaaacttgaatatattgtttctttctatttggagcattgtaggtatttggcaacattataaattataatacttgctaacagactccaatgcttgaaggctcctcactgtgcgagaaggtatgggggaaggtcatcaaggtattgctaataaattaggaaaaggttggattttttcttataaagttggttccaagaagcaacacatgtccaattcctttttatagaaacagccagcaaatagtctctgtttgacagaacacaagggcttttt

SEQ ID NO: 3229 - DNA, 924 bp, Nicotiana tabacum
ttcataaaatctttgaacaggtgtccctctcctccttgtagcggtgctccactccgctcctctttctgcatttcttcccaaacccatcgtatctcctcttctctgtacacacacagacacacactgagagacctagaatagacagtaatgggcgcatacagagcggacgacgattacgattatttattcaaggttgtattgatcggcgattccggcgtcggtaaatccaacctcctctccagattcactcgcaacgagttcagtctcgagtcaaagtcaacgatcggcgttgaattcgccactcgtagcattcgtgtagatgataaagtcgtcaaggctcagatttgggataccgccggtcaagaacgatatcgtgcaatcacaagtgcctactatcgaggagctgtcggtgcgttgcttgtctatgatgtcactcgtcatgtaacctttgagaatgtagagagatggttaaaagagctccgagaccacaccgactctagcattgtcataatgctggtgggtaataaggcagatttgcgtcatctgcgggctgtttcaactgaggatgccaaggggtttgctgagaaggaaagtacgtttttcatggaaacatctgcattggagtccatgaacgtggacaatgccttcacagaagtgctcactcaaatacaccgcgttgttagcaggaaagctcttgaagtaggagatgaccctgcagcattgccgaaggggcagactattaatgttggagggaaggatgatgtttctgaagtaaagaaagccgggtgctgttcttcttagaacaaagagtaatacaaatggttgaagaggttctctttgttttgagcccaaaaattgacatggcagttgtacttctccctctatatactaggaagtaaccacatggattgctcatcaatggga

SEQ ID NO: 3230 - DNA, 848 bp, Zostera marina
atcctccaccgagccgaccacttctcctttcaacttctccgcaactctgatcggaatcgggaactcgaattcgacgccggagttcccaaaatggcgtataggacagatgatgattacgattacttgtttaaagtggtgctgatcggcgattccggcgtcgggaagtcgaatctgttgtcgcgattcactaggaatgagtttagtctggagtccaaatccaccatcggggttgagttcgctactagaagtatccgtgtggaggataaggttgtcaaggctcagatctgggacactgctggtcaggagaggtaccgtgcaatcacaagtgcatattatcgtggagcagtgggtgctcttcttgtctatgacgtaacccgtcatgtaacatttgagaacgtggagagatggttgaaggaactgagagatcacaccgatgctaacattgtcatcatgcttgtgggtaataaagccgatctacgacatttgagggccgtatcaactgaagatgcccaggcctttgccgaaaaagagactacatttttcatggaaacttctgcccttgaatccatgaatgtcgagaatgccttcaccgaagttctcactcagatacacagtgttgtccgaaagaaagcccttgagatcggtgatgatcctgttgccttacccaagggccaaaatatcaacgtcggcagcaaggacgatgtatctgaggtgaagaaggtcggttgctgctcgacttagctggtaaatacattagttgtcgcgacaatattcattggggagttagtattcttaagcttcttagttgatagattttttaactaatgtaatacaatttaccactatca

SEQ ID NO: 3231 - DNA, 1097 bp, Olea europaea
agctggtaaaagctggctcaaccatataccctgttgcccaattttcttgatttctcttgctcttaaattcccaacccatactagcatttactgggtttcttcatgtataactagaaagacgtaaacttgtatattaagatggcgggaggatacagggcggaagatgattacgattacctgttcaaagtggttttgattggcgattctggggttggaaagtcgaatttactatcgagattcacgcgcaacgagttcagtttggagtcaaagtccaccatcggcgtagaattcgccacccgaagcattagtgtagaagataagatcgttaaagcccagatttgggacaccgccggccaagaacgataccgtgcaatcacaagtgcatactaccggggggcagttggtgctttgcttgtttatgatgtcactcgacatgtcacattcgagaatgttgaaagatggttgaaagagctccgagatcacacagaccagaatattgttataatgcttgtgggcaacaaggctgatttacgtcatctacgtgccgtctccactgaggatggcaaggcttttgccgagagagaaaatacattctttatggagacatctgcactcgagtctatgaatgtcgggaatgcttttacggaagtactcacccaaatataccatgtggttagtcggaaggcacttgatattggagatgaccctgctgccctgcccaaagggcaaaccatagacgttgggaccaaggaggacgtttcagcggtgaagaaggttggttgttgctcagtctaatcaaaagactcgtgaatcagtgggtgttgcgttctccttgaattccattaacctttcagacggtgctatttctttttgttgtcgctatactttcagtgattgtcctaagctagagctagggctagagctgctcagttttggagttagagatgtgttgttcgttttttctttcaatctgtactgttccatttgtgtgctctgatctgctgttgtattatactgcagtttgcgtggtatctggattaaaattcttcaaaacagtgattttcaatgtttcttatagttgatgaatgagtagttac

SEQ ID NO: 3232 - DNA, 1295 bp, Tabernaemontana elegans
ctttacttgtgcactctctctgataagatgttctctccaaatcccaaaatttcatagcaaaattcacttcattctttgctggaagcaagattattcagtgccattggtgatttactgtgattgattcaacaatttccacggtttttgctacagtacttggctagggttagggcttttcgaaatcttaccctcttaaacaagagattcagtttggagaagtgtataggtagatagttgtattattttcattcttgttgttgatattttgaggatcataagctttgatggcgggaggatacagggcggacgatgactatgactacttgtttaaggtggtgttaattggagactccggtgtcggtaaatcgaatctgttgtctagatttactcgcaacgagtttagtctggagtctaagtcaaccatcggtgtcgaatttgccacccgcagcattcgcgttgatgacaagattgtcaaggcccagatttgggacaccgctggccaagaacggtaccgagcaattacaagtgcatactaccgaggtgctgttggtgctttgcttgtgtatgatgtcactagacatgtcacttttgaaaatgttgagagatggctaaaagagcttcgtgatcacacagaccaaaacattgtgataatgctcgtggggaacaaggctgatttacgacacttgcgtgctgtttccacggaggatgcaaaggcctttgctgagcgagagagcctctattttatggaaacttcagcactggagtctatgaatgttgaaaatgcatttactgaagtacttagtcagatatatcatgtggtcagcaagaaagcacttgaggttggagatgatcctgcagcagtacccaaggggcaaacaatcgatgttggcaataaggatgatgtttcagctgtgaaaaaggttggttgctgctctgtctaagcactaaaccaaatgattgaggagtaactagagtatttctgcctagtgtcgtttggcgattccttctgtgtgttaattgctatgtcttcagtggttggatgcctttgcagaaggttggctcttggtttttgaccttgtagagaatgcggcatacagattcctctacctataccgagttacttagaattctgtctttcgcaacttgtattgtttcattgttttactgtggtttagcctgcatgaatattacggtatctttaggttcttagctgcttcctctcttggatcttttactcgctcggttaaatcatgaagtgattgttattacttttgaggtaaaaacttttcttttat

SEQ ID NO: 3233 - DNA, 1075 bp, Cajanus cajan
gagaaagaatgatgagattgtaacttatgatcaatctaataaccagatatcactttcattcaaatacaaacagtaaaatttgtatatctaagggcaacatgacaccattcctattacagaaaaaaaaaaatgagaaaacaataaacttggcaaggcatgtgggaaaagttacataaaaaggcaagtgtaggtattaaaagatgttgagaattggttgaatccatgcacatctatagatacgttgtgaaactatgcagagcagcatccagccttcttaacagctgagacatcatccttgcctccaacattgatggtctgacccttgggaagggctgcagggtcatctccaatctcaagagtcttcctactaacaacacggtatatctgagtgagcacttctgtgaaggcattgtcaacattcaaggactccagagcagatgtttccatgaaaaatgtgttttctctctcggcgaacgccttcgcgtcgtcggtggacaccgccctcaggtggcggaggtctgccttgttccccacgaacataattacaatgttggcatctgtgtgatcacgaagctcctttaaccatctctccacgttttcaaatgtcacgtgtctggtaacatcatacacaagcaatgcaccaacagcacctcgatagtatgcacttgtgattgcacgatatcttgacctctcttggcctgcagtgtcccaaatttgcgcctttacgatcttatcatcgacgtggatgctgcgagtggcgaattcaacgccaatggtggatttagattccaagctgaattcgtttttggtgaatcgagacaagagattggattttccgacgccggagtcaccgatcaagacaaccttgaacaagtagtcgtaatcatcgtccgctctgtaggcacccattttccctcttccttctctttcgatccaaagatcctaactttgcgcttttttcttcaatcgcttctcgggaattgaactgggtcggtgccaatgggggttgcgagtttcagcattggaatgtgacagaagagaaggatatgatgatatggagggagaagcattcaga

SEQ ID NO: 3234 - DNA, 913 bp, Trifolium pratense
tttatttttagcatatagcatcacgcacgcaccacaaaatcaaaataaaaataatttagtctctccatttgtggctgttttccctcatcagatcatcaaatgggggcatatagagccgatgacgattacgattatctattcaaggttgttttgatcggtgattctggtgttggtaaatcaaatcttctttctagatttacaaaaaatgaattcagtctcgaatctaaatctacaattggcgttgaatttgctaccagaagcattcgtgttgatgataaggttgttaaggctcagattcgggatactgctggtcaagaaaggtaccgagcaattactagtgcttattatcgcggagctgttggcgctttgttagtctatgatgttaccaggcatgttacatttgaaaatgtggagagatggctaaaagagctgagagatcacacagatgcgaacattgttgtgatgcttgtaggcaacaaagcagatctgcgtcatttacgagcagtttcgaccgaagattctacagcttttgcagaacgcgagaatacatttttcatggaaacatctgcccttgagtccttgaacgttgaaagtgcgttcacagaagtgttgacgcagatctatcgtgttgtaagcaagaaggcccttgagattggtgatgatccagctgctttacctaaaggacagacgattaatgttggggcccgtgatgatgtatcagctgtgaagaaatctggatgttgttctgcttaagaatgttgtaaaagtctctgtatttttaccctgaaaatgatgtcatgtttataccatgtagagattgaactgacagcaagaagatggattgtttagagagttctgttcaatattagccaaatgtttaggaaacatacacatttattttaagtaatttata

SEQ ID NO: 3235 - DNA, 843 bp, Allium cepa
atatggatctcctcagattcgttgcaaaattctttccttctccactcaattttacccaagctattcaataagcggtggtaagttaccgcatatcgccatggcgtacagagccgacgacgattacgactacctgttcaaagtcgtactgatcggcgattcaggcgttggcaaatcgaaccttctttcccgattcacgaggaatgagttcagtcttgagtcgaaatcgacgataggggtggaatttgctacaaggagtatacatgttgatgataaggttattaaggctcagatttgggatactgctggccaggaaagatatcgggcaattacaagtgcatactacagaggagcggtgggagcccttctagtgtacgacgtgaccagacacgtaacatttgagaacgtggagagatggctgaaagaactcagagatcacaccgactccaccatagtcatcatgcttgtaggcaacaaagcagatctgcgccatcttaaggcggtcacgacagaagatgcaaaagcatttgctgagagagaaagcaccttctttatggaaacatctgctctggaatcgatgaacgttgaaaatgctttcactgaagtgctcactcaaatttacagggtggtaagtagaaaagcacttgaagtcggcaatgacgctgctgctttgcccaagggacagaccatcaatgtagggtccaaggatgatgtatctgctgtaaagaaaggtggttgctgttcgacgtagatgatattagtgtccggttattctaacatctttgggaattcggtgcgctgatgagacgttttagttattgtcggtgcacctagttattgagataa

SEQ ID NO: 3236 - DNA, 844 bp, Petroselinum crispum
aaaaaagtgaatgggggcgtacagagccgacgacgattacgactacttattcaaagtagtattaatcggtgactcaggcgttggtaaatcaaatttactgtctcgattcactcgtaacgagtttagtctcgagtctaaatccactattggcgttgaattcgctactcgtagtattcaagttgatgataaagtcgttaaggctcagatttgggatactgctggccaagaaagataccgtgcaatcacgagtgcttactaccgaggggctgtcggggcgttgcttgtatatgatgtaacacgacatgtcacatttgagaacttagagaggtggttaaaagagctccgtgatcatacagatgcgaatattgtgattatgcttgttggaaacaaatcagatttgcgtcatctgcgagctgtttccaccgaggatgccaaagcatttgctgaaaaagagggtacctactttatggaaacttctgcactggagtccatgaatgttgacgatgcttttacagaagtacttactcaggtacaccatgttgtcagcaaaaaagctcttgagattggagatgatcaagcagccttgccaaaggggaagacgattaatgttggtaacaaggatgatgtctcagcagtgaaaaaagctggctgctgctcttcttagaagccgctaatgcagtagggaaactttgttactgtcacttctggttttgcgtggctataaatattctagatgaatcatattctgactgcatgtactttgattacaagaactttagtcagttgtgacctatgtgaactaaaacactaggaatcttgtgcacattctgaatttaaaattctt

SEQ ID NO: 3237 - DNA, 1366 bp, Glycine max
aagacgtatggaggagggttaaaacggtaaaaagaagcaaacccatttcatttgcttgttgtgattgttttcctttttcatctgaatctgtgatatatcattcgagctttgaatgcttctccctccataacaacaacaacgctctcttaatctttcttttttcatttccaatgctgcaacaacttgcaaggttcatatgcagcactacgacagacccaattgaattcccacaaaagaattaaagaaaaaacggtcaagttagaatcttttgaacctttcgatcgcgtgggaaggaagagaggaagatgggtgcgtacagagcggacgatgattacgactacttgttcaaggtggtgttgatcggagactcgggcgttgggaaatcgaacctcttgtctcgattcacgaagaacgaattcagcttggaatccaaatccaccattggcgtcgaattcgccacccgcagcatccacgtcgatgacaagatcgtcaaggcgcaaatttgggacactgctggccaagaaagatatcgcgcaatcacaagtgcatattacagaggagctgttggtgcactgcttgtgtatgatgttaccagacatgtgacttttgaaaacgtggagagatggttaaaggagcttcgcgatcacacagatgccaacattgtaatcatgcttgtggggaacaaggcggatcttcgtcacttgcgtgcagtggccaccaacgatgccaaggcgtttgccgagagagaaaacacgttcttcatggaaacatctgctctggagtccttgaatgtcgataacgccttcaccgaagtgctcactcagatatatcgcgttgttagcaggaagactcttgagatcggagatgaccctgcagccttgcctaaggggcagaccatcaatgttggaagtagggatgatgtctcagctgttaaaaagtctggatgctgctctgcatagtttcacatgcccttttgcagcagaacagaatatctatatgtgcatgatccaaccaattctcaacattttggggtcctagtgaaatattttaatacctagccttctctttttatgtaattttctccacatatatcttggcaagttaattgttttctctctttttccttttcttttcttttcatgtaagcattgtttggtcataggaatgatgtcttgtcgtccttagatatacaaaatttactgtttgtattgagtgaaagtgatattgggttctcagattgatcagaagttactatctcatcattcttcatcaagttttgcattccactgaaacaagaaaaattctttgataggtaggaagtattattcaatcgtggaagtgtttttttggcatatgactatatgag

SEQ ID NO: 3238 - DNA, 1182 bp, Manihot esculenta
tatgaacccacattttctatcttcccaatcgaaaagtaggactgcccatttcgttttgatcttcttttccaaaaacccagcaatcccttttatttgaaacgcagagaaagcgagggaatttaggttaatgggggcttacagggcagacgatgactatgactacctgttcaaggtggtgttaataggtgactctggggttggaaaatccaatctgttgtcaagattcacgaaaaatgaattcagtctggaatctaaatctaccatcggtgttgaattcgccactcgtagcatccatgtcgatgacaaggttgtcaaggcccagatttgggacactgccggccaggaaagatatcgtgcgatcactagtgcatactacagaggagctgttggtgccttgcttgtctatgatgtcactcgacatgtcacctttgagaatgtggagagatggttgaaggagcttcgagatcacactgattccaacattgttattatgcttgtaggaaacaaggctgatttgaggcacttgcgtgcagttacaactgacgatgctaaggcatttgctgagaaagaaaacactttctttatggaaacctctgccctagagtccttgaatgttgacaatgccttcactgaagtactaactcagatctatcgtgttgtcagccgaaaggctcttgacattggggatgacccaacatccttgccgaagggacagactattaatgttggcaaagatgacgtatcagctatgaaaaaagatggttgctgctctgcatagtcagaataaaaacaagtcttgatcttagtagtttcttcttttaaagatctgcatttcagtggtttgaactttgaagatgtcttttttctctacaaaatgcaaaagaagccacctggaatgctcacatatggcatttgtagtttgatggcgtgcttagagattagcaaagtttaagttgagagacaacttaagggttcagatcgaagagactatcacatgtggctggcatttctgttacctattattcttttgtagttttgcttccgtgggtggtgttgtatccatagacagatccaaccctctaggttaggttatcttttattgcttatatttggaaaatatgttgagataatggtgtttttactggatttatttattaatcgattatcttgtcctgatttaaa

SEQ ID NO: 3239 - DNA, 991 bp, Manihot esculenta
ggaattttggttaatgggggcttacagggcagacgatgactatgactatttgtttaaggtggtgttaataggcgactctggggttggaaaatccaaccttttgtctagattcacaagaaatgaattcagcttggaatctaaatccaccatcggtgttgaattcgccacccgcagcatccgtgtcgatgacaaggtcgtcaaggcccagatttgggacactgctggccaggaaagataccgagcgatcactagtgcatactatagaggagctgttggtgccttgcttgtttacgatgtcactcgacatgtcacctttgagaatgtggagagatggttaaaagagcttcgggatcacactgattcaaacattgttatcatgcttgtgggaaacaaggcagatttgaggcacttgcgagcagttacaatggaggatgccaaggcatttgctgagagagaaaacactttttttatggaaacctccgctctagagtccttgaatgttgaaaacgccttcacagaagtactaactcagatctaccgtgttgtcagccggaaggctcttgaggttggggatgacccagcggccttgcccaagggacagaccattaatgttggcaaagatgacgtatcagcaatgaaaaaagtgggatgctgctcagcatagtcagaataaaagaagccatggtgttagtagtttgtcctttaaagatttgcatttcagtggcttgaagatgcctttgtttatgttgaaaagaagcaacctggaatgctcataagcatttgtagtttgatggtgtgcttagagattagcaaatttgtttaagttgagagacaaattaagggttcagattgaagagactttcataatttctgttgctttttcttgttattctttctcttttatatgtttgttttgatttgatgggtgttgttgtaatccctagacaaatccaacccttaaggttagattatattttattgctcagatttg

SEQ ID NO: 3240 - DNA, 1563 bp, Ricinus communis
gcgctagctatctctggagattgcaaaatacaaaaagaaaaaaaaaaaaaaaagaaaagaaaagaaaaaagaagaacagcaaacaacaaacaagaaacaagagaaatagaagagataattgagccgacccgaccggcccgagaattggaaagaaatggcggcgtacagagcagaggacgattacgactatctattcaaggtggtgttgataggagattcaggtgtagggaaatcaaatctactctccagattcactagaaatgaattcagccttgaatccaaatccactatcggtgttgaattcgctacccgtagtatccgcgtcgatgataagatcgtcaaagcccagatttgggataccgctggccaagaaagatatcgtgcaatcacgagtgcttactaccgaggagctgttggtgcattgctagtgtatgatgtcacaagacatgtcacatttgagaatgttgagagatggttgaaggagctaagaggtcacacagatgctaatattgtgattatgcttgtgggtaacaaggcagatctgcggcacttgcgtgctgtttccactgaagatgctaaggcctttgctgaaagggagaacacattctttatggaaacatctgcacttgagtctatgaatgttgagaatgctttcactgaagtgcttactcaaatatatcgtgtagttagccggaaagcgcttgaggtaggggatgatccaggagccttgcctaaaggacaaaccatcaatgttaaggatgatgtttcagcagttaagaaagttggctgctgctctgcttgaatgctgctctgaggattgagaaggtgaaaaatatgtcaaacctcagtgaacatagacttctagacttccagtggtcaagatatagcaggtctctcccaaatgaaccattacaattatatctcaggttgctaaagcttctatgagatttggtctagaggtccaaagaaattatctgcatctttcagatttcatttttaatttggtatcagttctttgatagttagttgaggtttttcctcctcgtgtattgttttatcgcctagctcagccgatgttgtatttgattgctctagtatagacattgtcagaaaattttaatttgtggagtgatttgcttcctttccttacgcataatttgcaagagagacaaatgccattaaactgcaagtcacctgcttgggttgttactgcaccttttgttgacacctgaatacagaaagctggtatatgcattgttaaaatgaggacaactggcatatcaggatgtgaaaatgaacattgttctataatgagaaataaaattttgataaatttgtttccatgagtagaaattgtataggcaatttaaagagtgttagtcgagttggcaagggagagtactcttattctttgttgattaatgttcaattcttctaggaagtattctatgtatttattttttgaatgtgctattcaatgctgataggggagtgtctttaagatcgctcggaaggaaataattagattcggttggaaagggggaggacttctatttttgttaa

SEQ ID NO: 3241 - DNA, 825 bp, Cucumis sativus
gttgccaagtgatcgtcttcaacaatttcaaaaccttttgagctccattttttcagacccttcgaatttcagtcatcggattcgacctcaataagtatggcagcgtatagaactgacgacgattacgattatctctttaaagttgttctcatcggtgactcgggtgtgggtaaatccaatcttctctccaggtttacgcgtaatgagttcagtcttgagtctaaatccacaatcggtgttgaattcgccactcggagtattcgggttgatgacaagatcgtcaaggctcagatttgggacaccgctggacaagaaagataccgtgcaatcacgagtgcatactatcgaggagctgttggtgcattgcttgtctatgatgtcacacgacacgtgacatttgaaaatgtggagagatggctgaaagagcttagggatcatactgattcaaatattgtgataatgctagttggcaacaaggcagatttgcgacatttgcgtgctgtatcaactgaggatgcccaggcctttgcagagaaggagaacacattcttcatggagacatctgcccttgagtctctgaatgtcgagaatgcttttaccgaagtgctaacacaaatctatcgtgtagtttgcagaaaagcacttgaaattggagaggatcccgctgcattgcctaaaggacaaaccattaacgttggaaacaaggatgatgtttctgcaatgaagaaagttggttgctgctcttcatgatatcatcattttgaatattaggtacatcatcaaaaaggagtaaaaggatgagttcattatgatatgtcttgaatt

SEQ ID NO: 3242 - DNA, 1049 bp, Fagopyrum esculentum
actctacttgcaactttgctagtaagcttcctctcccctaaccatttccactgctttcagatctgaggaacttccttcttcttacccgcagaaaacaagcagatggggttcagagcagatgacgattacgattacctcttcaaggtggtgttgatcggcgactccggtgtcggtaaatccaacctcctctctcgattcactcgcaatgagttcagccttgagtctaaatccaccattggtgttgaattcgctactcgtagcattcatgttgatgataaggtcgtcaaagctcaaatttgggacactgctggccaagaaagataccgtgccataacaagtgcatactaccgaggagcagttggtgcgctgcttgtctacgatgtaactcgtcatgtgacatttgagaacgtagagagatggttgaaggagcttcgagaccacacagactcaagcatagtgataatgctggtgggaaacaaagcagatttacgccacttgcgagctgtgtcaacggaggacgccacagcatttgctgagaaggaacaaacagtcctcatggaaacctctgcactggagtctctaaacgtggaaaatgccttcacagaggttctaacacagatatatagggttgttagcaaaaaggctcttgaagctggggatgacccgggttctgtaccaaaggggcaaaccatcaacgtgggaagcaaggatgatgtgtctgctgtcaagaaagctggatgctgctcatcttagtatcagcagttggaagatgagtttagattgaaatccaagatgatttggtgtgttatgccaggtattaggcagttctgttgtgtttatttgttggacttacgttgaccttcattgagagactattgaaactcaaaaattaaaagggtatatactactttacctcacagcctgtgttaatctgttaatgggaacggaagggtgttctctaatctatgtatgtttcgagaaaattggtgatgatccatgatccatttgtgaaggacaagtccaataaataatgcgttttggttagaagc

SEQ ID NO: 3243 - DNA, 1154 bp, Panax ginseng
aaaatacatacatacatactatatgtatttacatctatatctcttaatttcgtttcgtcgttagagtgaaaaagggtttgaattttgaaaacaaacggacagaaatttgatacttcctataactttctatggcggcgtacagagccgacgatgactacgattatctcttcaaggttgtgttgatcggagattcaggtgtcggaaaatcaaatcttctctccagattcactaaaaacgagtttagtttggaatctaaatctacaatcggtgttgaattcgctaccagaagtattcgcgtcgatgataagatcgtcaaggcccagatttgggacaccgctggccaagaaagatatcgtgcaatcacaagtgcatactaccgaggggcagttggtgcattggttgtctatgatgtcacccgacatgtcacgtttgagaatgttgagagatggttaaaagagctgcgagaccacacagatgccaatattgtgataatgctggtgggaaacaaggctgacttgcgtcacttgcgtgctgtttccaccgaggatgcaaagtccttgctgagagagaaacactttctttatggagacatcggcccttgaatctttgaatgtagagaattcattcactgaagttcttagccaaatatatcatgtagtcagccggaaagcacttgagattgggggatgatcctgcagcattgcctaaagggcaaacaatcaatgttaaggatgatgtttcagcagtgaaaaaagttggctgctgctctgtgtaactacaagagtaaatcattggtgagtgagagaacttttcaagaactccacttggcagctctggttcgtcccaaatattcctatgtttcaatagttgggatggtttgagataatctaaggctaactgctaagtttggagtctacgaagaaatacagcacgagggattttcatttatcctaggccagttcattggtactactatttatttaaggggttttttttgtcaatctgtattgtttcatttgtttacggccgtagtttgtattgtattttatcgaactgaattagtttttgttgataggttgtattttttaacacactgagtagttgagtgttgattttataaaatgacgagttcctctagcaagctacttggaaaa

SEQ ID NO: 3244 - DNA, 1153 bp, Gossypium raimondii
tttttttccaaattcaaaaattgtcacaccaatgccactgagctctgccatttattaaaatttcctcccaaaaaataaattcaaaaattttaatataaaaatccataaaagaacccgacccggtgacccggaatggcggcgtatagagcagatgatgactacgattacttattcaaggtggtgttgatcggagattcaggtgttgggaaatcgaatttgttgtcgagatttacgaggaacgagtttagccttgaatccaaatccacaatcggagttgaattcgccacccgaagtattcgggtcgatgataaggtcgttaaggcacagatttgggacaccgccggacaagaaagataccgagcgattacaagtgcatactaccgtggagctgttggtgcgttgcttgtctatgatgtcactcgacatgtcacatttgagaatgttgaaagatggttgaaggaattacgaggtcacacagattcgaatatcgtgattatgcttgttggtaacaaggcggacctgcgacacttgcgtgctgtttccaccgatgatgctaaggcctttgccgagagagaaaataccttctttatggagacatctgcccttgagtctatgaatgttgagaatgcattcactgaagtactaactcaaatacatcatgttgtcagtcgaaaagcacttgaagtaggagatgatcctgcagcattaccaaagggacgaaccatcaatgtaggaagcaaggatgatgtttcagccgtcaagaacgctggctgctgttctgcttaaatgttagatgatatatcctccatttttcgtatctttaagcacaagatttgagattgaagtcaaaggagaaagtagcagcttccaaatttccttcatttgatttcggttccttactcgtggttcttttatggtattggtctccctagtgtaatgttccatttcatagttttgatagtttttgttgtatttgattgctttagaatacatagcagacagatctagtttgggtttctaaataattttcattagttgtggatgataaattttgaattatttaagacaatacatcttaaattcctccatacgtgaatgctagaaattgtatacaaaattggaattgcaaaatggattgggtttcaagcgtaca

SEQ ID NO: 3245 - DNA, 872 bp, Cucumis melo
aattcaaaaccttttgagctccatttttcagacccatccaatttcagtcatcggattcgacctgattaagtatggcagcgtatagaacggacgacgattacgattacctctttaaagttgttctcatcggtgactcgggtgtgggtaaatccaatcttctctccaggtttacgcgtaatgagttcagtcttgagtctaaatccacaatcggtgttgaattcgccactcggagtattcgggttgatgacaagatcgtcaaggctcagatttgggacaccgctggacaagaaagataccgtgcaatcacgagtgcatactatcgaggagctgttggtgcattgcttgtctatgatgtcacacgacacgtgacatttgaaaatgtggagagatggctgaaagagcttagggatcacactgattcaaatattgtgataatgctagttggcaacaaggcagacttgcgacatttgcgtgctgtatcaactgaggatgcccaggcctttgcagagaaggagaacacattcttcatggagacatctgcccttgagtctctgaatgtcgagaatgcttttaccgaagttctaacccaaatctatcgtgtagtttgcagaaaagcacttgaaattggagaggatcctgcagcgttgcctaaaggacaaaccattaacgttggaaacaaggatgatgtttctgcaatgaagaaagttggttgctgctcttcatgatatcatcattttgaatatgaggtcatcaaaaaggagtaaaaggatgagttcattatgctatgtcttgaatttccactcctggatttgctcaacgaacatttactttatggtcattttttacggtgatggagagcttacttacggtaa

SEQ ID NO: 3246 - DNA, 963 bp, Olea europaea
aaaacaatataagcggcctaaagacttctggaagaagaaaagaatagactagtctgctaggccccctttcctaacggtgtgtaaatctttgcttcaattcaaccgcttgtcttctccccaaataatacccatatttacagatacacatcctcgtacacacgtgaaaatgggtgcttacagagctgacgatgattatgattacttgttcaaggtggtgctaatcggcgattctggtgttggaaaatcgaatttgctttcacggttcacccgaaacgagttcagtttggagtccaaatcaactattggcgttgaattcgccactcgaagcatccgcgttgatgataaagtcgttaaagcccagatttgggacactgctggccaagaacgatatcgtgcaatcactagtgcctactatcgaggagcggttggtgcattgcttgtgtatgatgtcacacgtcatgttacatttgaaaatgtcgagaggtggttgaaggaactcagggatcataccgattcaaacatcgttataatgcttgttggaaataaggcagacttgcgtcacttacgggctgtttccacagaagatgcgaaggcatttgccgaaagagaaaacacatatttcatggaaacctctgctctggaatctatgaatgtggaaaacgccttcacagaagttcttagtcagatatatcacgttgtcagcaggaaagctcttgaggtcggtgatgatccagcggctttgcctaagggacagaccattaatattggctctaaggatgatgtttctgagatgaagaaagttggatgttgctctgtttaaaacaagcagctctatttactctaatgagatttaatattcatggagccggtgatttcctgttgaacaattgactacatattgttcatttgcttgtaccaaaactttatcctcgtcattgaagggaaatggatctcgattactta

SEQ ID NO: 3247 - DNA, 1233 bp, Citrus sinensis
ctccacgtttcttcttcagttctctttctcatttgaacaaatctcactttcacatgtcactgtttcatttcaccatttcctaatccatttgccattgacccgacccgaataatttaaatggcggcttacagagcagacgaggactacgattatctatacaaagttgttttgattggcgattcgggtgtgggcaagtccaatttgctgtcgagattcacccgtaatgagttcagtttagaatccaagtcaacaatcggagtcgaattcgccacccggagcattcgggtcgaagataaaatcgtcaaggctcagatttgggacactgctggccaagaaagatatcgagcaattacaagtgcatattaccgaggagctgttggcgcattgcttgtctatgatgttacgcgacatgtcacatttgagaatgttgagagatggttgaaagaattgcggggtcacacagactccaatatcgtcattatgcttgtgggtaacaaagctgacttgcgtcacttgtgtgctgtttctacagaagatgctaaagcctttgcagaaagggaaaacacattctttatggagacatcagctctggagtctatgaatgttgaaaatgcattcacagaagtgctaacgcaaatctatcatgttgttagccgaaaagcacttgatatagggggtgatcctgcagccttgcccaagggacaaacgattaatgttggaggcaaggatgatgtctcggctgttaagaaagtgggttgctgcaatgcttaaatgaaggctaatgatggagtgtactgatcatatttcctcctatttcagtcatataaattcaagagtttcacatgtcatgaatcaagatgtggcccccttgcacttggatttggctgtgacacataataaccttcaatgaggcttatttatgggatggagttgaaagaagttgctgctgcaattgacacctgtttctcaatgctcaatgctcaatgctctttccttgtttgcattgttttagtagtttttgttgtattttggtttctatagaatagaaatttttttctttctgacaattttgcttttgtattctttaaattaagctgtcttctgctgattacatacctaatactattagttcatcatattcatccatatgtatgtacagtatatcagtgagaagagaacaacaatgacctgtcatcatcaaatgctctattttgctaagttcttattatattt

SEQ ID NO: 3248 - DNA, 1132 bp, Arachis hypogaea
aataaaaaagagaatagaataagagactttgagctttgaatgcttctccctcctttctgcaacaactcgtctctcttcttccaatgccgaaagttgcagccattaaacgcagtttccaaattcaaatccttaaaaccaattcatattcaaacaaaacccccaatttctgttgtattcggatctagacagaacaaaacacgcccttctccacctcctccaatcagaaaatagaaactagaaaaatgggagcatacagagcggacgatgattacgattacttgttcaaggtggtgctgatcggagactccggcgtcggaaagtcgaaccttttgtctcgattcacaaaaaatgaattcagcttggaatccaaatccaccattggcgttgaattcgccactcgcagcatccacgtcgatgataagatcgttaaggcccaaatttgggacactgctggacaagaaagatatcgcgcaatcactagtgcatattatcgaggagctgttggcgcattgcttgtgtacgatgttaccagacacgtgacttttgaaaatgtggaaagatggttaaaggaacttagggatcacacagatgccaacattgtaatcatgcttgtaggaaacaaggcggatcttcggcacctgcgtgccgtgaacactgatgacgccaaggcatttgccgagagagaaagcacattcttcatggaaacgtctgcgctcgaatccttgaatgttgacaatgctttcacagaagtgctcactcagatctatcgcgttgttagtcggaaaactcttgagattggagatgaccctactgccttgccaaaggggcaaacgatcaatgtcggtggtaaggatgatgtctcggctgttaaaaaggctggatgctgctcttcatagtttgataatgaaaggaagttcttgaatcttgacagcaaaacacatatttatcagcgcaggattcaactaatccccagcaggacaacattgagatccatgctacatgttctaatacttatgcttttcatttttgtaatcttttctagcccctcccccctcctcttttcccactctataagcattgtttatttataggaatgatgttgccttagatatatacaaattttactgtttct

SEQ ID NO: 3249 - DNA, 871 bp, Lippia dulcis
ctcattaaacccagcatgaaactctcgggaatttggttgctccatttggtttattagtactaaccctgaaatagaatctcaatcttgctcaggagaacagtttggcatggcgggatacagagctgacgacgactacgattaccttttcaagctggtgctgatcggagactccggcgtcggaaaatccaatttgctctccagatttgctaggaatgagttcagcttagagtcaaagtctactataggcgtggaattcgccacgcgcagcattcgcgttgatgataagatcgtcaaggctcagatctgggatacggctggtcaagaacgataccgtgcgatcacaagtgcctactatcgaggggcagttggagcattacttgtgtatgatgttacccgacacgtgacatttgagaatgttgaaagatggttgaaagagcttcgagatcacacagaccagaatatcgtgatcatgcttgtgggcaacaaggcagatttacgccacctccgtgctgtttccactgaagatggccaatcttttgccgagagagaaaaaacgtactttatggagacatcagcactcgagtctatgaatgttgagaacgctttcacagaagtactcacccaaatataccatgtagtaagtcgtaaagcacttgatattggtgatgatcctgctgccttgccgaaagggcagaccataaatgttggcaaagacgacgtttcagctgtgaaaaaagtcggttgctgctctgtatgaatcctggaaaaatcaactcttgaaatgggcattgttggattactcttcaaattcaggaagacattgcaatgtcagattttgaagatagaaatattgttaaattgtctctaaaat

SEQ ID NO: 3250 - DNA, 1475 bp, Populus trichocarpa
caagcctactcccaaacaaaaatcaaagaatgttcaacactttaaaattcaaaacctctacacagatccacatataaccccacaagtccacaacacagaaaggccaaacctttatctctcaacatcatttcccatataacaaaaactagagaattagcaaagcaaatgggtgcttacagggcagatgatgactatgattatctattcaagttagtgttgataggtgattctggtgttggaaaatccaatcttttatcaagatttacaaggaatgaattcagtttggaatccaaatccactattggagttgaatttgccactcgtagtatccatgttgatgataaagttgtcaaagctcagatttgggacactgctggccaagaaagataccgtgcaattactagtgcatattatcgaggagctgttggcgccttgcttgtctatgatgtcactcgacatgtcacttttgagaatgtggagagatggctaaaggaacttcgtgatcacactgattcaaacattgtgattatgcttgtgggaaacaaagcagatttgcgtcacttgcgtgcagttactactgaggatgccactgcatttgctgagagagaaaatacttttttcatggagacctctgccctagagtccttgaatgttgaaaatgctttcactgaagtgctcactcagattcatcgtgtagtcagccggaaggctcttgatgttggggatgatcctgcagccttgcccaagggacagactattactgtcggcaaagatgatgtatcagctgtgaaaaaggttggatgctgctccgcatagatagaatagatgaaagaagtatggtggtaatagtttctcctatttcataatttgcctttttgttatttgaagacgcctttcagacacatgaatgttaagatggatagttgtagtccaattgcttgcctagaaactaccaaacttcttgaagttgagagaaagcttaactgcttaaggttatggatccaagaggcatatgcatttgattgccattcctttttccttctttcttttgattgttcttttgtaagtttgttccttggagtgttgtaatttttagacagtttcaaccctctagtttagattcaattttattgcttgaatttgggaaatattaaggtaatcgctcaacttgattgattgttcaattctttctttcacaatttattgtttttcaccgttgacgtccacaccaacaaaggtgtcatcaagcttgtcattaacatcgaagagattgattttgtttgttgatgcttaatgtgtgggcagagaagttgctctttttgccttgctatgcaccggctattgtccaaatgaaagatcgatgttctttcatgactttgctgggttgctgcaaactttcctgaatattaatgcttgctttttggcaaacaacccatgatttctcaatgtcataactcgtaagttagcaagccaaa

SEQ ID NO: 3251 - DNA, 787 bp, Silene vulgaris
taatgggatatagagctgacgacgattacgactacttattcaaagtagtcttaatcggcgactccggtgtcggaaaatcgaaccttttatcgcgatttacacgtaacgaattcagtttagaatctaaatcaacaattggagtcgaattcgcaactcgtagcattcgtgtcgatgataaagttgttaaagctcaaatttgggatactgctggtcaagaaaggtaccgtgcaattacgagtgcatattaccgtggagctgtcggtgcattactcgtttacgacagtacccgtcatgtcacatttgagaacgttgaaagatggttgaaagaactccgagatcacacagattccaatatagtgataatgctagtcggaaacaaggcagatttgcggcatttgagagccgtctccactgaggatgcacaagcatttgccgagagagaacaaacattctttatggaaacctccgccctcgagtctatgaatgttgaaaacgctttcactgaggtgctgactcaaatatacaaggttgtcagcaggaaggctctcgaggctggagacgatcctgctgccttgcccaagggtcaaaccattaacgtgaaggatgatgtttctgctgttaaaaatgtcgggtgttgttctgcatagcccattcagcagattaatactgcctagatatttatcattgtagagtagcagggagcttcacaattatagagagcttgtttgcacaattcatccaggttcatagcaatgagaattgctgttgactcgtatgaatgtatgat

SEQ ID NO: 3252 - DNA, 1072 bp, Triphysaria pusilla
gcagcccctctttcctaaacgggctacacagatcaacagcccctttttccttctaccaaattcagtcaagactaaaacccttcgcctaatctatccacatttctacactatcactcttaccctgtatatactcacatatatacacacactcccactcacattcactcatgggtgcataccgagccgacgatgattatgactacttgttcaaggtagtactgattggcgattccggcgtcggaaaatcgaatttgctgtcgagattcactcgcaatgaatttagcttggagtccaagtccacaatcggagtcgagtttgccacccgcagcatccgtgtcaatgagaaagttgtcaaggctcagatttgggacaccgctgggcaagaacgatatcgtgcaattacaagtgcttactatagaggagctgttggggcattgctagtttatgatgtcactcgccatgtcacatttgaaaacgtggagagatggttgaaggaactcagagatcacacagattcaaacattgttatcatgctcgttggaaacaaggctgatttgcgtcaccttcgggctgtttctacagaggacgcgacggcttttgctgaaagagaaaagacgtttttcatggaaacctctgctttggaatcgatgaatgtggaaaatgccttcacagaggtgctttcacagatatataatgttgtcagcaggaaagctctggaaggtggtgatgacccggcagctctacccaagggtcagaccatcaatgtcggttctaaagatgacgtttcagcagtaaagaaaggtgggtgctgctcttcttaaagagcttgttccaaagctaaaagccgttccctttttattacgaatgagttttaatgttatttttttcgttgttggatgatctatctcattgtatacattgatcgcttcgactgtttgagcactttgttcatcgacatgcgaaatattttacataggtaaagatagtactactagagaccatcgctgtttctattttctgtcatctacaatatttggctcaattcgtctagctgtgtcattcgtttgccccg

SEQ ID NO: 3253 - DNA, 1121 bp, Tripterygium wilfordii
tacagcagcgggagtggactgatcacttctttactactcattctcttcttttctaaatctgatgcgtcaaagctgctcttttccttgatccgtttagctgctgcaagaaccccgcccgtcccgaacaggaagagactgggaaattggaaatggcggcttacagggctgacgatgattacgactacctgttcaaggttgtgcttataggggactctggggtgggcaaatcgaacttgctgtcgcgattcacgaaaaacgagttctcgttggagtctaagtccaccatcggagttgaattcgctactcggagtattcgagtcgatgacaatgtcgtcaaggcccagatttgggatactgctggccaagaaagatatcgagcaatcacaagtgcatactatcggggagctattggtgcattgcttgtgtatgatgtcacgcgacatgtcacatttgagaatgttgagagatggttaaaggagctacgggatcatactgactccaacattgtgattatgctggtgggaaataaggcagatctgcgccatttacgagctgtttccacagaggatgccaaggcctttgctgagagagagagcactttctttatggaaacatctgctctcgagtctctgaatgttgagaatgcctttactgaagttctaacgcaaatatatcacgtagccagcaggaaagcacttgatattggggatgaccctgcagctttgcccaaaggacaaaccatcaatgttggaacaaaggatgatgtttctgctgttaggaaagttggctgctgctccgtttaactgtaagaggaagatgaaggatacccaatatatatttatccgctgcaattataaatgctagacttaccgtattacaggaaatggtccgtctcctaacttttaaaccttataaatcatgcatggatgcctgggtttttgcatgatagctttttatggtatggagtcgagtaaatccagatcttgaagatttttcctttttcccttggatgtcacttccttcatagtcgcttcgggtttgctcctcgtgtatgttttatttgttgattgctgtaagttctttgtgtaattctatccgagtaggagatttgtttatcaatg

SEQ ID NO: 3254 - DNA, 950 bp, Castanea mollissima
agagagagagagagagagagagagttgtgtatgaaatgggggcgttacagagcagatgatgattacgattacttgtttaaggtggtgctgatcggggactccggtgttggcaaatcgaacctgttgtcgaggttcacgaagaacgagtttagccttgaatctaagtcgaccattggggtcgagttcgccaccagaagtattcgtgttgatgaaaaggttgtcaaggctcagatttgggacactgctggccaagaaaggtatcgtgcaatcacaagtgcctattatcgaggtgctgttggtgctttactagtctatgacgttacccgccatgttacatttgaaaatgtggagagatggctgaaggagcttcgggatcacacagatgccaacattgtgatcatgcttgtaggaaacaaagcggacctgcggcacctgcgagcagtttccactgaagatgccaaagcatttgctgaacgagagaacacctttttcatggaaacatctgcccttgagtccttgaacgttgagaatgccttcacagaagtgctgacccaaatttatcatgttgtaagcaggaaggccctggaggttggggatgacccagcagctgtacccaaaggagaaacaatcaatgttggaaccaaggatgatgtatcagctgtgaagaaagttggatgttgctctacttgagcatggagagttttaaaatacattctctttgaacttctatcccatgttcatatctttgtagagatcagcaactgaacgaaaagtgttttctatagaatatttacagtgtgaacttgtctaccttagctgaaaatttaggatccaaaagatatgtgcctgttcttttctattattgaatttaaagtacctgtgtccccactttaccctttttgtatgactaaaattactcagcttctctagttttatatcaagtttgatca

SEQ ID NO: 3255 - DNA, 1071 bp, Trifolium pratense
attttcatttctttgaatgtttcttctctccctcctctcttttaacaatgcctctctttatctcaaattctgaaacctaaaaaccatcaaattttcattcaatttcaaaaccctatttcatcaaatccttaatcttcaacctcaatcaagattaacaaaaaatgggtgcgtacagagccgacgatgactacgattacctattcaaggttgttctgatcggagactctggcgtcggtaaatccaatcttttgtcacgattcacaaaaaatgaattcagtttggaatcaaaatcaaccattggtgttgaattcgctacacgtagcatccatgttgatgacaagattgtaaaggcacaaatttgggataccgcaggacaagaaagatatcgtgcaatcacaagtgcatattatcggggagctgttggtgcattgcttgtgtatgatgttacaagacatgtaactttcgaaaatgtggagagatggttaaaggaacttcgcgatcacacagatgccaacattgtaattatgcttgtcgggaacaaggctgatcttcgtcacctgcgtgccgtgtccactgacgacgctaaggcatttgctgaaagagaaaacacgttttttatggaaacgtctgccctcgagtcattgaatgttgacaattctttcacagaagtgcttactcaaatatatcgagttgttagtaggaagactcttgagattggagatgaccctgctgctttgcctaaaggacagacaatcaatgttggcagagatgatgtctcagctgttaaaaaggttggctgctgttcggcttaatttgacagataatagaaaggatcgtcttcgaaacacatggtatatctatctgtgcatgattcaaccaatcctcagcattttgaggtccatgtgaaatgttttaatacctaaggttttcttttctttcttttttttctgtattttctttcctcatgttttatctttattattgtcacttttttttttacccagtgctggttggtcgtagggattatatcattttacccttagatatacgaaattactgtttgtattgaat

SEQ ID NO: 3256 - DNA, 895 bp, Trifolium pratense
atcatcaaatgggggcatatagagccgatgacgattacgattatctattcaaggttgttttgatcggtgattctggtgttggtaaatcaaatcttctttctagatttacaaaaaatgaattcagtctcgaatctaaatctacaattggcgttgaatttgctaccagaagcattcgtgttgatgataaggttgttaaggctcaaatttgggatactgctggtcaagaaaggtatcgagcaattacaagtgcttattatcgcggagctgttggcgctttgttagtctatgatgttaccaggcatgttacatttgaaaatgtggagagatggctaaaagagctgagagatcacacagatgccaacattgtcgtgatgcttgtaggaaacaaagcagatctacgtcatttacgagcagtttcaactgaagattctacagcttttgcagaacgcgagaatacatttttcatggaaacatctgcccttgagtctttgaacgttgaaagtgcgttcacagaagtgttgacgcagatctatcgtgttgtaagcaagaaggcccttgagattggtgatgatccaactgctttacctaaaggacagacgattaatgttggggcccgtgatgatgtatcagctgtgaagaaatctggatgttgtgctgcttgagaatgttgttaaagtctctgtatttttaccctgaaaatgatgtcttgtttataccatgtagagattgaactgacagcaagaagatggattgtttagagagttttgttcaatattagccaaatgtttaggaaacatgcacatttattttgcgtaatttatatttttggcattgtaagatattcattcatctaatttcaaaattttcatttctgacctaaaaaagaaaagagtat

SEQ ID NO: 3257 - DNA, 1061 bp, Trifolium pratense
attttcatttctttgaatgtttcttctctccctcctctcttttaacaatgcctctctttatctcaaattctgaaacctaaaaaccatcaaatttcgttcaatttcaaaaccctatttcttcaaattcttcatcttcaacctcaaagaagattaacaaaaaaatgggtgcgtacagagccgacgatgactacgattacctattcaaggttgttctgatcggagactctggcgtcggtaaatctaatcttttgtcacgattcacaaaaaatgaattcagtttggaatcaaaatcaaccattggtgttgaattcgctacacgtagcatccatgttgatgacaagattgtaaaggcacaaatttgggatactgcaggacaagaaagatatcgtgcaatcacaagtgcatattatcggggagctgttggtgcattgcttgtgtatgatgttacaagacatgtaactttcgaaaatgtggagagatggttaaaggaacttcgcgatcacacagatgccaacattgtaattatgcttgtcgggaacaaggctgatcttcgtcacctgcgtgccgtgtccactgacgacgctaaggcatttgctgaaagagaaaacacgttttttatggaaacgtctgccctcgagtcattgaatgttgacaattctttcacagaagtgcttactcaaatatatcgagttgttagtaggaagactcttgagattggagatgaccctgctgctttgcctaaaggacagacaatcaatgttggcagagatgatgtctcagctgttaaaaaggttggctgctgttcggcttaatttgacagataatagaaaggatcgtcttcgaaacacatggtatatctatctgtgcatgattcaaccaatcctcagcattttgaggtccatgtgaaatgttttaatacctaagcttttcattttattttttttgtattttctttcctcatgttttatctttatgtcactttttttttaccaagtgctgtttgatcgtagggattatatcattttacttttagatatacaaaattactgtttgtattgaat

SEQ ID NO: 3258 - DNA, 865 bp, Vicia sativa
atctttctccaaacaacaatgtctctctctgtctcaaattctcaaacttgaaaaccattcaatttcccaaacccttccttcaaatccctaatttttcaccatccatttctatttcaatcctcacacaatatacaagaaatgggtgcgtacagagccgacgacgactacgattatcttttcaaagtcgttctcatcggagactccggcgtcggtaaatccaatctcttgtcacgattcacaaaaaacgaattcagtttggaatccaaatccaccattggcgttgaattcgctactcgcagtatccacgttgatgataagattgttaaagcacaaatttgggataccgcaggacaagaaagatatcgtgcaatcacaagcgcatattatcgaggagctgttggtgcattgcttgtgtatgatgttacaagacatgtaacttttgaaaatgtggaaagatggttaaaggaacttcgtgaccacacagatgccaacattgtaattatgcttgtggggaacaaggctgatcttcgtcacctgcgtgccgtgtccaccgaggatgctaaagcatttgctgaaagagaaaacacgttttttatggaaacgtctgccctcgagtcattgaatgtcgataattccttcacagaggtacttactcaaatataccgagtggttagtaggaagactcttgagattggagatgaccctgccgccttgccaaaagggcacacaatcaatgttggcagtagagatgatgtctcagctgttaaaaaggttggatgctgttccgcgtagtttgacagataatagaaaagatcgtcttcgcaaccaatggtatatttatctgtgcatgaatcaaccaatcctc

SEQ ID NO: 3259 - DNA, 1174 bp, Solanum tuberosum
ctgcagtgataatccttcatctctcttcttcttcattttctctctctatacatacatatatcatatatataatatatatatataaacgtattgagagaccaccagtaatgggggcgtacagatcggacgacgattacgattatttgttcaaggtggtgttgatcggcgattccggcgtcggaaaatctaatcttctatccagatttacacgtaacgagttcagtctagagtcgaagtcaacgatcggcgttgaatttgctactcgtagcattcgtgttgatgataaggtcgtcaaggctcagatttgggatactgccggtcaggaacgatatcgtgcaatcacaagtgcctactatcgaggagctgttggagcattgcttgtctatgatgtcacccgtcatgtaacttttgagaatgtagagagatggttaaaagagctccgagatcacaccgactctagcatcgtcataatgctggtgggtaacaaggcagatttgcgtcatctgcgtgctgtttcaactgaggatgcccaggcatttgcagagaaggaaagtacatttttcatggaaacatccgctttggagtccatgaacgttgaaagtgccttcacagaagtgctcactcaaatacaccgcgttgttagcaggaaagctcttgaagtaggagatgacccggcagcacttcccaaggggcagacgattaatgtaggaggtaaggatgatgtttctgaagtaaagaaagctgggtgctgttctgcttagaacaaagagtaatctaaaccgcggacgagattctttttgttttgagctgaatttcacatgacatttgtacttcaacctctaaccacatgaattgcttagcactaatagctttattcactggacaactagacattgttgaattgagtgcagccccaagattgaatatccaaattagctttattcatagcattctttatccttgtttctgtattttgcttccattggtcaatgatttattgtattagctggctgcttatggacctccaaaatagggtatatttgtttcaaaaagattctgaatcgcgctatatgtatgaaactatgaacacattttatcctgccttgtaattgattgtttgattaattgtgaattgaggaatattttcaatttcttatgctatgtttgtgtaatt

SEQ ID NO: 3260 - DNA, 839 bp, Ambrosia trifida
taataataataataataataaacccaacacaacacaacacaagacaacataaactaaaacccctgtttcattttatttcatcatcacagatctaaataaccaacaagcaatgggtgggtacagagcagacgacgattacgattatttattcaaggtagtcctcatcggagactccggagtcggcaaatccaacctcctttcaagattcactcgcaacgagttcagtctggagtccaaatccacaatcggggtcgaattcgccactcgcagcattcacgttgatgataaagttgtcaaggcccagatttgggacactgctggccaagaaaggtaccgtgcaatcacaagcgcatactaccgaggtgcagttggtgcgttgctggtgtatgatgtcacacgccatgtcacctttgaaaacgtagagagatggttaaaggagcttcgtgatcatacagattccaacattgtcatcatgctcgtgggtaataaagccgatttacgccatttacgagctgtccaaactgaagacgccacatcatttgctgaaaaagaacacacctacttcatggaaacctctgcacttgaatcattgaatgtagaaaatgcattcacagaggttctcactcaaatttatcatattgtgagcagaaaagcactggatggtggtgatgatcaggcgacgttgccaaaagggcagacaattcatgtgggggggaaggatgacgtgtcagcagtgaagaaagccggatgttgttcttcttagaaggtgagttttgatcaagtgaatgaaacattggagtataaatcataggtttttattgtttaatctaaactaaact

SEQ ID NO: 3261 - DNA, 918 bp, Antirrhinum majus
aatgggtgcatatcgagcagacgacgactacgattacttgttcaaggtagtactgatcggcgattccggcgtcggaaaatcgaatttgctatcgagattcactcgcaatgagttcagcttagagtccaaatccacgatcggcgttgaattcgccactcgcagcatccgcgtcgaggagaaagtcgtcaaggctcagatttgggatactgccggtcaagagagatatcgcgcaatcacaagtgcctactatcgaggagctgttggtgcattgctagtttatgatgttacacgccatgtaacatttgaaaatgtagagagatggttgaaggagctcagggatcacacagattcaaacattgttatcatgctcgttggaaacaaggctgacttgcgtcacttgcgggctgtttctacggaagacgcaaaagcttttgctgaaagggagaacacttttttcatggaaacttccgccttggaatcaatgaatgttgaaaatgccttcacagaagtgcttgctcagatacatcgtgttgtcagccggaaagctctagaggcaggtgatgatccggcagctgtacctaagggacagaccatcaatgttggcaaagacgatgtttcagaagtaaagaaagttggttgctgctctgcttaaaagggagctaagagttaatatgcagctctgttatccatatgtgctctaatatttcttgtggtgttagatgatctgattgtacactttgatcccttggatattgctcaccaaagttttagtctctggcatacaaaagtttgttcgggttaagcgaatattctccttagagagtaagtttcttagtgacatccgtggattttcattttcctattatgctctacgtcgtgtattatttttagtagtatacgcctagatttgttgaaaaa

SEQ ID NO: 3262 - DNA, 1202 bp, Cicer arietinum
gccaacttggaaagctaaaatggtgtaaattacctttccttttttgtaattaattaattacctttctagtttttttttttgtaatgtgattcggttaccgttgccaaattaatgttaagttacctttataatcactgttctaaatctagatttattccaatttccccaaaaattaaaaatcagcatagcatggttcttcggtctcattcaattattttgtaaaccagcaaatcaaaataatattctgtctcttcccctgtttctcgttgttttaattaatgggggcatacagagccgatgacgattacgattatctattcaaagtggttttgatcggagactcaggtgttggtaaatcaaatcttctttcgaggttcacaaagaatgaattcagcctcgaatctaaatccaccattggcgttgagttcgctaccagaagcattcgtgtagatgataaggttgtcaaggctcagatttgggatactgccggtcaagaaaggtaccgagcaattacaagtgcttattatcgtggagctgttggcgctttattagtctatgatgttactcgtcgtgttacatttgaaaatgtggagagatggctaaaagagctgagagatcacacagatgccaacattgtcgtgatgcttgtaggtaacaaagcagacttgcgtcatttacgagcagtttcaactgaagatgctacagcttttgctgaacgggaaaatacatttttcatggagacatctgcccttgagtcattgaacgtagaaagtgcgttcactgaagtgttgacgcagatctatcgtgttgtaagtaagaaggcccttgagatcggtgacgatccagctgctttacctaaaggacagacgattagtgttgggtcccgtgatgatgtatcagctgtgaagaaagctggatgttgttctgcttgagtatgttgtaaaacacttttggttatcatgtagagattgaactggaagcatgaagataattgtttacagagcatcaaactataaagttgctgctttggtttgtagagaattatgttcaatattagtcaaatgtttaggaaacatgccccgccgcgcatttattttgaatttcaattccgttcttttcttaatcttagccaattttatttattctcatctatactgacaaagcaaattattccctctggtattttccctgctctacttttt

SEQ ID NO: 3263 - DNA, 1038 bp, Gossypium hirsutum
acctaccaaaaataaattacaaaatttaatataaaataccataaagaacccgacccggtgacccggaatggcggcgtatagagcagatgatgactacgattacttattcaaggtggtgttgatcggagattcaggtgttgggaaatcgaatttgttgtcgagatttacgaggaacgagtttagccttgaatccaaatccacaatcggagttgaattcgccacccgaagtattcgggtcgatgataaggtcgttaaggcacagatttgggacaccgccggacaagaaagataccgagcgattacaagtgcatactaccgtggagctgttggtgcattgcttgtctatgatgtcactcgacatgtcacatttgagaatgttgaaagatggttgaaggaattacgaggtcacacggattcgaatatcgtgattatgcttgttggtaacaaggcggacctgcgacacttgcgtgctgtttccaccgatgatgctaaggcctttgccgagagagaaaataccttctttatggagacatctgcccttgagtctatgaatgttgagactgcattcactgaagtactaactcaaatacatcatgttgtcagtcgaaaagcacttgaagtaggagatgatcctgcagcattaccaaagggacgaaccataaatgtaggaagcaaggatgatgtttcagccgtcaagaacgctggctgctgttctgcttaaatgttagatgatatatcctccatttttcgtatctttaagcacaagatttgagattgaagtcaaaggagaatgtagcagcttccaaatttccttcatttgacttcggttccttactcgtggttcttttatggtattgttctccctcgtgtaatgtcccatttcatagttttgatagtttttgttgtatttgattgctctagaatacatagcagacagatctagtttgggtttctaaataattttcattagtggtggatgataaattttgaattatttatgacaatacatcttaaattccttcataggtgaatgccaga

SEQ ID NO: 3264 - DNA, 1287 bp, Panax ginseng
aagcagtggtatcaacgcagagtacatgggatggccagctatgctgcagtgctgctgatttaatttccccaattcatcacactagctaccagtttcttttccttttctccatcttcttacatttctccctctacagtatattattcattacttataaacaagattattctttcttatctctccctctctcgaagccattgttagagagagaaaggttggaactttgaaaacacagtactaccttactttatatatatggcggcatacagagccgacgaggactatgattatctattcaaggttgtcctgatcggagattcaggtgtcggaaaatccaatctgctctccagattcaccaaaaatgaatttagtttggaatccaaatccaccatcggtgttgaattcgccaccagaagtattcgcgtcgacgataagatcgtcaaggcccagatttgggacacagctggccaagaaagataccgtgcaatcacaagtgcatattatcgaggggcggttggtgcattgcttgtgtatgatgtcacccgacatgtcacgtttgagaatgttgagagatggttaaaagagctgcgagaccacacagatgccaatattgtgataatgctggtgggaaacaaggctgacttgcgtcacttgcgtgctgtttccaccgaggatgcaaagtccttcgctgagagagaaaacactttctttatggagacatcggcccttgaatctttgaatgtagagaattcattcactgaagttcttagccaaatatatcatgtagtcagccggaaagcacttgagattggtgatgatcctgcagcattgcctaaagggcaaacaatcaatgttaaggatgatgtttcagcagtgaaaaaagttggctgctgctctgtgtaactacaagagtaaatcattggtgagtgagagaacttttcaagaactccacttggcagctctggttcgtcccaaatattcctatgtttcaatagttgggatggtttgagataatctaaggctaactgctaagtttggagtctacgaagaaatacagcacgagggattttcatttatcctaggccagttcattggtactactatttatttaaggggtttttttgtcaatctgtattgtttcatttgtttacggccgtagtttgtattgtattttatcgaactgaattagtttttgttgataggttgaattatttaccacaccgagtagttgagtgttgatcttataaaatgatgagttcctctaaaaaaaaaaaaaaaaaaaaaaaa

SEQ ID NO: 3265 - DNA, 970 bp, Panax ginseng
aaatttcaacattttgatctcccacacaatttctctctcttcattttcttccttctgtattagaatttaggatcagaaacagaattatactcgtaagaagaacagaaaatgggggcttttagagcagatgaggattacgattacctgttcaaggtggtgttgatcggcgattccggcgtcggaaaatcaaatctgttgtcgagattcagtcgcaacgagttcagcctcgaatcgaagtccacaattggggtcgaattcgccactcgcagtattcatgtcgatgaaaaggtcatcaaggctcagatttgggacactgccggtcaggaaaggtaccgtgctatcacaagtgcttactatcgtggagctgttggtgcgttgctagtctatgatgttacccgccatgttacttttgaaaacgttgaaagatggttgaaggagctacgggatcacacagacgccaatattgtcatcatgctcgtagggaacaaagctgacttaaggcacctacgtgctgttcctaccgatgatgcaaaggcctttgccgaacgtgagaacaactttttcatggaaacatcagccctagagtctttgaatgttgagaatgccttcacagaagtactgacccaaatctaccacgtagtaagtaggaaggctcttgacattggggatgatccaactgttttgcccaagggacagactatcaatgtggggggcagggatgatgtatcagccgtgaagaaatccggatgttgctctacgtaagtttgggaaaataagtttaaatatctgaagaatatcatttacagattctaaaccttgtttatacttgcaaggatgctttgactacctggagtaaaagttagtatccactccttgctgatcactgatgtaccttcataacaaattatgtggtcatgtaatcatgttatgtatttaattcaattattggctattgggttaaaaagaaaaa

SEQ ID NO: 3266 - DNA, 1180 bp, Medicago truncatula
gaatatttctcctccctcctctctttaatatctttttctttcaaacaatgcagaaaattcaaaaccgttcgtttcattgaaaaatttcccaaacccttctttcaaatccctaattttcatcaacaatgggtgcgtacagagccgatgacgactacgattatctcttcaaggttgttctcatcggtgactccggcgtcggtaaatccaatctcttgtcacgtttcacaaaaaacgaattcagtttggaatctaaatccaccattggcgttgaattcgctacaaggagtattcatgttgatgataagattgtaaaggcgcaaatttgggataccgctggccaagaaagatatcgtgcaatcacaagtgcatattaccgaggagctgttggtgcattgcttgtgtatgatgttacaagacatgtaacttttgaaaatgtggagagatggttaaaggaacttcgtgaccacacagatgccaacattgtaattatgcttgtagggaacaaagctgatcttcgtcacttgcgtgccgtgtccaccgatgatgctaaagcatttgctgaaagagagaacacattttttatggaaacgtctgcccttgaatcattgaatgttgacaattctttcacagaagtgcttactcaaatatatcgggtcgtcagtaggaagactcttgagattggagatgaccctgctgctttgccgaaagggcagacaatcaatgttggcagtagagatgatgtctcagctgttaaaaaggttggatgctgctctgcatagtttgacagataatagaaaagatcttcacaacaaatggtatatctatctgcatgattcaaccaattctcaacattttgagatccatgtgaaattttctaatacctaagctttttcctttttgtatttttcctcacatgttgtctttattattgtcactttttttaccaagtactgtttgctcatagggatttatcattttacctttagatatacaaaattactgtttgtattgaatgaaagggatatcatgctcttagattgtctagtagttacaatacttgtcacgctgcttctaattttccttccattggaaaaagaaaagttctattggtagagaccaagtataattcaatcctgaatttgtaatgtgcatatacttcttaatgttgttaggatataaa

SEQ ID NO: 3267 - DNA, 1133 bp, Medicago truncatula
caattttattctaatccaaaaaaaattacgttttgagagtgataaaaaaaaatagagtctacataatcgtataacgattgattcggttaccgttacaaatggcaaattaaaaaaagtttaggttacatttttttgatgactcttctaaatctggatttgttcccaataccataaaatcaaaatcaaaaataattttctctctcctccatttctggttctaatcaaatcaaataaaaatgggggcatacagagccgacgatgattacgattatctattcaaagtggttttgattggtgattcaggtgttggtaaatctaaccttctttctagattcaccaaaaacgaattcagcctcgaatctaaatccaccattggcgttgaattcgctactagaagcattcatgttgatgataaggttgttaaagctcagatttgggatactgccggtcaagaaaggtaccgagcaattacaagtgcttactatcgtggagctgttggcgctttgttagtctatgatgttacccgccatgttacatttgaaaatgtggagagatggctaaaagagctgagagatcacacagatgccaacatcgtcgtgatgcttgtaggcaacaaagcagacctgcgtcatttacgagcagtttcgaccgaagatgctacaagtttttctgaacgggagaatacatattttatggagacatctgcccttgagtccttgaacgttgaaagtgctttcaccgaagtgttgacgcagatctatcgtgtggtaagcaaaaaggcccttgagattggtgatgatccggctgctttacctaagggacagacgattaatgttgggtcccgtgatgatgtatcggctgtgaagaaagctggatgttgttctgcttgagtatgttgtagaagtgtatttttttctctgaaatttatgccctgtttataccatttagagattgaactgacagcatgaagatgattgtttagagagcatcaaactgtgaagtttctgctttggtctgtagagaattctgttcaatgttagccaaatgtttaggaaacatgcacatttattttgcgtaatttataatttgtgccgttttaagatattcattcattcatcttatttaaaaaattt

SEQ ID NO: 3268 - DNA, 1088 bp, Quercus alba
gtaacatagagcataatagtagttgagtaatattgatccgatccgcgtttgttggagaatattcagacagacagtgtgaaatagaaatagatatagataaagatggcggcttacagagcagaagacgattacgactacctgtttaaggtggtgctaataggagactcaggtgtaggcaaatcaaacctgttgtctcgcttcacaaagaacgagttcagcctcgagtccaagtccaccatcggtgtcgaattcgccactcgcagcatccgtgtcgacgacaacattgtcaaagcccagatttgggacaccgctggccaagaaaggtaccgtgcaataactagtgcatactaccgaggagctgtgggtgcattgcttgtctacgacgtcacccgccacatcacgtttgagaacgttgagagatggttgaaggagctacgggatcacacagactccaatatcgtgataatgcttgtgggtaacaaggcagacctacgtcacttgcgtgctgtatccactgaggatgctacagcctttgctgaaagagagaacaccttctttatggagacatctgcccttgagtctatgaatgttgagaatgcattcactgaagtgctaacccaaatatatcgagtggtcagccggaaagcacttgatattggagatgatcctgcagccttgcctataggacaaaccataaatgttggaaccaaagatgatgtttcagctgttaagaaagttggttgctgctctgcataaatcataaagagttatatcaaggaggctaaatcttttctcttcgaatttcactgcccttgaaatctgaggatttccacctgcaactaccggatattctcactaccatctaattgttatggtggtgcttaagcttgaggcgggctcaacatttgcagtccaaagaaatgccacatattatatttcttgtggtatattgtttcaattctatttcttagctgctgtagttttttgttttacttagttgctttagattatagaaagagttttttggattcaatttaatcttgtatctgatgaaagattagttcttcaatgtttggatgatgtgaaat

SEQ ID NO: 3269 - DNA, 905 bp, Olea europaea
cccatctacacttgattcccaaacagaaagaaaacccatacacaaaaatctacgtgcatatatatcattaaattgaagtgaggaagtaataatgggtgcatatagagcggacgacgactacgattacttgttcaaggtggtgctgatcggcgattcgggtgtcggaaaatcgaatttactgtcgagattcactcgaaatgagttcagtctcgaatccaagtcgaccatcggagttgagttcgccactcgaagcatccgggtcgatgataaagtagttaaggctcagatttgggacactgccggccaagaacgatatcgtgcaatcacaagtgcctactatcgaggagctgttggtgcattgcttgtatatgatgtcactcgtcatgttacatttgaaaatgttgagagatggttgagggaactcagggatcatacagattctaacattgttatcatgcttgttggaaataaggcagacttgcgtcacttgcgcgctgttcaaactgaagatgcaaaggcatttgctgaaaaagaacatgcatttttcatggaaacctctgctttggagtctatgaacgtagaaaatgcctttacagaggtgcttactcagatacatcaagttgtcagcaggaaagctcttgaggctagtgatgatccagctgccttacctaaagggcagaccattaatgtcagctctaaggatgatgtttcagctgtaaagacaggtggttgctgctctgcatagtggagaccaaagagtgagaagcagatgcagttgtggggatatcgtccatgtttacattaacagcacagttcatttcgccattagttttagttcattggcatccaaaaatttgtccaagtcaagccaactctctagagtaagagtcttagttaaatgcttg

SEQ ID NO: 3270 - DNA, 822 bp, Allium cepa
tacgggggtagttcagatgacgactacgattatctgttcaaggtcgttttgatcggcgattccggagtcggtaaatcgaatttgttatctcgatttacgagaaacgagtttagtcttgaatcgaaatcgacgattggggttgagtttgctacaagaagtatccatgttgatgataaggtggtgaaggctcagatttgggatactgctggtcaggaaaggtaccgtgcaatcacaagtgcatactaccgaggagcagtaggcgccctcctggtttacgatgtgacccggcacataacgttcgagaacatagagagatggctgaaagaactcagagaccacaccgatgcaaacatcgtcataatgctcgtcggcaacaaggcagatctccggcatctcagagcagtcaccacagaagacgcaaaggcgttcgctgaaagggagaacactttcttcatggaaacatctgctctggaatcgctcaatgtggaaaatgcattcactgaagtactaagccagatctaccgtgtggttagcaggaaggctctggatatcggtgacgatcctgctgctttgccaaaagggcagactatcaatgtcgggtccaaggatgatgtttcagcggtcaagaaggcaggttgttgttcaaattagtggattttggagtaaaatttttgtttttacattgtataatttgtgatgatgcttcttgtgtattgttacttaccattgttattattttttggttcctatatttcctttttgtttctgtaattgaaaagattatgtctactgaaggttgatagtattacgtaacacggtttt

SEQ ID NO: 3271 - DNA, 1090 bp, Cajanus cajan
aagcagtggcatgataaaaaagaaatggaaaataaaggtaattgtttgtttgagaattgagaccttacagtcaccactctcaacaatttgccaactaagaaaccccacatttccagctttgctctttcaacttcttattgttaccaaaagttgttccaaatctcgatttcaaaacaaagtacgtttctttcatcataaatatagattcgccgcaacccatttgaatctgtgagagaaggagcatatcaaaatcattttttccccttgattttctctttagccaaacaccagatagaaaagtgtgtgtgtggctaatgggggcgtacagagctgatgaggattacgattatcttttcaaggtggtgctgattggggactctggtgtgggaaaatccaatcttttgtcgaggttcaccaagaacgaattcagccttgaatcaaagtccaccattggggttgagtttgccaccagaagcattagggtagatgataaggttgtcaaggctcagatttgggacactgctggccaggaaaggtaccgagcaatcaccagtgcatattatcgaggagctgttggtgctttattagtctatgatgttacccgccatgttacatttgaaaacatagagagatggttgaaggagctcagagatcacacagatgccaacattgtggtgatgcttgttgggaacaaagcagacttgcgccatttgcgggcagtttccaccgaagatgctacaacttttgcggaacgggagaaaacatacttcatggaaacatctgcccttgagtccatgaatgttgaaaatgccttcacagaagtgctgacacagatctatcatgttgtaagcaagaaggcccttgaaattggtgatgatccagcagcattaccaaaagggcagactataaatgttagttctcgtgatgatgtatcagctgtgaagaaatctggttgttgttctaattgagcatgcagtaaacctctgtattttcactttaaagtttaaacctatgttctgtttatatctatgtagagttcagccttacagcatgaaaatgaatgtctagtgagcattacaatctaaacttt

SEQ ID NO: 3272 - DNA, 1238 bp, Populus trichocarpa
tggacatccttttgatttataattgactaatgactgtttgtctctgtttgtgtcaaagcgcaaaatctgtaatctcccaactgtaccaggtccagaagcaaagttaggcttacaaaacctttcgtctcttgaaaatgagtgcgtacagagcagatgaagattacgactatctgttcaagttggtgttaattggagactctggagttgggaaatcgaatctcttatctcgattcacgagaaacgaattcaacctggaatccaaatccactattggtgtcgaattcgctactcgtagcatccgtgttgatgacaagattgtcaaagcccagatttgggacactgctggtcaagaaagataccgggcaatcacaagcgcatactaccgaggagctgtcggtgcattgcttgtttatgacgtcactagacatgtcacgtttgaaaatgttgagagatggctaaaggagctgagagatcacacagatgctaatattgtgattatgtttgttggtaacaaggcagacctgcgtcatctgcgtgcggtttctactgaagatgccaaggcctttgctgagagggagaacacatactttatggagacatctgctcttgagtctctgaatgttgaaaatgctttcactgaagtgctaacccaaatatatcatgtggtcagccgcaaagcacttgacataggagatgatccagcagccttgcccaaaggagaaaccatcaatgttaaggatgatgtttcagcagtcaagaaagttggttgctgctctgtttaaacccaagtgagaggatgcagtggacaaatactccaattctctgccaccatgaactcaagacttcctcttttcaagtcacggtccctccccaaattttgtcattgtcagagtcataatgggatggacgctaagttcttagagtttgtagtctgatgaaaatgtctgcatcttccaggtttttaatttttcatttgatgccagtttctttatagtttctcaaggctcgtatctcatatgtctttagtgatatagcttttgttgtattttattgctcctagcataagacattgttccagacaattttatttctgtacgtgattgaatgatttttatgatacaaactgatacttcctataattatatttgtgtccacacgatcaaggaaatcttgatattccaatccagcttgtaattgtttaatgttggaacttgattacaagacaattagttctgtca

SEQ ID NO: 3273 - DNA, 1097 bp, Solanum phureja
atatataaacgtattgagagaccaccagtaatgggggcgtacagatcggacgacgattacgattatttgttcaaggtggtgttgatcggcgattccggcgtcggaaaatctaatcttctatccagatttacacgtaacgagttcagtctagagtcaaagtcaacgatcggtgttgaattcgctactcgtagcattcgtgttgatgataaggtcgtcaaggctcagatttgggatactgccggtcaggaacgatatcgtgcaatcacaagtgcctactatcgaggagctgttggagcattgcttgtctatgatgtcacccgtcatgtaacttttgagaatgtagagagatggttaaaagagctccgagatcacaccgattctagcatcgtcataatgctggtgggtaacaaggcagatttgcgtcatctgcgtgctgtttcgactgaggatgcccaggcatttgcagagaaggaaagtacatttttcatggaaacatccgctttggagtccatgaacgttgaaagtgccttcacagaagtgctcactcaaatacaccgcgttgttagcaggaaagctcttgaagtaggagatgacccggcagcacttcccaaggggcagacgattaatgtaggaggtaaggatgatgtttctgaagtaaagaaagctgggtgctgttctgcttagaacaaagagtaatctaaaccgcggacgagattctttttgttttgagctgaatttcacatgacatttgtacttcaacctctaaccacatgaattgcttagcactaatagctttattcactggacaactagacattgttgaattgagtgcagccccaagattgaatatccaaattagctttattcatagcattctttatccttgtttctgtattttgcttccattggtcaatgatttattgtattagctggctgcttatggacctccaaaatagggtatattttttcaaaaagattctgaatcgcgctatatgtatgaaactatgaacacattttatcctgccttgtaattgattgtttgattaattgtgaattgaggaatattttcaatttcttatgctttgtttgtgttaatt

SEQ ID NO: 3274 - DNA, 879 bp, Helianthus annuus
tttggtttggtgttatgggtgcgtacagagcagacgatgattacgattacctcttcaaggtagtcctcatcggtgattccggagtgggtaaatccaatctcctctccagattcactcgcaacgagttcagtctcgagtccaaatccaccatcggcgttgaattcgccactcgcagcatccgtgtcgatgataaagttgttaaggctcagatttgggacactgctggccaggaaaggtaccgcgcaattacaagcgcatactaccgaggtgcagttggtgcactgctagtgtatgatgtcacacgccatgtcacctttgagaatgtagagagatggttaaaggagcttcgtgatcatacagattccaacattgttatcatgctcgtcggtaataaagccgatctacgccacttacgagctgtccagtctgaagatgccacatcatttgctgaaaaagaacacacttacttcatggaaacctctgcacttgaatccttgaatgtagaaaatgcattcactgaagttcttactcaaatttatcatattgtaagcagaaaagcgctcgatgctggtgatgatcaggccacgttgccaaaagggcagacaattaatgttggcgggaaggatgacgtgtcagcagtgaagaaagccggatgctgttcttcttagaaggtgagttttgatcgagtgaatgaaaattggagtataaatcatagctttaattgtttcatcaaaacctttgtttcatcttgatgtctttaaattggtttttgtcaagtgattgtggcagcattctatatgtagtaagattgtattggtatctatgtactatgattgattcattagttgtgtatgtctgaaccaagtaggtctttttaac

SEQ ID NO: 3275 - DNA, 789 bp, Cynodon dactylon
cggccgggggacaaaagcaaacaagtgctctctgcctcggcaccgacctccccttccgctccctccccacctccgcctctcgttccgccgccgggaacccaaggcggggctctcgctgcgcagccccagcgagaaggaaggttcggggtgggaggatggcgtaccgggcggacgacgactacgactacctcttcaaggtggtgctcatcggggactcgggcgtcggcaagtccaacctgctctcgcggttcacgcgcaacgagttcagcctcgagtccaagtccaccatcggcgtcgagttcgccacgcgcagcatccacgtcgacgataaggtcgtcaaggcccagatctgggacaccgccggacaggaaaggtaccgagcaatcacgagtgcgtattaccgtggagcggtaggggcacttgtcgtctacgacgtcacgcggcacgtcaccttcgagaatttttagcccccgctgcgggagctcaaggaccacacggacagggggggggggatcatgctcgtcggcaacaaggcggacctgcgccacctcagggccgtcccgaccgacgacgccaaggccttcgccgagagggagaacaccttcttcatggagacgtcggcgctggaggccatgaacgtcgaggacgccttcaccgaaagtgctcaccaacatctactgcgtcgtgagtaagaaggccctcgacatcggcgacgaccccgccgcgcctcccaaggggcacaccatcaacgttggcggcaaggatgatgtgtctgctgtcaagaaaatc

SEQ ID NO: 3276 - DNA, 914 bp, Camellia sinensis
gagagagagagacacatatggcggcgtacagagccgacgatgactacgattacttgttcaaggtggttctgatcggggactctggtgtgggaaaatcgaatctcctctctaggttcacaagaaacgagtccagcctcgagtccaaatctacaatcggtgttgaattcgctactcggagtattcgcgtcgatgacaagatcgtcaaggcccagatttgggacacagctggtcaagagagataccgtgcaatcacaagtgcatactaccgaggagctgttggtgcgttgctcgtctatgatgtcacccgacatgttacattcgagaatgtcgagagatggttaaaagagctacgcgatcacacagactccaacattgtgataatgctcgtagggaacaaggcagacttgcggcatttgcgtgctgtttcgaccgaggatgcaaaggccttcgctgagagagagaacaccttctttatggagacatctgccctcgagtctatgaacgttgagaatgcgttcacagaagcgcttacctaaatacatcacgttgtcagcaggaaagtacttgatgtaggggaagaccctgcagccttgcctaaagggcaaaccattaatgtgggaaaggacgatgtatcagctgtgaaaacagttggttgctgctctgcatagctgctagagtaaaaaatttacgagtgtgattgaaaagcttgcttgccttggaaatgtcaagaactctacattgcagctcctggtttcttcgcctctcactttattgattgatttgttcactgatatggtttcagtggctgttattttggagctttgtcggaggctttcagtttgtagtgtataaagagaagcggcatacaaattctcctttcatacatgccagtttctcttgtaatatgtactttg

SEQ ID NO: 3277 - DNA, 889 bp, Panax ginseng
gagcagacgatgattacgactacttattcaaggtagtacttatcggagactccggtgtcggagaatcaaaccttctctctaggtttacacgtaacgagttcagtcttgagtccaaatccactatcggcgtcgaattcgccacccgcagcattcacgtcgacgataaagtcgtcaaggcccagatttgggacaccgcaggccaagaaagataccgtgccatcacaagtgcctactaccaaggagctgtcggggcattgcttgtatatgatgtcactcgacatgtcacatttgagaatgttgagagatggctaaaggagctccgtgatcatactgattccaacattgtgattatgcttgtagggaacaaggcagatttgcgtcacttgcgggctgtctccactgaggatgccaaggcatttgctgagaaagagagtaccttctttatggaaacttctgctctggagtccatgaatgttgaagatgcttttacagaagtgcttactcagatataccgtgttgtcagcagaaaagctcttgacattggagatgatccagcatccttgccaaagggacagaccattaatgttggcagcaaggataatgtatcagcggtgaaaaatgttggatgctgctctgcctagaagttggtaaaccagttggtcaaaatcagtttctgcgacttctaatttccgtgtggctgaacttgtccttgtgaatcataattttcagccccacattgagtctttagttgtcaaagctagagttatgacatatggaactaaaatgctcgagacttgctgaagttccgccaaatttgttcaaggagaagaatccaagtacttctcttctgttcatcttccttgtctccatcttcttttactcattgtat

SEQ ID NO: 3278 - DNA, 1015 bp, Chenopodium quinoa
tctctctctccaccgctgagttttcgagatttgcaataggcacctgaaacttctcctcctacactagatccaacccaactttctactcttccccaatatactcccactgtactctcttttctccagatccactgcatttcaattctccatttctgatccctaataaatttctacaatggggtatagagcagatgatgattatgattatttgttcaaagttgtgttgattggagattctggggttggaaaatctaacctgctttccagatttactcgtaatgagtttagccttgagtctaaatccaccattggtgttgagtttgctactcggagtattcgcgttgatgataaagttgtcaaagctcaaatttgggatactgctggccaagaaaggtaccgtgcaattactagtgcttattaccgcggtgctgttggtgcactacttgtctacgatagcactcgtcacgtcacatttgagaatgtagaaagatggttgaaagagctccgagatcatacagattctaatattgtgatcatgcttgtggggaataaggcagatctacggcatttacgggctgtttccaccgaagatgctcaaacatttgctgagaaagaaaagaccttcttcatggaaacctctgccctagaatcattaaatgtcgaaaatgctttcacagaggtacttactcaaatataccgagttgtctgcagaaaggctctggaagctggtgatgaccctgctgctgtgcccaaaggacaaaccattaatgtgaaggatgatgtatctgcagtgaaaaaagttggatgctgttcaacatagtcctgagagttgattgggttgagggtggtaaagctgtgtgtaatattggggtgttactggaagcatcaaatacacattagagcttctttgcacaatttatttagcttcatgtttaatcctgttctggaaaagtgtggattttgcctgttttctttacagtctcaagcagtcgtgggagtcaaggctacacgaggg

SEQ ID NO: 3279 - DNA, 1038 bp, Triphysaria pusilla
tattactcctagtaaaatacgaatcaggataaatctcattcccgaaaagtacgtattttttcataaagtatacagcacagatattgacaatggcggggggatacagagccgacgacgactacgattatctcttcaagctggttctcattggcgactccggtgttggaaaatccaatttgctttccagatttgctcggaatgagttcagcttagagtccaaatctactattggcgttgagttcgccacgcgcagcattcgcgttgatgataagatcgtcaaggctcagatttgggataccgctggccaagaaaggtaccgagcaatcacaagtgcctactaccgcggagctgtcggagcattgctcgtttacgatgtgacacgtcatgtcacgttcgagaatgtcgagagatggttgaaagagcttcgagaccacactgaccagaatatcgtgattatgcttgtcggcaacaaggcagatttacgccaccttcgtgccgtctcgactgaggacggccaagcttttgccgagaaggaaaaaacctatttcatggagacatctgcactcgagtctatgaacgtcgagaattcttttactgaagtgctcacccaaatataccatgttgtttgccgtaaagcccttgatatcggtgatgacccttcggccttgccgaaaggacaaaccataagcgttggaggcaaagatgatgtgtcggctgtgaaaaaggtcggttgttgctctgtataatttccggaattcgtttacaggtgagttggcgtatcggatttgtttagaacccagggacacattcattgcattggttctttttgcgctaattttgtatcggtttcgaagttgagatgttcaagcttatgaacgtcggatttattgtgttgtattatgattcatcatataatagtatcattttgattttggatgtttactaatttattgttattagaatgggaaaaggactatgatttgttgttgagaaatgtatgtagatttgtgatatctacataattctaccatgtcaaaa

SEQ ID NO: 3280 - DNA, 940 bp, Vinca minor
atggcaggaggatacagggcggacgatgactatgactacttgtttaaggtggtcttaatcggagattcgggtgttggtaaatcgaatctgttgtctagattcactcgtaacgagtttagtttggagtctaagtcaaccatcggtgtcgaatttgccacccgtagcattcgcgtggacgacaagattgtcaaggctcagatttgggataccgccggtcaagaacggtaccgtgcaattacaagtgcatactaccgaggggctgtgggtgctttgcttgtgtatgatgtcactagacatgtcacttttgagaatgtcgaaagatggctaaaggagcttcgagatcacacagaccaaaacattgtgataatgcttgttgggaataaggctgacttacgacaccttcgagctgtttccacagaggacgcgaaggccttttctgagaaagatagcctctattttatggaaacttcagcactggagtcgatgaatgttgaaaatgcatttactgaagtacttactcagatacatgtagtggtaagtaggaaagcacttgaggttggagatgatcctgcagcattacccaaagggcaaacgatcaatgttggcaaggatgatgtttcagctgtgaaaaaagttggttgttgctctgcctaaccattaaaacaatacttgattacctgccctattatcacatggttggttctgtctttgttaattgctatagtttcaatggttggatgtttttgcaaaaggttgatccttgatttgacttcagagaatgcagcatacagactcctctaccccgaaaacctacttgtttagatttccatctttctcaacttgtattgtttcattgtttactgtggtttaccggtgtgatgttatattttctgtaggatgatcttttactccttgattaaatgatatagtagttgttatt

SEQ ID NO: 3281 - DNA, 854 bp, Vinca minor
atggcgggaggatacagggctgacgatgactatgactacttgtttaaggtggtcataatcggagattccggtgttggtaaatcgaatctgttgtctagattcactcgcaacgagtttagtctggagtctaagtcaaccatcggtgtcgaatttgctacccgtagcattcgcgtggacgacaagattgtcaaggctcagatttgggataccgccggtcaagaacgataccgtgcaattacaagtgcatactaccgaggggctgtgggcgctttgcttgtgtatgatgtcactagacatgtcacttttgagaatgtcgaaagatggctaaaggagcttcgtgatcacacagatcaaaacattgtgataatgcttgttgggaataaggccgatttacgacacctgcgtgctgtttccacggaggatgcaaaggccttttctgagaaagagagcctctattttatggaaacttcggcactggagtcgatgaatgttgaaaatgcatttactgaagtacttactcagatacatcatgtggtaagtaggaaagcacttgaggttggagatgatcctgcagcattacctaaagggcaaacggtcaacgttggcaaggatgatgtttcagctgtgaaaaaagttggttgttgctctgtctaaccactagaccgatactggattatctgcgctagtatcatgtggtggtttggtcattgttaattgctatagtttcaatggttggatgcttttgcagaaggctggttcttggttttttacctcagagaatgcgacatacagcttcctctacctgaaaccttgttgcttagaattctgtctttctcacttgtatcgttcattat

SEQ ID NO: 3282 - DNA, 1000 bp, Amaranthus tuberculatus
aatgggatatagagcagatgacgattatgattatttattcaaacttgttctgattggagattctggggttggtaagtctaatctactttccagattcactcgtaatgagtttagtcttgaatctaaatccaccattggcgttgagttcgctactcgaagtattcgtgttgatgataaagtcgtcaaagctcaaatttgggatactgctggccaagaaaggtaccgtgcaatcactagtgcttattatcgaggtgctgttggtgcattactcgtttacgatgtcactcgtcatgtcacatttgaaaatgttgagagatggttgaaagagctccgagaccatacagattctaacattgtgatcatgcttgtggggaacaaggcagatttacggcatttgcgtgctgtttccaccgaagatgcacagacatttgctgagaaagagaaaacatactttatggagacctctgccctagaatcattgaacgttgaggatgcatttaccgaggtgcttactcaaatatatcgatttgtcagcaaaaaggctctggaggccggggatgaccctgctgctgtgcccaagggacaaaccattaatgtcaaggatgatgtatctgcagtgaaaaaagttggatgctgctcaacataataacccgaagaagcatttcagttaaggatgctaaagcttcgtttaatatgataaagcaagtccaacttgtggatgtggtggaagcatcgatcacacaatcgatttattctattccttgatacaggcttcccttacaccatgacaagctctttatcatagtgaacctgtatttatcttccatatgttgatttgatttaatatggaagatttggactattagattgtttgagaaggctacttttaagtttaatgatgttattacatgaagcccttttatttgggaccatgtatttttattgtcatagctacaatgtattgttttgtgtcatccttcggtatcctatactatctagt

SEQ ID NO: 3283 - DNA, 3564 bp, Musa acuminata
cgacggcaagaaccctagcgacgacggcggcgacgacgagtcgcagctcctcgcccaaagagaaggaaaagggcggtagaagggtttgcgggatctgatttccggcggaaggcgctggaagcggtggtgctgctgctgctgcggccggcgacggtggtagtggtggcgggatggcgtacagggcggacgatgattacgactaccttttcaaggttgtgctgatcggggactccggcgtcggaaaatcgaacctgctctcgcggttcacccgggacgagttcagcctcgagtccaagtccaccatcggcgtcgagttcgccacccgaagcattcgcgtggaggacaaggttatcaaggcccagatttgggataccgctggccaagagagataccgagcgatcacaagtgcgtattatcggggagcagttggtgcgctagttgtctatgatatcacacgtcatgtgacatttgagaacatagagagatggttgaaggaactcagagatcacactgattccaatattgtgatcatgctagtgggaaacaaggcagatctgcgacatcttagggctgttaatactgaggatgcaaaggatttttctgagaaggagaacgcgttcttcatggagacatctgctctggaatcaatgaatgtggaaaatgcctttactgaagtgctgacccagatatatcgagtggtgagcaggaagtcacttgaagctggtgatgatccagcagatttgccgaagggtcagacgatcaatgtcggcaccaaggatgatgtatccgctgttaagaaagctggttgctgctcatcttaggtttaagaggtgagacaactgttatcccgacataccgaaacagcaggttatcacacgcttactgactacacggacaagttgtcgagcatgacactaaacgagatggttcttgctgcgaatttgtgtttttgtttaaggttttaaatgtggtctaagatgtttaaaatttgcattgtccttattgtagaaccgaagaccattttgtttgatagatcatgtattgctagtaggtttgttcaactcatctttgttgcatttttcattagatgtttgatagataatgctatgatttgatattggaagcatcatatgttttgttcagtcttttttgtgactcacagatcgcctaaatgagaagacgatccaaatacatattgttgatcgtatgcagccttacattagtcttcgatcgtatgcagccttacagttcgccttacattgtagttttaaagtgtccaaaaggagagggtaattaaacagaacacacttaaacgcagtaatttgcaaccaacatgaagacgaatgcaaaaggcggcgtgatgatgagccatgcagtcactccctcctcttccctctcatgcttcattgctgctgtcccttcttcttcttcttccaaatgtctaccaccgtccaaactccgcctcccttcatcatcccgccgcacgccgccccgccagcgccgtcgtcgtccatgtcccctgccatcagtggcgacccccaaccgacgtgccaggcctcgaggcgcttgtccatcgacccgcagcttctcccctccgcgtccagcgccgcggcgcccgcctccgccgccttccgccactgctccgtctgcgccctcagccgcctcatctccgcctccagcgccgccttcgccccctccgccgcctccagctgctccgccagccggtccgctttggctctgctcgctttgagctcctcctccgtcgactccagcttcgccatgagctccgcttcctttgcccgtgctgcgcccgccatcttcttcgcctccgcctcggcgttcgtcttcaagatcgcattctctaccacgagaatctccgcttccttctccttctccaacagcttgacctttaggtggtctacctccgggctcacaggaagcaccgccactgctttgctctccttttcctcttcctctgcagcgaccgccgcgtcgtcctcatcatcgtttcttctctcaatggctgtcattttctcctcttccctcgatactacttcaaaggcatccatcgacttgttctcccgttgaggtttctcttcattgagctcctccctggctgtgctcagcctggtcttcttgtcggccaccatcgtgcctttcttcctcttaatgcattgaagacaccgaccatggcgttgcgtcagatcacaggcgccgagatcacgagcgtgaaatgatttgatggcgagcaagaagaagaaggccattgattaccacttgcaacgcagcacgggggcacacttcggggcgacatggcggtgcacgctgtcggcctgtggtcttcaggtcgagcggtgactgccgctgaggcacaccgacgctctgcccgccatcaaaacacttcccgccacacgtataacacacgcaacacaggatttgacttttcaacacctgcatccacaaatggcagctgcctcacagtataaactggatttgttctccccagtacctgctgcatcctcaaggcaggcacttggaaatatcatctctaatcacaaagcctgcacatttcaagagccattcattgttaaggatgtgtcatcattgcacattacgtcgcaacaagcaatcaaactaataaaagaacttgaggacggattcagcattactctcagttcaacagtcaaacagaacacgactcactcgcttccctttcttcatcaccttctttgattcgactttattggctcctcaggaagaaggtggccctaccagtaccagcatctgcggcatcatcacagcaggttccctttcaataacacagctgagctgtagctcatcctgagcatttgatctcccattgttcgctaataatatgatccaatcaataagcagagcagctcacaaccatccttgcagtggcctcaatggagccgcccaagctgctccaacgtgcacaaggccgggtgggaatgctgataacagcactagcagaacaacatctgttacaagccgagtttggtgatggcagctaaagcgcaaaaaatgcaaccaggggttgatttgtaggaaccacagggcacaaactgggttatctttgatcccccatgctccattgtagttcattgttcttccataagcctccatcaaacaagcaaatacaatgtagcactgacgcaacctacttctcggagatgcttgggcacaattgctaactctgatgaaactgaatgcccaccatagattagcctggaagttgctgtgagcaaaacaaatactgaagaggcccaatgagaatgctaagtgcatcaatataataacacaactaagagtaactgcaaagttgaaaaaaaaacgcctgcaatgccagatcatatatgttctgccagaaagaatctgcagccttgaggtaaaaaagctttactgaaaacgctacagtatataatttggaaatctaacgagtattcatttgctcataggacaattcttggatctgcataattgcagatgactggcaagcatataaactgttaatctgttgtgtgctttaagacttcaaaacac

SEQ ID NO: 3284 - DNA, 1152 bp, Cichorium intybus
atgacagtcccttgccagcccaacatctcttgagcctcgagacgagtcggcgcctctttgcgtctacataaaccatgcctgctcgttgatgatcgtcttttaagaatagaagacttgaagtggtttattcgatactgattgttgacgcgaaggccgaagctcgcacttgatcataccaactcatggcggcgtatagagctgacgatgactacgattatctgttcaaagtcgttctgattggagactccggtgtcggaaaatctaacttgctttccaggttcaccaggaacgagtttagtcttgaatctaagtccacaatcggtgttgaattcgccaccagaagtattcgtgttgatgacaagatcatcaaggctcagatttgggatactgccggccaggaaaggtaccgtgcaatcacgagtgcttactacaggggagcggtcggtgctttggttgtttacgacacaacacgccatgtaacctttgagaacgttgaaagatggttgaaagagctcagagaccacagtgattcaaacattgtgataatgttagtaggaaacaaagcagatttgcgtcacttacgtgcagtttccacagaagatgcaaagacatttgctgaaaaggaaaacacgtacttcatggagacatcagctttagaggccacgaatgttgaggattctttcactgaagttcttacacaaatatatcatgtggtaagccgaaaagcacttgatattgggaacgatcctggagctttgcctaaagggcaaacgattaatgttggatcaaaagatgatgtttctgctgtcaagaaagttggttgctgttctagttgaaaatcaggtggtggatgatcaagatttttgaaggttcgggtgatatcaggttagtttttgaacttttaatgagagaagtagatgtggctactggtattactttaaattttcctggtctttttgtattatttgatttgttaactgcaatggatcatgtattatatatttggatacctgttcttaagatttataacacgttttgtttttaacattagattggagcaaattgggatgttgagtttgattggtttttgagcatcaagatctttgttcttgtgaaactttctttaaaatgtgatggctgaatgctgacgta

SEQ ID NO: 3285 - DNA, 945 bp, Trifolium pratense
caaactcatcaaaatcattttttcttttaaatctttgatcttttctctctagccaaacaccattgttaaaaaagaggtgtgtggcaaatgggggcgtatagagctgatgatgattatgattatctgttcaaggttgttctgattggtgattctggtgttggaaaatccaaccttttatcaagattcaccaagaatgaatttagccttgaatctaaatccaccattggtgttgaatttgcaacaagaagcattaaggttgatgataaggttgttaaggctcagatttgggatactgctggccaggaaaggtaccgagcaattacaagtgcatattatagaggagctgttggcgctttactagtttatgatgttacacgccatgttacatttgaaaatgtggcgagatggttgaaggagctgagagaccacacagatgcacacattgtggtgatgcttgttggaaacaaagcagatttgcgtcatttgcgtgcggtttcaactgaagatgcaacaagtttcgctgaaaatgagaacacatttttcatggaaacatctgccctcgagtccttgaatgtcgaaagtgccttcactgaagtgctgacacagatctaccgtgttgtgagcaagaaagccctcgagattggtgacgatccagcagcactacctaaaggacagacaattgatgttggatctcgggatgatgtctcggctgtgaagaaatctggatgttgctctgcttgagcttacagtaaaagtatctgtatttttattggaaacctatgccatgtttatatccttatagagaccagccttacggcatcaaaatgattgtctagattctagagagcatcacttctaacttttggcattggtctagcaaaatctgttcaatattagttagatgtttaggatacatgcactttcattttgatttgttcatttttc

SEQ ID NO: 3286 - DNA, 983 bp, Trifolium pratense
tctagccaaacaccattgttaaaaaagaggtgtgtggcaaatgggggcttatagagctgatgatgattatgattatctgttcaaggttgttctgattggtgattctggtgttggaaaatccaaccttttgtcaagattcaccaaaaatgaatttagccttgaatctaaatccaccattggtgttgagtttgcaacaagaagcattaaggttgatgataaggttgttaaggctcagatttgggatactgctggccaggaaaggtaccgagcaattacaagtgcatattatagaggagctgttggcgctttactagtttatgatgttacacgccatgttacatttgaaaatgtggcgagatggttgaaggaactgagagaccacacagatgcccacattgtggtgatgcttgttgggaacaaagcagacttgcgtcatttgcgagcggtttcaactgaagatgcaacgagtttcgccgaaggagagaacacatttttcatggaaacgtctgccctcgagtccttgaatgtcgaaagtgccttcactgaagtgctgacacagatctaccgtgttgtgagcaagaaagcccttgagattggtgacgatccagcagcactacctaaaggacagacaattgatgttggatctcgggatgatgtatcggctgtgaagaaatctggatgttgctctgcttgagcttacagtaaaagtttctgtatttttactgtaacctatgccatgtttatatcttcatagagatcaaccttacagcatgaaaatgattgtctagactctagagagtagagagcctcacttctaacttgtggcattggtttagcaaaatctgttcaatattagttagatgtttaggatacatgcactttcattttgattggttcatttttctgttgaagatattcatttatctaatttcaggtttattgaatatttacagtgactcgatttggattagttttcactttat

SEQ ID NO: 3287 - DNA, 1159 bp, Petroselinum crispum
agtcgggcggcccaacgggttgagacccaataacagaagtaagtatttaggtggagacagagtccatcggtcacacactcttccgatctaaaccttgatacaatgggggcgtacagagcagacgatgattacgattacttattcaaaatagtactaatcggtgactctggcgttggtaaatctaatcttctttccaggttcactcgtaatgagtttagtcttgagtccaaatctactattggcgtcgagttcgctactcgtagcattcacgtcgatgataaagtcgttaaagctcagatttgggacactgctggtcaagaaagataccgtgcaatcacaagtgcatactatcgaggagctgtcggggcattgcttgtatatgatgtcacgcggaatgttacatttgagaatgtagaaagatggctcaaagaactccgtgatcacactgattccaacattgtcataatgctagtggggaacaaggcggatttgcgtcatttgcgtgctgtcgccactgaagatgcgactgcatttgcggagaaggagagtaccttcttcatggaaacgtctgctctagagtccatgaatgttgaagatgctttcacagaagtgcttgctcagattcatcaagttgtcagcagaaaagctcttgaatcaggaaatgatccagcagctgtgccaaaaggacagacaattaatgttaaggatgacgtatcagcggtgaaaaaatctggatgttgctcttcctagaatttggtaaattgatgtgtgcaataagttgccaatcttcagtgatgtcttatatacgtctgattgtacctttccatatcggttctggtcaacaaatctagagcttatggcggaattagaatacttgagtttgctgttatttaagtatgtaagtgggtctcggggtttaatctttctatagtcgacatataaagttagttataggtaccctttgcttagttcctattcaattacttgcaacaggctgttcgttttcttcctctatagtgcaattgttttccttagtaatttagtgacgactgttattattgtgtaatgtagaaaggctagcatgccggtcttttttctactttgatttggtcatttttgtagaacataatgttgactagttagtggagttcagatttct

SEQ ID NO: 3288 - DNA, 1090 bp, Populus trichocarpa
aaaaaaaaaggagaaaaaaacccatcaaatgggagcctatagagctgacgatgattacgattacttgtttaaggtggtattgatcggtgattcaggcgttggcaaatccaatctcttgtctcgttttacaagaaatgaattcagtctcgaatccaaatccaccattggcgtcgagtttgctactcgcagcattcgcgttgatgataaaatcgttaaggcccagatttgggacactgctggccaagaaagataccgtgctataacaagtgcatactatcgaggagctgttggagccttactagtctatgatgtaacccgccatgttacattcgagaatgtggagagatggctaaaggagcttcgcgatcacacagatgctaacaatgtgatcatgcttgtaggaaataaagcagacctgcgtcacctccgagcagttgccactgaggatgccaagggttttgctgaaagagagagcacatttttcatggagacttctgctctcgagtcaatgaatgttgaaaatgctttcacagaagtgctaacccagatctaccgtgttgtaagcaggaaggctcttgacgttggagatgactcaacatacttgcccaaaggacagacgattaatgtcggaagcagagatgatgtctcggctgtgaaaaaggctggatgttgctcgtcatgagcgttgcaaagtttcgaaatgtttctcttccgagattttattagcctaaagattgtcgtctttgggacatcatacaggtttatctgaccacacgacaatatgctatgttgacaaaagacattcaacagtctaaatgttactattttttaagaactagagatgaatttgtagcccattttgaatcttaaatttgtcatgtttctttatttgttgttcttctccagataaagtatttgcttgcctccaccctccctccatgtgatagcagcagcctagtgctgtagttttatgtaaagtttggttgtctaggtcataaacgtgtaaagacctggctctgacggagcatgtaatactgaaagctcaaggctaaaaattcattttattggtatattatttttcaacttattc

SEQ ID NO: 3289 - DNA, 1073 bp, Abies balsamea
gaaatggtgtgtcgggagacgatccttttctgaagggcaggccttagaattgtgcgggcctcagaattgtgcggcaattcgcaggggataaaatggcttacagagcagacgatgactacgattacctcttcaaggtggtactgattggagactctggtgtcggcaagtccaatctgctgtcgagatttactaggaacgagttcagcttggagtccaaatctaccatcggggtggagttcgcaactcggagtataacagtagatgataaggtcataaaggcgcagatttgggacacagctggtcaagagagataccgggctataacaagtgcatattatcgaggagcagttggtgcactgttagtttatgatgtaaccagacatgtaacctttgagaacgtggaaagatggcttaaggagcttagggaccatactgatgccaatattgttataatgcttgttggtaacaaggctgatttgcgtcatcttagagctgtttctacagaggatggcaaagcgtttgcagaacgagaaaatacatatttcatggaaacatcagctctggaatcaacaaatgttgagaatgcatttacggaagtacttagccagatctaccgaatcgtgagtaagaaagctcttgatgttggggaggacccagcagcggtgcccagtaaaggacagacgatacatgttggtaacaaggatgatgtgacagcaatgaagaaagttgggtgttgttctgtataggcccaaagtgcaatgctctagagtgttgtcttctaaagcttttgtttttaaagcgactcttttcgaggaattgatttaaatatgtcaaagttgaaaggaggtatcgatggttgcctgtcaattttaagagacaagcaccctgctatatctattgctctgtatgatttatcagtgaacttttgctgctcttggatgcctccgaagcgcattgttgccatttagcttttgttgctactatatgttttaagaaacatttcaattatttgtaatgtggttattttggacagatcatgtcaagtattggttaattgtatctctaaatattga

SEQ ID NO: 3290 - DNA, 949 bp, Arabidopsis lyrata
ttcttgtgcggcgtttctgcttctccgtttgtccgtacgcgttttcttaccggtgacctgaaactctccgattctcgaacgagcagctgcttctctgataatggcggcgtatagagctgacgatgattacgatttcctgtacaaggtggtattaattggtgattccggcgtcggtaaatccaatctgctttctcgattcacgcgcaacgagttcagcctcgagtctaaatccaccatcggtgtcgaattcgccacccgaagcattcatgtcgatgaaaaaatcgtcaaggctcagatttgggacaccgccggtcaagagagataccgagcaatcacaagcgcttactatcgaggagctgtaggagctttgcttgtttatgatgttactcggcatgtgacatttgagaacgttgagagatggttgaaggagctcagagatcacacagaggccaacattgtgatcatgcttgttgggaataaggcggatctacgtcacctaagagctgtttcaaccgaagatgctaaagcctttgcagagagagagaacacattcttcatggagacatctgcactcgaagcattgaacgttgagaatgctttcactgaagtgctttctcaaatataccgtgtggcaagcaagaaggccttggatattggtgatgatccggctacccttcctaaaggccagagtattaatgtcgggtctaaggatgatgtttctgaggttaagaaggttggttgctgctcaagttgatcttgatcaagccattttgtctggtaacgtttctttcttaggtaagaatatagtttggttatctatggaagatcgcagatgattcttctgtgtgtttttcctttagttgcttctttttccttcttttggtgtaagtttctcatatccttataatgttttaactatttttacataagcattcatattcgataatct

SEQ ID NO: 3291 - DNA, 1143 bp, Artemisia annua
tcacacacttcgtgacaccccactcctccactctccctccccagatctcccccaaaatttaacaacacttttcatcaacagatctcacaaaaaagaatgggagcatacagagcagacgatgactacgactaccttttcaaagtagtcctcatcggtgactccggtgtgggtaaatccaacttgctgtctagattcactcgtaatgagttcagccttgagtcaaagtcaactattggagttgaatttgctaccaggagtattaaagttgatgataaagttgttaaggctcagatttgggatactgctggccaagaacgataccgtgcaattacaagtgcatactaccgaggagcagttggtgcattgcttgtctatgatgtaacccggcatgtcacttttgagaatgtcgagaggtggttaaaggagctccgtgaccatacagattccaacattgtcatcatgcttgtaggaaacaaatctgatctgcgtcatttaagggctgtgacaactgaagatgccaaagcattcgctgaaaaagagaacacttattttatggaaacatctgcgcttgaatcatcgaatgttgaaaacgccttcacagaagtccttactcaaatccaccaagttgtcagcagaaaagctcttgatgttggagaagatcctggtgctttgccaaagggacagactattaatgttggcaacaaagatgatgtatcagcattgaagaaggcgggctgctgttccacttagatggaagaagcagttgcatcctttgtaagttctcattatcatatgaacatcacatttcaaagtacaaatcatagttttaatcccgttttgccaagactagataagggtttaagggtatctccggaactgcatgattgagttgagccaaaactgtgacagaagaattgatttctatgctttatttttatgttttttttagcatgatgtattgttatagctgtgagcaaccacatagagtaggcaaatacctgagtggtgaatgtggttttggcattccaaatgtattaacgattctattgctgctatccttgtaattttatttttcatctgacatccgtgaacaaaatgaagctttaccaatttcttaagtatcatcctttttctgagttttgg

SEQ ID NO: 3292 - DNA, 1635 bp, Phaseolus vulgaris
ccaaacaaaaagaaaggttaaatttgaaggtttttccttcattttctctatccaaaagaaaaaaaagaagataataagatgtatggaagagggtgaaaaaggtaaaaggaagcaaagccattttgattgttatgcttgtttgatatatcattcattccattctagcttggagtgcttctccctccatacccttctgccattacaacaacatcaacaccacccctctttctctctcttcttcatttccaatgctgaaagttgaagggttcatagacactgacccaattgaattccccgcaaaataattgaagaaaaaaccgtcaaagttaggattttttgaaggcacggatcgcgtgagaaggaagagggaaaatgggtgcgtacagagcggacgatgattacgactacttgttcaaggtggtgttgatcggagattccggcgttgggaaatcgaacctcttgtctcgattcacgaagaacgaattcagcttggaatctaaatccaccattggcgttgaatttgccacccgcagcatccacgtcgatgacaagatcgtaaaggcacaaatttgggacaccgcgggccaagaaagatatcgcgcaattacaagtgcctattatcgaggggccgtgggagctttgcttgtgtatgatgttaccagacatgtgacttttgaaaacgtggagagatggttaaaggagcttcgtgatcacacagatgccaacattgtaatcatgcttgtagggaacaaggctgatctccgtcacctaagagccgtggccacagatgacgcgaaggcgtttgctgagcgagaaaacacattttacatggaaacatctgctcttgagtccttgaatgttgacaatgccttcacagaagtgctcactcagatatatcgtgttgttagtaggaaaactcttgagattggagatgaccctgcagccttgcctaagggccagaccatcaatgttggcagtagggatgatgtctcagctgttaaaaaggctggatgctgctctgcatagtttcacaagccttttgcagcagaatggtatatctatatgtgcatgattcaaccaaccaattctcaacattttgggatccaagtgaaagcttttaatacctacacttatctttttatgtaatttctcctacatatcttgccaagtttattgttttttttccctcttcttttcttttcatgtaagcatggtttggtcataggaatgatgtcatgttgcccttagatatatacggaatttactgtttgtattgagtgaaagctatatctggttcttagattgattcagaagttgttacattacaatctcatcattctttatcaaagtttccattctactggaacaagaaaaaactttgatagattgttagtgttattcatcctgaaagagttatggcttgttgatacatagggcagcatatcatagcaattgcaatacttcacaaatatatagtgctcagcacacaggaaaaaggattgcaagaaattatacacttgttgcactggttaagttttagctataataacaatattagtctttaactgtacatctggtgtacactttcttttttacttcttgtagatctaacaaaaatatgccccttggtcttta

SEQ ID NO: 3293 - DNA, 939 bp, Gossypium hirsutum
agaggaatgggagcttacagagcagatgatgactatgattacttgtttaaggttgtcctgattggcgactccggtgtcggaaaatccaaccttttgtctcgatttacaaagaacgagtttagccttgaatctaagtccaccattggggttgagtttgcaacccgtagcattcgtgttgatgataaggtcgttaaagctcagatttgggacactgctggccaagaaagatatcgtgcgataacaagtgcgtactaccgtggtgctgttggtgctttactagtctatgatgtcactcgtcatgttacatttgaaaacgtagaaaggtggctgaaagaacttagaggtcacaccgatgccaacatcgtgattatgttagttggaaacaaggcggacctgcgtcacttgcgagcagtctccaccgatgatgctaaagcttttgccgaacgagagaacacctttttcatggaaacatccgcgctagagtctttgaacgtcgggagcgcattcactgaagtgctggctcagatttatcgtgttgtaagcaagaaagctcttgatgtaggagatgatccctcggctttgcctaaaggccagacgatcaatgtaggatcgaaagacgatgtatcagctgtgaagggagctggatgttgctcggcttaaggatggtgaaaaaagtccaaagagatatttagttgatatctgcatagaagtttttgccttgcatcacaaaacgtgaacgtcaacaaagtatcaaccaagtttttgacattgtgctttggaacatgctaagcacaacttgtccatgtttagcttgaattctaggactttaaggttactggtttttatgttatttttttcgttgttaattttcagacagattgcttttggttctttcctttgttcattgcctttttaagtgcaaaaccatcataattttac

SEQ ID NO: 3294 - DNA, 1056 bp, Gossypium hirsutum
taaattcaaaaattttaatataaaaatccataaaagaacccgacccggtgacccggaatggcggcgtatagagcagatgatgactacgattttttattcaaggtggtgttgatcggagattcaggtgttgggaaatcgaatttgttgtcgagatttacgaggaacgagtttagccttgaatccaaatccacaatcggagttgaattcgccacccgaagtattcgggtcgatgataaggtcgttaaggcacagatttgggacaccgccggacaagaaagataccgagcgattacaagtgcatactaccgtggagctgttggtgcgttgcttgtctatgatgtcactcgacatgtcacatttgagaatgttgaaagatggttgaaggaattacgaggtcacacggattcgaatatcgtgattatgcttgttggtaacaaggcggacctgcgacacttgcgtgctgtttccaccgatgatgctaaggcctttgccgagagagaaaataccttctttatggagacatctgcccttgagtctatgaatgttgagaatgcattcactgaagtagtaactcaaatacatcatgttgtcagtcgaaaagcacttgaagtaggagatgatcctgcagcattaccaaagggacgaaccatcaatgtaggaagcaaggatgatgtttcagccgtcaagaacgctggctgctgttctgcttaaatgttagatgatatatcctccatttttcttatctttaagcacaagatttgagattgaagtcaaaggagaaagtagcagtttccaaatttccttcatttgatttcggttccttactcgtggttcttttatggtattggtctccctagtgtaatgttccatttcatagttttgatagtttttgttgtatttgattgctttagaatacatagcagacagatctagtttgggtttctaaataattttcattagttgtggatgataaattttgaattatttaagacaatacatcttaaattcgtccatacgtgaatgctagaaattgtatacaaaattggaattgcaaaa

SEQ ID NO: 3295 - DNA, 944 bp, Gossypium hirsutum
taacagaggaatgggagcttacagagcagatgatgactatgattacttgtttaaggttgtcctgattggcgactccggtgtcggaaaatccaaccttttgtctcgatttacaaagaacgagtttagccttgaatctaagtccaccattggggttgagtttgcaacccgtagcattcgtgttgatgataaggtcgttaaagctcagatttgggacactgctggccaagaaagatatcgtgcgataacaagtgcgtactaccgtggtgctgttggtgctttactagtctatgatgtcactcgtcatgttacatttgaaaacgtagagaggtggctgaaagaacttagaggtcacaccgatgccaacatcgtgattatgttagttggaaacaaggcagacctgcgtcacttgcgagcagtctccatcgatgatgctaaagcttttgccgaacgagagaacacctttttcatggaaacatccgccctagagtctttgaacgtcgagagcgcattcaccgaagtgctggctcagatttatcgtgttgtaagcaagaaagctctcgatgtaggagatgatccctcggctttgcctaaaggccaaacgatcaatgtaggatcgaaagacgatgtatcagctgtgaagggagctggatgttgctcggcttaaggatggtgaaaaaagtcaaaagagatatttaattgatatctgcatagaagtttttgcctcgcatcacaaaatcgtgaacatcaacaaagtatcaaccaagtttttgacattgtgctctggaacatgctaagcacaatctgtccatgtttagcttgaattctaggactttaaggttactggtttttatgttatttttttctttgttaattttcagacagattgtttttggttccttcctttgttcattgcctttttaagtgcaaaatcatcataattttac

SEQ ID NO: 3296 - DNA, 1098 bp, Euonymus alatus
agtgatagtcagatattcatgtcttcagctcctgctcacgcttcttcactaatcactgctttattacattcattttcttccattttaaatctccgcggatagaaatctctaatctgattcgtcaaagctgcttcctttcctgatccgtttagctgctgaaagaaccccgcccgaccagaacaggaagagactagggaattggaaatggcggcttacagggccgacgacgattacgactacctgttcaaggtggttattataggggactccggggtgggcaaatctaacttgctgtctcgattcacgaaaaacgagttctcgttggagtctaagtccaccatcggagttgaattcgctactcggagtattcgagtcgatgacaatgtcgtcaaggcccagatttgggatactgctggccaagaaaggtatcgagcaatcactagtgcatactatcggggagctgttggtgcattgcttgtgtatgatgtcactcgacatgtcacatttgagaatgccgagagatggttaaaggagctaagggatcatactgactccaatattgtgattatgttggtgggaaataaggcagatctgcgccatttacgagctgtttccacggaggatgccaaggcctttgcagagagagagagcactttctttatggaaacatctgcactcgagtctttgaatgtcgagaatgcctttactgaagctctaacccaaatatatcatgtagtcagcaggaaagctcttgatattggggatgaccctgcagctttgcccaagggacaaaacatcaatgttggaaccaaggatgatgtttctgctattaagaaagttggctgctgctctgcttaactgtaagaggaagatgaaggatacccaatatatatctatccactgagattattcgtgctagacttaccgtattacaggacatggtctgtctcctaacttttaaaccttattaatcatgtacgcctgggctttttcttgagagcttttttcgagcaaacccggatcttgaagattttttccttttcacttggatgtcacttctttcatagtctcttccagttttttgctcccttgtgcatg

SEQ ID NO: 3297 - DNA, 1130 bp, Panax ginseng
atttctccctctacagtatatacatattcattacttataaacaagattattctttcttatctctacctctctcgaagccattgttagagagagaaaggttggaactttgaaaacacagtactaccttactttatatatatggcggcatacagagccgacgaggactatgattatctattcaaggttgtcctgatcggagattcaggtgtcggaaaatccaatctgctctccagattcaccaaaaatgaatttagtttggaatccaaatccaccatcggtgttgaattcgccaccagaagtattcgcgtcgacgataagatcgtcaaggcccagatttgggacacagctggccaagaaagataccgtgcaataacaagtgcgtattatcgaggggcggttggtgcattgcttgtgtatgatgtcacccgacatgtcacgtttgagaatgttgagagatggttaaaagagctgcgagaccacacagatgccaatattgtgataatgctggtgggaaacaaggctgacttgcgtcatttgcgttctgtttccaccgaggatgcaaagtccttcgctgagagagaaaacactttctttatggagacatcagcgcttgaatctttgaatgtagagaattcattcactgaagttcttagtcaaatatatcatgtagtcagccggaaagcacttgagattggggatgatcctgcagcattgcctaaagggcaaacaatcaatgttaaggatgatgtttcagcagtgaaaaaagttggctgctgctctgtgtaactacaagagtaaatcattggtgagtgagagaacttttcaagaactcaacttggcagctctggttcgtcccaaatattcctatgtttcaatagttgggatggtttgagataatctaaggctaactgctaagtttggagtctacgaggaaattcagcctgagggattttcatttatccaaggccagttcattggtactactatttatttaaggggtttttttttgtcaatctgtattgtttcatttgtttacggccgtagtttgtattgtattttatcgaactgaattagttttttgttgataggttgtattttttaacacactgagtagttgagtgttgatttta

SEQ ID NO: 3298 - DNA, 1227 bp, Panax ginseng
aagcagtggtatcaacgcagagtacatggggaattgactttgacctcatttgattgccaacgaaagaaaacgttctatccagctaatcctgtttttctctctcctaaatatgggggagattgaacaaaagtaaatctcacgttttgaaaatcaaattcattttttgtgagatcaaatttgccattttgatcttcttcgtccaaattccaaacgcataatttgcataataattttctctctctggaatataatttaggatcagaaacagaattgtactcttagaataacagggggaaatctaagaaaagaaaatgggagcttatagagcagatgaggattacgattacctgttcaaggtggtgttgatcggagattccggcgtcggaaaatcaaatcttttatctagattcacgcgtaacgaatttagtctggaatcaaagtcgacaatcggcgtcgaattcgccactcgcagcattcacgtcgacgataaggtcgtcaaggctcagatttgggacactgctggtcaagaaaggtatcgtgcgatcacaagtgcttactatcgaggagctgttggtgctttactagtctatgatgttacccggcatgtaacatttgaaaacgttgaaagatggctcaaggagcttagggatcatacagactccaacattgtgatcatgcttgtagggaacaaagcagacttgcgtcacttgcgagctgtccctacagatgatgcaaaggcctttgcccaacgggagaataactttttcatggaaacatctgctctcgagtctttgaatgttgagaatgcctttacagaagtgctgacacaaatctatcgtgtagtaagtaggaaggctcttgacataggagatgacccaaccgtcttgcccaagggacagactatcaatgttggaggcagggatgatgtatccgcagtaacgaaaggcggatgttgctctacataaaaagtttccatgtctgaagaatttcatctacatgtccttgttcatacttgaaacttgaaagaaaggagggttcatttacaagtcacgaggatgcttggtctgcaaaattatctctgttagatacgtgctttgaatactaggagtatagttgttgttcccactcgtctcctttactgatgtactcttagaaaatatgattttggcatttgtgtttcattcagttgttagttagtattataaatataaagaatgaatattttgc

SEQ ID NO: 3299 - DNA, 1311 bp, Panax ginseng
aagcagtggtatcaacgcagagtacatgggatcttcaaacatttctccctctacagtatatacatattcattacttataaacaagattattctttcttatctctacctctctcgaagccattgttagagagagaaaggttggaactttgaaaacacagtactaccttactttatatatatggcggcatacagagccgacgaggactatgattatctattcaaggttgtcctgatcggagattcaggtgtcggaaaatcaaatcttctctccagattcactaaaaacgagtttagtttggaatctaaatctacaatcggtgttgaattcgccaccagaagtattcgcgtcgacgataagatcgtcaaggcccagatttgggacacagctggccaagaaagataccgtgcaataacaagtgcgtattatcgaggggcggttggtgcattgcttgtgtatgatgtcacccgacatgtcacgtttgagaatgttgagagatggttaaaagagctgcgagaccacacagatgccaatattgtgataatgctggtgggaaacaaggctgacttgcgtcatttgcgttctgtttccaccgaggatgcaaagtccttcgctgagagagaaaacactttctttatggagacatcggcgcttgaatctttgaatgtagagaattcattcactgaagttcttagccaaatatatcatgtagtcagccggaaagcacttgagattggggatgatcctgcagcattgcctaaagggcaaacaatcaatgttaaggatgatgtttcagcagtgaaaaaagttggctgctgctctgtgtaactacaagagtaaatcattggtgagtgagagaacttttcaagaactcaacttggcagctctggttcgtcccaaatattcctatgtttcaatagttgggatggtttgagataatctaaggctaactgctaagtttggagtctacgaagaaatacagcacgagggattttcatttatcctaggccagttcattggtactactatttatttaagggtttttttgttctaatctgtattgtttcatttgtttacggtccgtagtttgtattgtattttatcgaactgaattagttttttgttgataggttgaattttttaacacactgagtagttgagtgttgattttataaaatgactagttcctctagcaagctacttagacatctctggctataagtacagtagaaaggtgaaatagaactttggattgcatcctccaggcgccaggggtctgaatcataggtgttatatgaactatttgagtcgta

SEQ ID NO: 3300 - DNA, 1062 bp, Panax ginseng
gaagccattgttagagagagaaaggttggaactttgaaaacacagtactaccttactttatatatatggcgtcatacagagccgacgaggactatgattatctattcaaggttgtcttgatcggagattcaggtgtcggaaaatccaatctgctctccagattcaccaaaaatgaatttagtttggaatccaaatccaccatcggtgttgaattcgccaccagaagtattcgcgtcgacgataagatcgtcaaggcccagatttgggacacagctggccaagaaagataccgtgcaataacaagtgcgtattatcgaggggcggttggtgcattgcttgtgtatgatgtcacccgacatgtcacgtttgagaatgttgagagatggttaaaagagctgcgagaccacacagatgccaatattgtgataatgctggtgggaaacaaggctgacttgcgtcatttgcgttctgtttccaccgaggatgcaaagtcctgcgctgagagagaaaacactttctttatggagacatcggcgcttgaatctttgaatgtagagaattcattcactgaagttcttagccaaatatatcatgtagtcagccggaaagcacttgagattggggatgatcctgcagcattgcctaaagggcaaacaatcaatgttaaggatgatgtttcagcagtgaaaaaagttggctgctgctctgtgtaactacaagagtaaatcattggtgagtgagagaacttttcaagaactcaacttggcagctctggttcgtcccaaatattcctatgtttcaatagttgggatggtttgagataatctaaggctaactgctaagtttggagtctacgaggaaatacagcatgagggattttcatttatccaaggccagttcattggtactactatttatttaaggggtttttttttgtcaatctgtattgtttcatttgtttacggccgtagtttgtattgtattttatcgaactgaattagttttttgttgataggttgaattttttaacacactgagtagttgagtgttgattttataaaa

SEQ ID NO: 3301 - DNA, 1147 bp, Gossypium raimondii
gtttcatttatacccagcccatccaaacccagaaaaaaaataatacacattcgaaaaagaaacgccttttttatatatttaaatttccatttacaattttaaatattttttgacgccaatcaaagacaacaatcggacgaacgaagaagaaaacccagaagaaaagaaaagaaagcaaaaaggaaaaaaattcacataacagaggaatgggagcttacagagcagatgatgactatgattacttgtttaaggttgtcctgattggcgactccggtgtcggaaaatccaaccttttgtctcgatttacaaagaacgagtttagccttgaatctaagtccaccattggggttgagtttgcaacccgtagcattcgtgttgatgataaggtcgttaaagctcagatttgggacactgctggccaagaaagatatcgtgcgataacaagtgcgtactaccgtggtgctgttggtgctttactagtctatgatgtcactcgtcatgttacatttgaaaacgtagagaggtggctgaaagaacttagaggtcacaccgatgccaacatcgtgattatgttagttggaaacaaggcagacctgcgtcacttgcgagcagtctccatcgatgatgctaaagcttttgccgaacgagagaacacctttttcatggaaacatccgcgctagagtctttgaacgtcgagagcgcattcaccgaagtgctggctcagatttatcgtgttgtaagcaagaaagctctcgatgtaggagatgatccctcggctttgcctaaaggccagacgatcaatgtaggatcgaaagacgatgtatcagctgtgaagggagctggatgttgctcggcttaaggatggtgaaaaaagtcaaaagagatatttaattgatatctgcatagaagtttttgcctcgcatcacaaaatcgtgaacatcaacaaagtatcaaccaagtttttgacattgtgctctggaacatgctaagcacaatctgtccatgtttagcttgaattctaggactttaaggttactggtttttatgttattttttttctttgttaattttcagacagattgcttttggttccttcctttgttcattgcctttttaagtgcaaaatcatcataattttacacaaaa

SEQ ID NO: 3302 - DNA, 1129 bp, Tropaeolum majus
gtcaccaacctgatattcgtgatccaaatttaaaaccccgcctatatctatctacctactgacctgagatacaaacccggtacgggagcggatacaatggcggcctacagaacagacgacgactatgattacctctttaaggttgtattgatcggcgattcgggcgtgggaaaatccaacttgttgtcacgttttacgaagaatgagtttagtctcgaatccaagtctacaattggagttgaattcgcgactcggagcatccgggtggatgacaaggtcgtcaaggctcagatttgggataccgcgggccaagaaagatatcgtgccatcacaagtgcatactaccgaggagctgttggtgcattgcttgtttatgatgttaccagacatgtcacatttgagaatgttgaaagatggttgaaggagcttagagatcacacagattccaatattgcaatcatgcttgttggtaacaaggcagatcttcgtcacctccgtgctgtttcgactgaggacgccaaggcttttgccgaaagagagaagacattcttcatggaaacatctgccctcgaatcattgaatgtcgaggatgcattcactgaagtgctaacccaaatatacggtgttgtaagccgaaaagccctagatgtaggggatgatccagcagccttgcctagaggccaaactattaatgttggatcaaaagatgacgtttcagccgtcaagaaaggtggttgctgctctgcttaaatatgggaatttaacttctaaaggaccccatccaacagcttttagtgttgcaatcagtgtgttggatgcttaagcttctccaacaccatttttaagatcgaaggctaaagatcatgctgcatcttcaatattttcgccaatgtaacttgataattgtagtttcttgttgtaatttgttctttagaataggaaatatgctttcagatcatttcaattccatgattgtttaaataacttgtttgtttgcttttggttcctccatggtttcagatcactgtatgatttgtgagtttaggagattacagaactatgttagaggtcaaattttgtaaggacatgtagtttacttttcttagccatagcatgtgggtaggtttca

SEQ ID NO: 3303 - DNA, 830 bp, Olea europaea
aagtgaggaagtagtaatgggtgcatatagagcggacgacgactacgattacttgttcaaggtggtgctgatcggcgattcgggtgtcggaaaatcgaatttactgtcgagattcactcgaaatgagttcagtctcgaatccaagtcgaccatcggcgttgagttcgccactcgaagcatccgggtcgatgataaagtagttaaggctcagatttgggacactgccggccaagaacgatatcgtgcaatcacaagtgcctactatcgaggagctgttggtgcattgcttgtatatgatgtcactcgtcatgttacatttgaaaatgttgagagatggttgagggaactcagggatcatacagattctaacattgttatcatgcttgttggaaataaggcagacttgcgtcacttgcgcgctgttcaaaccgaagatgcaaaggcatttgctgaaagagaaaatgcgtttttcatggaaacctctgctttggagtctatgaacgtagaaaatgccttcacagaggtgcttgctcagatacatcaagttgtcagcaggaaagctcttgaggctagtgatgatccagctgccttacctaaagggcagaccattaatgtcagctctaaggatgatgtttcagctgtaaagacaggtggttgctgctctgcttagtcgagaccaaagagtgagaagcagatgcagttgtgggggtatcgtccatgtttacagtaacggcacagttcatttcgcctttagttttagctcatcggcatccaaaaatttgtccaagtcaagccaactcttaagagtaagagtcttagttaaatgcttg

SEQ ID NO: 3304 - DNA, 1149 bp, Arachis hypogaea
ccaacgaagaatcccacatttccagcgcctacctctttctctttcactttgcttctcaattccaattcactctttaacaaactaacaaagtttcgtttttttaaacctcccttccaatttccaaatctcgttccatcttcaactatgacccttatcttccacttccattttcaactacccatttgagcctccttaaaattcacccaatcaaaatcctttctttcttttgttttctttctgggaaatgggggcctacagagcggatgacgattacgattacctcttcaaggtggtgctgatcggtgactctggcgtcggaaaatcgaaccttctctctcgcttcacaaggaatgagttcagccttgaatccaagtccaccattggtgttgagttcgccaccagaagcattaaggttgatgataaggttgtcaaggctcagatttgggacactgctggtcaagagaggtaccgggcaattacaagtgcttattatcgaggagctgttggtgctctactagtttatgatgttactcgccatgttacgtttgaaaatgtggcgagatggctaaaggagctgagagatcacacagatgccaacattgtggtaatgcttgtaggaaacaaggcagatctgcgccatctgcgagcagtttccgtcgaagacgccactgcctttgctgaaagagagagcacatttttcatggaaacatctgcccttgagtcgatgaacgttgagaatgccttcacagaagtcctgacccagatccacagcgtcgtaagcaagaaggcccttgaagttggtaatgatccagcagcattgccaaaagggcagacgatcaatgttggttcccgggacgacgtctcagcggtgaaaaaaggtggatgttgttctaattgagtatgtagtacaagtgtctgtaattttaaattcagaatctgccttgtttataaccaaccatgtagagattgcccagacaacagcatcagaatgatattctagaaagcagcatcaaaccataatttatgtttatgttttggtcggaagagggaatctgttggatattagctagagcctaggtgtttttcactttcatttaaccttttaagatattcataattatccaatttatctaatttcatattttctta

SEQ ID NO: 3305 - DNA, 889 bp, Pisum sativum
ttcttcgctttccttcaattctattttaaaccacaacaaacaaaaccattttctctctccatttctccttcttttccctctacccaaatgggggcatacagagccgatgacgattacgattatctcttcaaagtggtcttgatcggtgattcaggtgttggtaaatcaaatcttctttccagattcacaaaaaacgaattcagcctcgaatctaaatccaccattggcgttgaattcgctaccagaagcattcgtgttgatgataaggttgttaaagctcagatttgggataccgccggtcaagaaaggtaccgagcaattacaagtgcttattatcgtggagctgttggcgctttattagtctacgatgttacccgccacgtaacatttgaaaacgtggagagatggctaaaagagctgagagatcacacagatgccaacattgtcgtgatgctcgtaggcaacaaagctgacctgcgtcatttacgggcagtttcgacggaagattctacatcttttgctgaacgggagcatacatttttcatggagacatctgcccttgagtccttgaacgttgaaagtgccttcacagaagtgttgacacagatataccgtgttgtaagcaagaaggcacttgagattggcgatgatccagctgctttacctaaaggacagacgattaatgttggttcccgtgacgatgtatcagctgtgaagaaaggtggatgttgttctgcttgagtatgctgtaaaagtctctgtatttttactccgaaatttatttcctgtttataccatgtagagatttaactgacagaatgaaggtgattggttagagagtatcaaacaaagaagtttctgctttagtctgtagagaattatgttcaat

SEQ ID NO: 3306 - DNA, 1105 bp, Populus trichocarpa
agctaaaacgacacaaaaaaaaaggagaaaaaaacccatcaaatgggagcctatagagctgacgatgattacgattacttgtttaaggtggtattgatcggtgattcaggcgttggcaaatccaatctcttgtctcgttttacaagaaatgaattcagtctcgaatccaaatccaccattggcgtcgagtttgctactcgcagcattcgcgttgatgataaaatcgttaaggcccagatttgggacactgctggccaagaaagataccgtgctataacaagtgcatactatcgaggagctgttggagccttactagtctatgatgtaacccgccatgttacattcgagaatgtggagagatggctaaaggagcttcgcgatcacacagatgctaacaatgtgatcatgcttgtaggaaataaagcagacctgcgtcacctccgagcagttgccactgaggatgccaagggttttgctgaaagagagagcacatttttcatggagacttctgctctcgagtcaatgaatgttgaaaatgctttcacagaagtgctgacccagatctaccgtgttgtaagcaggaaggctcttgacgttggagatgactcaacatacttgcccaaaggacagacgattaacgtcggaagcagagatgatgtctcggctgtgaaaaaggctggatgttgctcgtcatgagtattggaaagtttcgaaatgtttctcttccgagattttattagcctaaagattgtcgtctttgggactccatacaggtttatctgaccatacgacaatatgctatgttgacaaaagacattcaacagtctaaatgttgcaattttttaagaactagagatgaatttgtagcccattttgaatcttaaatttgtcatggttctttatttgttgttcttctccagataaagtatttgcttgcctccaccctccctccatgtgatagcagcagcctagtgctgcagttttatgtaaagtttggttgtctaggtcataaacgtgtaaagacttggctctgacggagcatgtaatactgaaagctcaaggctaaaaattcattttattggtaatattatttttcaacttattc

SEQ ID NO: 3307 - DNA, 1219 bp, Glycine max
gaaaaaacaattggaaaatggaattaattgtttgtttgatgcaaagcactttgcagttaccatactgtcatcatttcattcccccctaacaatttgccaactaagaaaccccacctttccagctttttgctctctcaaaacttgttcctattgttgttgttgttaccaaaaggttgttccaaatctggatttcaaaaacaatatagattcgccgcaacccatttgaatctctgagagaaggagcatatcaaaatcatttttctttttcctgaagagcaaatgggggcgtatagagctgatgaggattacgattatctgttcaaggttgtgctgattggggactctggtgtgggaaaatcgaaccttttgtctaggttcaccaagaacgaattcagccttgaatccaagtccaccattggggttgagtttgccaccagaagcattagggttgatgaaaaggtactcaaggctcagatttgggacactgctggccaggaaaggtaccgagcaatcactagtgcatattatcgaggagccgttggtgctttattagtctatgatgttacccgccatgttacatttgaaaatatggagagatggttgaaggagctcagagatcacacagatgccaacattgtggttatgcttgttgggaacaaagcagatttgcgtcatctgagagcagtttctactgaagaagctacagcttttgcggaacgggagaaaacgtttttcatggaaacatctgccctcgagtccatgaacgttgaaaatgccttcacagaagtgctgacacagatctatcatgttgtaagcaagaaggcccttgaaattggtgatgatccagcagcattaccaaaaggacagacgataaatgttgggtctcgtgatgacgtatcggctgttaagaaagatggatgttgttctgcttgagcatgcagtaaaaacctctgtatatgttctgtttatatccatgtagagtttcacccttaaagcatgaaaatgattgtctagagagcattacaatctcaactttctgctttgctatgcagagaaatctgttcaattcaagtcaatttttcaggaagcatgcacttccattttgctatttggttgttgttgtttcatgaagctgttaatttatcgaatttgtcttaggcttctttattctttttgttctttttcatgcatgcagattcatgctatccaaatttatttt

SEQ ID NO: 3308 - DNA, 1153 bp, Solanum lycopersicum
tctgcatcttcttctccgatccttcatctctcttcttcttcattttctctctctatacatacatatattatatatatatatatataaacgtattgagagaccaccagtaatgggggcgtacagatcggacgacgattacgattatttgttcaaggtggtgttgatcggcgattccggcgtcgggaaatctaatcttctatccagatttacacgtagcgagttcagtttggagtcaaagtcaacgatcggcgttgaattcgctactcgtagcattcgtgttgatgataaggttgtcaaggctcagatttgggatactgccggtcaggaacgatatcgcgcaatcacgagtgcctactatcgaggagctgttggagcattgcttgtctatgatgtcacccgtcatgtaacttttgagaatgtagagagatggttaaaagagctccgagatcacactgactctagcattgtcataatgctggtgggtaacaaggcagatttgcgtcatctgcgtgctgtttctactgaggatgcccaggcatttgcagagaaggaaagtacatttttcatggaaacatccgctttggagtccatgaacgttgaaagtgccttcacagaagtgctcactcaaatacaccgcgttgttagcaggaaagctcttgaagtaggagatgacccggcagcagttcccaaggggcagacgataaatgttggaggcaaggatgatgtttctgaagtaaagaaagctgggtgctgttctgcttagaacaaagagtaatctacagcgcggaagagattctttttgttttgagctgaatttcacatgacatttgtacgtcaacctctaaccacatgaattgcttagcactaatagctttattcactggataactagacattgttgaattgagtgcacccccaagattgaatagtatccaaattagctttattcatatcattctttatccttgtttctctattttgcttccattggtcaatgatttattgtattagctgctgcttatggacctccaaaatagggtatatttgtttcaaaaagattctgaatcgtgctacgtgtatgaaactattaacacattttatcctgtcttgtaattgattgtttgatttatcgtgaattgagaaatattttcaa

SEQ ID NO: 3309 - DNA, 925 bp, Triphysaria pusilla
gggtgcataccgagccgacgatgactatgattacttgttcaaggtagtactgatcggtgattccggcgtcggaaagtccaatttgctgtccagattcactcgcaatgaatttagcttggagtctaagtcgacaatcggagtcgagtttgccacacgcagcatccgcgtcaatgagaaagtcgtcaaggctcagatttgggacaccgctggccaagagcgatatcgcgcaattacaagtgcttactatagaggagctgttggtgcattgctagtctatgatgtcacacgccacgtcacatttgaaaacgtcgagagatggttgaaggaactcagggatcatacagattcaaacattgtgatcatgctcattggaaacaaggctgatttgcgtcacttgagggctgtttctacagaggatgcaacagcttttgccgaaagggaaaagacgtttttcatggaaacctccgctttagaatcgctgaatgtggaaaatgcctttacagaggtgctttcacagatatataacgttgtcagcaggaaagctttggaaggtgccgatgacccagcagccctacccaagggccagaccattaatgttggttcaaaagatgatgtttcagcagtaaagaaaggtggctgctgctcctcttaaagagcatgtttcaagctgaaagccgttcctttctttcgaaatgagatttaatattttttttctgcgtggtttgataatctacttcattgtatacattgatcactttgactgtttgggcatttaattcattgacatgcgaaatattttacttaggttaagacagtgctactagagcatggctatttctattttttgtcatctgctatcattggctcaaattcatctagatgtagtgtatctttgtatttggaagatttattcattctcttcccc

SEQ ID NO: 3310 - DNA, 961 bp, Eschscholzia californica
atttcatttacaatcttattaaagtgggggcatacagaggcgacgacgattatgattatctattcaaagtagttctaatcggtgattcaggtgttggaaaatctaatttactttcaagattcacaagaaatgaattcagtcttgaatcaaaatctactattggtgttgaattcgctacaaggagcattcacgttgatgataaggttgtcaaagctcaaatttgggataccgctggccaagagaggtaccgagcaatcacaagtgcatactatcgaggagctgttggtgcattgctagtctatgatgttacgcgccacgttacatttgaaaatgtggagagatggttaaaagaactccgagatcacaccgatgccaatattgtaataatgctggtgggaaataaagcagatcttcgtcatttacgggcagtttctgttgaagatgcaaaagcttttgcagaaagagagaacaacttcttcatggagacatctgcattggaatcaatgaatgtcgaaaatgctttcacagaagtccttagccagatttatcgtgtcgttagcagaaaagctcttgatattggagatgatccagcagcattacccaaaggacagactattaatgtgggatcaagggatgatgtgtcggccgttaagaaggctggatgttgctcttcttgatctaacgaggtgactattttttttttgaaagcaatattaacgaggtgactattgaaccccaactgatactctgtttctacataattgttgattctcggctagacttaattgttcattcttaaaaatccattgagaacacaatgaactaaattgtagagggttcttatgttaccttacctattcctggtcaagctgtttattcgatcaatcaaatattgattaggtaagtcttgtttctatacagggtactgttgtatttgtttggatcattatttgaatgtgtt

SEQ ID NO: 3311 - DNA, 1042 bp, Ipomoea nil
ggtctgctccactgttctaaggaacggatctttttactctctgcaaatttttgatcattcatatatatacataatactttactgtatttgtatctgcgtatagagatggctggcggctacagtagagctgatgatgactatgattacctctgcaaggtggtgctcataggcgactccggtgtcggcaagtccaatctgctctcgagattcactcggaacgagtttaacctcgagtcaaagtccaccattggcgtcgagttcgccacccgcagcatccgggtcgacgacaaggtcgtcaaggctcagatttgggacaccgccggccaggaaaggtaccgtgccattacaagtgcatactaccgaggggctgttggtgcattgcttgtatatgatgttacccgtcatgtcacatttgaaaacgttgctagatggttaaaagagcttagagatcacacagaccagaacattgtgataatgctggtgggaaataaggcggatttgcgccacttgcgcgctgtttcaactgaggatgcgacggcctttgctgaaagggagagcacctttttcatggaaacatcggctctcgagtccctgaacgttgagaacgccttcacagaggtgctaacccagatataccatgtgatcagtcggaaagcacttgaggttggggatgacccggcagccttgccaaaggggcaaaccataagcgtgggagggaaggatgatgtttcagctgtaaagaaagttaattgctgctctgtctgaatttacaggtctgcattattgccctctagctcaaactccaaacactcagctacttccagttaatacatctgatgtagttgccttattattatgattatgtttttttgaactgcttgtgaaatgtagttttgcacttcatagagaattgcagcatagtctcaatcccttttgcagtggatgatgtctgcttaagcattttactccatttgtgtattgtttcatttgtatatctgctcattcaccgcctctttttcgagcctctgactagctttataca

SEQ ID NO: 3312 - DNA, 1099 bp, Cajanus cajan
caaaagttgttccaaatctcgatttcaaaacaaagtacgtttctttcatcataaatatagattcgccgcaacccatttgaatctgtgagagaaggagcatatcaaaatcattttttccccttgattttctctttagccaaacaccagatagaaaagtgtgtgtgtggctaatgggggcgtacagagctgatgaggattacgattatcttttcaaggtggtgctgattggggactctggtgtgggaaaatccaatcttttgtcgaggttcaccaagaacgaattcagccttgaatcaaagtccaccattggggttgagtttgccaccagaagcattagggtagatgataaggttgtcaaggctcagatttgggacactgctggccaggaaaggtccacattcccgagcaatcaccagtgcatattatcgaggagctgttggtgctttattagtctatgatgttacccgccatgttacatttgaaaacatagagagatggttgaaggagctcagagatcacacagatgccaacattgtggtgatgcttgttgggaacaaagcagacttgcgccatttgcgggcagtttccaccgaagatgctacaacttttgcggaacgggagaaaacatacttcatggaaacatctgcccttgagtccatgaatgttgaaaatgccttcacagaagtgctgacacagatctatcatgttgtaagcaagaaggcccttgaaattggtgatgatccagcagcattaccaaaagggcagactataaatgttagttctcgtgatgatgtatcagctgtgaagaaatctggttgttgttctaattgagcatgcagtaaacctctgtattttcactttaaagtttaaacctatgttctgtttatatctatgtagagttcagccttacagcatgaaaatgaatgtctagtgagcattacaatctaaactttctgctttggaatacagagaaatcggttcaatggaagtcatttgtttaggaaacatgcactttcattttgcttgatgccctatactgttgtttcatgaagctattgaattatttcagatttatcgcagttttcacaggcttctttat

SEQ ID NO: 3313 - DNA, 1110 bp, Chrysanthemum coronarium
cacacacacacgcataaaactcttcgtgacaccccactcctccactccccagatctcccccaaattcaacactttccaacaacagatctcacaaaaaaatgggagcatacagagcagacgatgactacgactacctattcaaagtagtcctgatcggtgactccggtgtgggtaaatccaacttgctgtctagattcactcgtaatgagttcagccttgagtctaagtcaactataggagttgaatttgctaccaggagtatcaaagttgatgataaagttgttaaggctcagatttgggatactgctggtcaagaacgataccgtgcaattacaagtgcttactaccgaggtgctgttggtgcattgcttgtctatgatgtaactcgacatgtcacttttgagaatgtagagaggtggttaaaggagctccgtgaccatacagattccaacattgtcatcatgcttgtaggaaacaaatctgatctgcgccatttaagggctgtgacaactgaagatgccaaaacatttgctgaaaaagagaacacttattttatggaaacatctgcccttgaatcattgaatgttgaaaacgccttcacagaagtccttactcaaatccaccaagttgtcagcagaaaagctcttgatgttggagaagatcctggtgctttgccaaagggacagactattaatgttggcaacaaagatgatgtatcagcattgaagaaggcgggctgctgttccacttagatggaagacgcagttgcatcctttgtaagttcttattatcatatgaacatcacatttcaaagtacaaatcatagttttaatcccgttttgccaagactagataagggtttaagggtatctccggaactgcatgattgagttgaaccaaaactgtgacagaagaattgatttctatgctttaattttatgtttttctttagcatgatgtattgttatagctgtgagcaaccacatagagtaggcaaataccagagtggtgaatgtggttttggcattccaaatgtattaacgattctattgctatctttgtaattttatttttcatctgacatccgtgaacaaagtgaagctttaccaa

SEQ ID NO: 3314 - DNA, 1170 bp, Cichorium intybus
aaagtaacgagagttgcgtgaaaaatgaaaaatctaagcaaaaatcagcagccaaaatctctttgaaacatctcgcccttttgtccttcacctcgtttgcacttctccctctctctacctctactatcgcataaaccctcttgcagatttctattgttgttttccccgtttccatcatacagatctgctttagatcaaaaccgcaagcatttcttgcgctttttcattctgttgtgaagatcattgtatagacagatatgggtgggtacagagcagacgatgattacgattacttgttcaaagtagttctgatcggggattctggagtcggaaaatcaaatctgttgtcgagattcactcgaaacgagttcagtcttgagtccaaatccacaatcggcgttgaattcgccacccgtagcattcgtgttgatgataaagttgttaaggctcagatttgggacaccgctggccaggaacggtaccgcgctatcacaagcgcatactaccgcggcgcagtgggcgcgttactcgtctacgacgtaacccgccacgtcaccttcgaaaacgtcgaacgatggttaaaagagctccgggaccacaccgattccaatatcgtcataatgctcgtaggcaacaaagccgatttacgccatttacgcgccgtccaatcagaggacgccacgtcattcgccgaaaaagaacacacgtatttcatggaaacttccgccctcgaatcactaaatgtagaagatgcattcacggaagttcttacccaaatttatcatattgttagccggaaagctctagaagccggcgatgatgccgccgcgttgccgaaaggacaaacgattaatgtgggcggcaaagatgacgtgtcggcggtgaagaaaggcggatgttgttcgagttaggttgaaaagggttgagttcttggtgtgttttggttaatttaattgaaaattcgatataaatcatagtctttttattgtttcatgaaaaccaaatgtggattttacgggtggctgaatgatttctggggttatgtttaatctgtattgttataattgatatttcatagcaatcttttaatagggtttaaatttctttgtggtttttgtggtgttcaaattgtagcaagattctattgttatctatgtattatgattgatc

SEQ ID NO: 3315 - DNA, 1115 bp, Cichorium intybus
aaagtaacgagagttgcgtgaaaaatgaaaaatctaagcaaaaatcagcagccaaaatctctttgaaacatctcgcccttttgtccttcacctcgtttgcacttctccctctctctacctctactatcgcataaaccctcttgcagatttctattgttgttttccgcgtttccatcatacagatctgctttagatcaaaaccgcaagcatttcttgcgcattttcattctgttgtgaagatcattgtatagacagatatgggtgggtacagagcagacgatgattacgattacttgttcaaagtagttctgatcggggattctggagttggaaaatcaaatctgttgtcgagattcactcgaaacgagttcagtcttgagtccaaatccacaatcggcgttgaattcgccacccgtagcattcgtgttgatgataaagttgttaaggctcagatttgggacaccgctggccaggaacggtaccgcgctatcacaagcgcatactaccgcggcgcagtgggcgcgttactcgtctacgacgtaacccgccatgtcaccttcgaaaacgtcgaacgatggttaaaagagctccgggaccacaccgattccaacatcgtcataatgctcgtaggcaacaaagccgatttacgccatttacgcgccgtccaatcagaggacgccacgtcattcgccgaaaaagaacacacgtacttcatggaaacttccgcactcgaatcactaaatgtagaagatgcattcacggaagttcttacccaaatttatcatattgttagccggaaagctctagaagccggcgatgatgccgccgcgttgccgaaaggacaaacgattaatgttggcggcaaagatgacgtgtcggcggtgaagaaaggcggatgttgttcgagttaggctgaaaagggttgaggtcttcttggtgggttttggttaatttaatggaaaattcgatataaatcatagtctttttattgtttcatgaaacacaaatctggattttacgggtggccgaatgatttctggggttatgtttaatttgtattgttataattgatatttcatagcaatcttttaatagggtttaaatttctttgtggt

SEQ ID NO: 3316 - DNA, 1200 bp, Cichorium intybus
aaagtaacgagagttgcgtgaaaaatgaaaaatctaagcaaaaatcagcagccaaaatctctttgaaacatctcgcccttttgtccttcacctcgtttgcacttctccctctctctacctctactatcgcataaaccctcttgcagatttctattgttgttttccccatttccatcatacagatctgctttagatcaaaaccgcaagcatttcttgcgcattttcattctgttgtgaagatcattgtatagacagatatgggtgggtacagagcagacgatgattacgattacttgttcaaagtagttctgatcggggattctggagttggaaaatcaaatctgttgtcgagattcactcgaaacgagttcagtcttgagtccaaatccacaatcggcgttgaattcgccacccgtagcattcgtgttgatgataaagttgttaaggctcagatttgggacaccgctggccaggaacggtaccgcgcgatcacaagcgcatactaccgcggcgcagtgggcgcgttactcgtctacgacgtaacccgccacgtcaccttcgaaaacgtcgaacgatggttaaaagagctccgggaccacaccgattccaacatcgtcataatgctcgtaggcaacaaagccgatttgcgccatttacgcgccgtccaatcagaggacgccacgtcattcgccgaaaaagaacacacgtacttcatggaaacttccgcactcgaatcactaaatgtagaagatgcattcacggaagttcttacccaaatttatcatattgttagccggaaagctctagaagccggcgatgatgccgccgcgttgccgaaaggacaaacgattaatgtgggcggcaaagatgacgtgtcggcggtgaagaaaggtggatgttgttcgagttaggttgaaaaagggttgaggtcttggtgggttttggttaatttaatggaaaattcgatataaatcatagtcttttttattgttttatgaaaaccaaatgtggattttacgggtggctgaatgatttctggggttatgtttaatctgtattgttataattgatatttgatagtaattttctgaataggtttaaatttctttgtggtttttgtggtattcaaattgtagcaagattttattggtatctatgtattatgattgatcattggtggatgtgtgaacaaaagtaaaa

SEQ ID NO: 3317 - DNA, 1059 bp, Cichorium intybus
gcccaacatctcttgagcctcgagacgagtcggcgcctctttgcgtctacataaaccatgcctgctcgttgatgatcgtcttttaagaatagaagacttgaagtggtttatttgataccgattgttgaagcgaagctcgcatttgatcataccaactgatggcggcgtatagagctgacgatgactacgattatctgttcaaagttgttctgattggagactccggtgtcggaaaatctaacctgctttccaggttcaccaggaacgagtttagtcttgaatctaagtccacaatcggtgttgaattcgccaccagaagtattcgtgttgatgacaagatcatcaaggctcagatttgggatactgccggccaggaaaggtaccgtgcaatcacgagtgcttactacaggggagcagtcggtgctttggttgtttacgacacaacacgccatgtaacctttgagaacgttgaaagatggttgaaagagcttagagaccacagtgattcaaacattgtgataatgttagtaggaaacaaagcagatttgcgtcacttacgtgcaatttccacagaagatgcaaagacctttgctgaaaaggaaaacacgtacttcatggagacatcagctttagaggccacgaatgttgaggattctttcactgaagttcttacacaaatatatcatgtggtgagccgaaaagcacttgatattgggaacgatcctggagctttgcctaaagggcaaacgattaatgttggatcaaaagatgatgtttctgctgtcaagaaagttggttgctgttctagttgaaaatgaggtggtggatgatcaagatttttgaaggttcgggtgatatcaggttagtttttgaacttttaatgagagaagtagatgtggctactggtattactttaaattttcctggtctttttgtattatttaatttgttaactgcaatggatcatgtattatatatttggatacctgttcttaagatttataacaattttcgtttttaacattagtatgaagtaaattgggatgttgagtttgattg

SEQ ID NO: 3318 - DNA, 1427 bp, Cicer arietinum
ggaaaaagtaaaattaagccaacccaaccaacaacccatgcagtgtctttttataatgataataataatatttttaattccatttaattccagctttgaatgcttctcctcctccctcctctctttctttttctttctgtaatcataaacaacaattaaaccaatgcatctctctctctctctctctccaatgctgaaatttgaaataattccctttccttaaatttctaaaccccttccatacttcaaatccaccgccatataagagacacaaaaatgggtgcgtacagggccgacgacgactacgactacctatttaaggtggttctgatcggagactccggcgtcggtaaatccaacctcttgtcacgattcaccaaaaatgaattcagtttggaatctaaatccaccattggtgttgaattcgcaacacgcagcatacacgtcgatgataagattataaaggcacaaatttgggataccgcaggacaagaaagatatcgagcgatcacaagtgcatattatcgaggcgctgtcggtgcattgcttgtgtatgatgttacaaggcatgtaactttcgaaaacatggagagatggttaaaggaacttcgggatcacacagatgccaacattgtaattatgcttgtggggaacaaggctgatcttcgtcacctgcgtgccgtgtccactgacgatgctaaggcatttgctgaaagagaaaatacgttttttatggaaacgtctgcgctcgagtctttaaatgtcgacaattctttcacagaagtgctcactcaaatatatcgagttgttagtaggaagactctcgagattggagatgaccctgctgccttgcccaaaggacagacaatcaatgttggcagtagagatgatgtttcagctgttaaaaaggttggatgctgttcggcgtagtttgagtgataatagaaacgaaatgaaagtcttcacaacaaacagtatatctatctgtgaatgagtcaaccattcctcagtatttaggatccatgtgaaatgttttaatacctaagctttcttttttgtattttttcccacatgttttgtcgagttattattttgccactttttttactaagtgttgtttggtcatagggattatatcattttacccttagatgtaagaaagtacactgtattaaatgaaagggatatcctgtcactaggttgttcagaagttacaatacttgttactcttcctctaattttctttaccactggaaaaagaaaagttcttttgatagagacgagtattgttcaatcctgaatttgtaatgtgcatatactgcttaatgctgttctgatgtaaaactatcaacttaatctttataacgtttttgttattggcatagaagctccttcgcaagttaaaaaactcatctagacgcatgttt

SEQ ID NO: 3319 - DNA, 1150 bp, Cichorium intybus
gaaatgaaaaatctaagcaaaaccagcagccaaaatctctttgaaacatctcgcccttttgtccttcacctcgtttgcacttctccctctctctacctctactatcgcataaaccctcttgcagatttctattgttgttttccccatttccatcatacagatctgctttagatcaaaaccgcaagcatttcttgcgcattttcattctgttgtgaagatcattgtataaacagaaatgggcgggtacagagcagacgatgattacgattacttgttcaaagtagttctgatcggggattctggagttggaaaatcaaatctgttgtcgagattcactcgaaacgagttcagtcttgagtccaaatccacaatcggcgttgaattcgccacccgtagcattcgtgttgatgataaagttgttaaggctcagatttgggacaccgctggccaggaacggtaccgcgcgatcacaagcgcatactaccgcggcgcagtgggcgcgttactcgtctacgacgtaacccgccacgtcaccttcgaaaacgtcgaacgatggctaaaagagctccgggaccacaccgattccaacatcgtcataatgctcgtaggcaacaaagccgatttacgccatttacgcgccgtccaatcagaggacgccacgtcattcgccgaaaaagaacacacgtacttcatggaaacttccgcactcgaatcactaaatgtagaagatgcattcacggaagttcttacccaaatttatcatattgttagccggaaagctctagaagccggcgatgatgccgccgcgttgccgaaaggacaaacgattaatgtgggcggcaaagatgacgtgtcggcggtgaagaaaggcggatgttgttcgagttaggctgaaaagggttgaggtcttcttggtgggttttggttaatttaatggaaaattcgatataaatcatagtctttttattgtttcatgaaacacaaatctggattttacgggtggccgaatgatttctggggttatgtttaatttgtattgttataattgatatttcatagcaatcttttaatagggtttaaatttctttgtggtttttgtggtgttcaaattgtgcaagattctattgttatctatgtattatgattgatc

SEQ ID NO: 3320 - DNA, 963 bp, Cichorium intybus
gcccaacatctcttgagcctcgagacgagtcggcgcctctttgcgtctacataaaccatgcctgctcgttgatgatcgtcttttaagaatagaagacttgaagtggtttatttgatactgattgttgaggcgaagctcgcactcgatcataccaactgatggcggcgtatagagctgacgatgactacgattatctgttcaaagttgttctgattggagactccggtgtcggaaaatctaacctgctttccaggttcaccaggaacgagtttagtcttgaatctaagtccacaatcggtgttgaattcgccaccagaagtattcgtgttgatgacaagatcatcaaggctcagatttgggatactgccggccaggaaaggtaccgtgcaatcacgagtgcttactacaggggagcagtcggtgctttggttgtttacgacacaacacgccatgtaacctttgagaacgttgaaagatggttgaaagagcttagagaccacagtgattcaaacattgtgataatgttagtaggaaacaaagcagatttgcgtcacttacgtgcaatttccacagaagatgcaaagacctttgctgaaaaggaaaacacgtacttcatggagacatcagctttagaggccacgaatgttgaggattctttcactgaagttcttacacaaatatatcatgtggtgagccgaaaagcacttgatattgggaacgatcctggagctttgcctaaagggcaaacgattaatgttggatcaaaagatgatgtttctgctgtcaagaaagttggttgctgttctagttgaaaatgaggtggtggatgatcaagatttttgaaggttcgggtgatatcaggttagtttttgaacttttaatgagagaagtagatgtggctactggtattactttaaattttcctggtctttttgtatcatttaatttgataactgcgatgga

SEQ ID NO: 3321 - DNA, 998 bp, Vigna unguiculata
aaaagtgaagttcgctttcgtatcacccttcatctaaatctgggatttttcttttcagttccaattgcaacattttctctctctctctctctctctctctctctctctctctcacttttctcttttcactctctccaaatccatacatacacagtaaaaggaggaacaacaaatgggggcttaccgagccgatgacgattatgattacttgttcaaggtggttctgatcggcgactccggcgtcggcaaatcgaaccttcttactcgcttcacgcgaaacgagttcagccttgaatccaagtccaccattggcgttgagttcgccaccagaagcattcgcgtcgatgacaaggttgtcaaggctcagatttgggacactgctggccaagaaaggtaccgagcaattacaagtgcgtattatcgtggagctgttggtgctttactagtctatgatgttacgcgtcatgttacttttgaaaatgtggagagatggctgaaagagctgagagatcacacagatgccaacattgtggtgatgcttgtagggaacaaagcagacctgcgtcatctgcgtgcagtttccaccgaggatgctacaagtttcgcccagcgagagaggactttttttatggaaacatctgccctcgaatcgttgaacgttgaaagtgcctttacggaagtgctgacccagatctatcatgttgtaagcaagaaggcccttgagattggagacgatccagcagctttaccgaaagggcagacgattagtgttggttcccgtgatgatgtatcagctgtgaagcaaggtggatgttgttctgcttgagtgtgtagtaaaagtcagtctctgtatttttactttaaaacacatgccttgtttataccatgtagagattcacctcacaacatgaatatgattgtttaaaaagcatcaaacagtttctgctatggtttgtagagaattatgttcaatgttagccagctatttttttaggaaa

SEQ ID NO: 3322 - DNA, 1066 bp, Euonymus alatus
ttacattcattctcttcctttttaaatctccgcggatagaaatctctaatctgattcgtcaaagctgcttcctttcctgatccgtttagctgctcaaagaaccccgccggaccagaacaagaagagactggggaattggaaatggcggcttacagggccgacgacgattacgactacctgttcaaggtggttattataggggactccggggtgggaaaatctaacttgctgtctcgattcacgaaaaacgagttctcgttggagtctaagtccaccatcggagttgaattcgctactcggagtattcgagtcgatgacaatgtcgtcaaggcccagatttgggatactgctggccaagaaaggtatcgagcaatcactggtgcatactatcggggagctgttggtgcattgcttgtgtatgatgtcactcgacatgtcacatttgagaatgccgagagatggttaaaggagctaagggatcatactgactccaatattgtgattatgttggtgggaaataaggcagatctgcgccatttacgagctgtttccacggaggatgccaaggcctttgcagagagagagagcactttctttatggaaacatctgccctcgagtctttgaatgtcgagaatgcctttactgaagctctaacccaaatatatcatgtagtcagcaggaaagctcttgatattggggatgaccctgcagctttgcccaagggacaaaacatcaatgttggaaccaaggatgatgtttctgctattaagaaagttggctgctgctctgcttaactgtaagaggaagatgaaggatacccaatatatgtctatccactgagattgttagtgctagacttaccgtattacaggacatggtctgtctcctaacttttaaaccttattaatcatgtatgcctgggctttttcttgagagcttttttcgagcaaacccggatcttgaagattttttccttttcacttggatgtcacttccttcgtagtctcttccagttttgctcccttgtgcatgttttattttgttgattggtgtaagttcttagtg

SEQ ID NO: 3323 - DNA, 1237 bp, Lactuca sativa
caagaattttgaaaaccacttaaccacatatattttatagtttcttaattcttatttattcatatttaaaatgaaattcagagataaaagagcaaatcagttccctcgttgacagtcccttgccagcccaacatctcttcagcttcgagacgggtcggcgcctctttgcgtctacatgaatcatccctgctcgttgctcatcgtcttttaagaatcaaagtggtttacttgatactcattcttcaaccgaagctctcattgaatcatactaactgaaacctgatggcggcgtatagagctgacgatgactacgattatctcttcaaagtcgttctcatcggagactccggtgtcggaaaatctaatctgctttccaggttcactaggaacgagtttagtcttgaatctaaatccacaatcggtgttgaattcgccaccaggagtattcgcgttgatgagaagatcatcaaggctcagatttgggatactgctggccaagaaaggtatcgtgcaatcacgagtgcttactacagaggagctgttggtgctttgattgtgtacgacacaacacgccatgtaacctttgaaaacgttgaaagatggttgaaagagctcagagatcacagcgactcaaacattgtgataatgttagtaggaaacaaagcagacttgcgtcacttacgtgcagtttccacagaagatgcaaagacatttgcagaaaaagaaaacacgtattttatggagacatctgctcttgaggccatgaatgtggaggattctttcactgaagttcttacacagatatatcatgtggtaagccgaaaagcacttgatattgggaatgatcctggggctttgcctaaagggcaaacaattaatgttggctcaaaagatgatgtttctgctgtcaagaaagttggttgctgttctagttgatgaaaatggtggagaatgaggatcaagatttttgaagattctggtgatatgatatcaggttagtgtttgagcttttaacaagaaattcagtagatgaggctactggtgttacttcaaattttcctggtctttttgtattatttgatttgttaactactatggattggatcatgtgttatatatttggatacttgttcttaagatttataacatttttcgtttttaacggtagattgaagtaaattgggatgtttgttttgatggtcttttgagcacatgatctttgatggattgacgaaat

SEQ ID NO: 3324 - DNA, 1207 bp, Lupinus angustifolius
tgcccaataaaaaactttatttttgccagtctttttatgttgtagattacaaactatggaggatttgtctctattttattttttaaataataataaataaaacctaggtgtgtggaaaagtaggagcaaagaagttgatttgaagttagaaacatagaccgattcgagctttgaatgcttcctcctccttcaacataaacagcacattctcagtctcttccccaactacgctgaaagttcctaactttttaaatgtatttatcaaactgaaatccttcaacacaactgatattaaaattaaaccccactcatttcctagaatttcaatcccacacatttgctagaatttaaatctataaagccttcagaaatctgagaatgggtccatatagagcggatgatgattatgattacttgttcaaggtggttctgattggagactccggtgtcggaaagtcgaatctgttgtctcgtttcaccaaaaatgagttcagtttggaatccaaatcaaccattggcgttgaattcgccacccgaagcattcaggttgatgataagattgtgaaggcccaaatttgggacactgctggccaagaaagatatcgtgcaatcacaagtgcatattatcgaggagctgttggagcattgcttgtgtatgatgtcaccagacatgtaaccttcgagaatgtggaaagatggttaaaagagcttcgggatcacacggacaccaacattgttattatgcttgtgggaaacaaggcagatcttcgtcacttgcgcgctgtggccactgatgatgccagggcttttgctgagagggaaaacacatttttcatggaaacatctgcacttgagtccttaaatgttgataatgctttcacagaagtgctcactcagatatatcacgttgtttgtaggaagactcttgagatcggcgatgaccctgcagccctgccgaaggggcagacaatcaatgttggcggtagggatgatgtatcggctgttaaaaaggctggatgctgctcggcatagattgaaggaggaaaggacttgacagcaacaaaatttacatctttctgtccatgattcaactatttctcaacattttgggatccatgtgaaatattatagtacctatgcttgtctttggtgtaattttgcttacttattttgggaagtcctattttgtattttcttttctattttt

SEQ ID NO: 3325 - DNA, 1323 bp, Pinus pinaster
atttgcacatcagaaaaccaattcacctgtcaacctaaacctacacctcaacaaacttacactgattgagacatatccagacagacatgtgacgttttctttggggttgggccctctccaccgtggcctgccttcccaaattgtacaatcattttaaacccaacatcctacaaataggatcatttggagcctcatttcactcggtttttctctcagtttgaagcggtggagaaatggtctgtaggcaaactaaccttttctgaagagcaggccttagaattgtagggtaatttgcaggggacaaaatggcttacagagcagatgatgactatgattatctcttcaaggtggtactgattggggactctggtgtgggcaagtccaatctgctgtcgagatttactaggaacgagttcagtttggagtccaaatccaccatcggagtcgagttcgcgactcggagtataacagtcgatgataaggtcataaaagctcagatttgggacacagctggtcaagaaagataccgggccataacaagtgcatattatcgaggagcagttggtgcactgttagtttatgatgtaaccagacatgtaacctttgagaacgtggagagatggcttaaggagcttagagaccacactgatgccaatattgtgataatgcttgttggtaacaaggctgatttgcgccatcttagagctgtttctatagaggatggcaaagcatttgcagaacgagaaaatacatattttatggaaacatcagctttggaatcaacaaatgttgagaatgcattcacagaagtacttagccagatttaccggattgtgagtaagaaagctcttgatgttggggaagacccagcagcggtgcccagtaaaggacagacgatacatgttggcaataaggatgatgtgacagcaatgaagaaagttgggtgttgttctttataagcccaaagtgcagtgctctaaagtgttgtcgtctgaagcttttgcttctaaagcgactctttttgaggaattgatttaaatgtcaaaagaaggattgatggttgcctgtcagttttaagagacaagcaccctgctattgctctgtatgatttattagtgaacctttgctgctcttggatgcctccaaagcgcattgttgtcatatagcttttgttgctactatacgttttagcaaatatttcaatgatttgtattgtggttattttggacagatcatgtcaaatattttgggttaattgtatctgtaaagattgagctggcaaatgcagttcaattttggtcgttatcctaattattcaaacca

SEQ ID NO: 3326 - DNA, 1199 bp, Olea europaea
gaggcacgcagtcatcttgatttcacctcagattcacactcactcctcgttctacaaaccccagattttcatacattcagtgtgtgtatacacacacacaaactccagtaagtaaaatgggtgcatacagagcggacgacgactacgattacttgttcaaggtggtgctcatcggcgattccggtgtcggaaaatcgaatttactgtccagattcacccgcaatgaattcagtttagagtctaagtcgactatcggcgttgaattcgccactcgtagtatccgagttgaagataaagttgtcaaggcccagatttgggacaccgccggacaagaacgatatcgtgcaatcacaagtgcctactatcgaggagcagttggtgctttgctagtctatgatgttacgcgtcatgtgacatttgaaaatgtcgagaggtggttgaaggagctcagggatcacacagattcaaacattgttgtcatgcttgttggaaataaagcagatttacgtcacttacgggctgtttccacagaagacgcgacagcatttgctgaaagagagagcacatattttatggaaacctcggccctggaatctatgaacgtagaaaattcattcacagaagtgctcactcagatataccgttttgtcagcagaaaagctcttgaagttggtgatgatccagcagctttacctaaggggcagaccattaatgtaggctcaaaagatgatgtttcagcagtaaagaaggttggttgttgctctgtttagaagtgtgtcaagatcgaaagcatctcaattttttcagtcttaacagtcaccaggttgtggattttcgtcctgtatacattgaccacatggattggttagccatcaaagttttagttaattgacatacaaaaatatgtccaaatcaggacacaactccttggtcatatcactcattatttttatagtcattgttatggtctcttgtttctttgtggtgtctattgttagtcttagccagttatgaaaatctcgcgtgagattacgtcgctcctggtttgagtatggacgtgcaacagttatgacttctatctatgtattctgattgattttcagatttttcactttgaacattaaaattaaacctgtaatcttgtaacatgaatttggttgatccgttttgttaatgaaatgtattttccccaaaatgcg

SEQ ID NO: 3327 - DNA, 1265 bp, Pinus taeda
ggggttgggccgtctccaccgtggcctgccttcccaaattgtacaatcattttaaacccaacatcctacaaataggatcatttggagcgtcatttcactcggtttttctctttcagtttgaagcggtggagaaatggtctgtaggcaaactaaccatttctgaagagcaggccttagaattgtagggtaatttgtagtggacaagatggcttacagagcagatgatgactatgattatctcttcaaggtggtactgattggggactctggtgtgggcaagtccaatctgctgtcgagatttactaggaatgagttcagtttggagtccaaatccaccatcggagtggagttcgcgactcggagtataacagtcgatgataaggtcataaaagctcagatttgggacacagctggtcaagaaagataccgggccataacaagtgcatattatcgaggagcagttggtgcactgttagtttatgatgtaactagacatgtaacctttgagaacgtggagagatggcttaaggagcttagagaccacactgatgccaatattgtcataatgcttgttggtaacaaggctgatttgcgccatcttagagctgtttctatagaggatggaaaagcatttgcagaacgagaaaatacatattttatggaaacatcagctttggaatcaacaaatgttgagaatgcattcacagaagtacttagccagatttaccggattgtgagtaagaaagctcttgatgttggggaagacccagcagcggtgcccagtaaagggcagacgatacatgttggcaataaggatgatgtgacagcaatgaagaaagttgggtgttgttctttataagcccaaagtgcagtgctctaaagtgttgtcgtctgaagcttttgcttctaaagcgattctttttgaggaattgatttaaatgtcaaaagaaggattgatggttgcatgtcagttttaagagacaagcaccctgctattgctctgtatgatttattagtgaacctttgctgctcttggatgcctccaaagcgcattgttgtcttatagcttttgttgctactatatattttagcaaatatttcaatgatttgtattgtggttattttggacagatcatgtcaaatattttgggtcaattgtatctgtaaagattgagctggcaaatgcagttcaattttggtcgttatcctaattattcaaactattatttcttaattttgcttactcgagtggtttttctctttta

SEQ ID NO: 3328 - DNA, 1243 bp, Picea glauca
tttcactctgattttcttctttcaatttgcagcggtgaagaaatggtctgtagggtgactaacttctgaaaagcaggccttagaattgtagggcaatttgcagtggacaaaatggcttacagagcagatgatgactacgattacctcttcaaggtggtactgattggggactctggtgtgggcaagtccaatctgctctcgagatttacaaggaacgagttcagcttggagtccaaatccaccatcggagtggagttcgcgactcggagtataacagtcgatgataaggtcataaaagctcagatttgggacacagctggtcaagagagataccgggcgataacaagtgcatattatcgaggagcagttggtgcactattagtttatgatgtaaccagacatgtaacctttgagaacgtggagagatggcttaaggaacttagagaccacactgatgccaatattgtgataatgcttgttggtaacaaggccgatttgcgccatcttagagctgtttctatagaggatggcaaagcatttgcagaacgagaaaatacatatttcatggaaacatcagctctggaatcaacaaatgttgagaatgcattcacagaagtacttagccagatttaccggattgtgagtaagaaagctcttgatgttggggaagacccagcagcggtgcccagtaaaggacagacaatacatgttggcaataaggatgatgtgacagcaatgaagaaagttgggtgttgttctgtataggcccaaagtgcaatgctctagagtgtcgtcgtctgaagcttttgcttttaaagcgactcgttttgaggaattgatttaaatatgtcaacagaagtataggcccaaagtgcaatgctctagagtgttgtcgtctgaagcttttgcttttaaaacgactcttttcgaggaattgatttaaatatgtcaaaggaagtattgatggttgcctgtcagttttaagagacaagcaccctgctatacttattgttctgtatgatttatcagtgaaccgttgctgctcttggatgcctccaaagcgcattgttgccatatagcttttgttgctactatacgttttagcaaatatttcaatgatttgtattgtggttattttggacatatcatgtcaaatattgggttaattttatctgtaaagattgaactggcaaatgcagttcaattttggtcgttacctaattattcaaactattatttctta

SEQ ID NO: 3329 - DNA, 1017 bp, Eutrema parvulum
gcccaaaatttaaatctctctctgtctctctcttcttgtgcgtttcttcttcccctttcgtctgtacgcgctttctcaccggttacctgaaaaaatctccgatcctcgaacgaagagcttcgtctctgatctcgaagaaacactcatcatggcggcgtatagagctgacgacgattacgatttcctctacaaggtggtactaattggagattccggtgttggtaaatcaaacctcctttctcgattcacgcgcaacgaattcagcctcgagtctaaatctacgatcggtgtagaattcgccaccagaagcattcaggtcgacgaaaaaatcgtcaaggctcagatttgggacacagccggtcaggagagataccgagcaatcacaagtgcatactatcgaggagctgtaggagctttgcttgtctatgatgttacacggcatgtcacgtttgagaacgttgagagatggctcaaggaacttagagaccacacagacgccaatattgtgatcatgctggttgggaacaaggcagatttgcgtcaccttagagctgtctcaaccgaagacgccaaagcctttgcagagagagagaacacattcttcatggagacatctgcactagaagccttgaacgtcgagaatgcttttactgaagtgctttctcaaatataccgtgtggcaaggaagaaagctttagatattggagatgatccagctactctccctaaaggacagagtatcaatgtcgggtctaaggacgatgtctctgaggtcaagaaggtcggatgctgctcaagttgatctcgatccagccattttttccggtaacaatttgttttgaaactatgtagtttgattatctatggaaggtatacagatgattctcccttgtctttttttactttggttttcttctctttccttttggtgtaagtttctcagatccttataatgttttatctatttttacataatcatattcggcaatctgtcaacaaaaaagaatgtactttaga

SEQ ID NO: 3330 - DNA, 1005 bp, Trigonella foenum-graecum
gaaaattacaatagaggagtattcggttacaaatgccagattaaagctaggttatttcttttatgactcttctaaatctggatttcttcttcttcccaaaataccacaaattttctctctctataattattatttcttccctcaaaccaaatgggggcatacagagccgaggacgattacgattatctattcaaagtggttttgattggtgattcaggtgttggtaaatcaaatcttctttctagattcacaaagaacgaatttagcctcgaatctaaatccaccattggcgttgaatttgctaccagaagcattcgtgttgatgataaggttgttaaagctcagatttgggatactgccggtcaagaaaggtaccgagcaattacaagtgcttactatcgtggagctgttggtgctttgttagtttatgatgttacccgccatgttacatttgaaaatgtggagagatggctaaaagagctgagagatcacacagatgccaacattgttgtgatgcttgtaggaaacaaagcagacctgcgtcatttacgagcagtttcgactgaagatgctacatctttttctgaacgggagaatacatattttatggagacatctgcccttgagtccctcaacgttgaaagtgctttcacagaagtgttgacgcagatctatcgtgtggtaagcaagaaggcccttgagattggtgatgatccagctgctttacctaaaggacagacaattaatgttgggtcccgtgatgatgtatcagctgtgaagaaagctggatgttgttctgcttgagtgtgttgtaaaagtgtcttttttactctgaaatttatgccctgtttataccatttagagtttgaactgacagcatgaagatgattgtttagagagcaccaaactatgaagtttctgctttggtctgtagagaattttgttcaatattagccaaatgtttaggaaacatgctcatttattttgcgtaatttatattttgtg

SEQ ID NO: 3331 - DNA, 1155 bp, Triphysaria pusilla
ccaccttccaccattacaccctccatgattttctcgggacacagtctactctatttctctttcttttatttgcgcgttgctattaccgtagctcaagtaaacactggtaaaggtaagaaaacggaaaaatcttccttcggatatacgcataaaagtactatttctggataaattatacagcacagattgacgatggcggggggatacagggccgacgacgactacgattatctcttcaagctggttctgatcggcgactctggtgtcggaaaatcgaatttgctttccagatttgctcgtaacgagttcagcttagagtcgaaatctactatcggggttgagttcgccacgcgcagcattcgcgttgatgataagatcgtcaaggctcagatttgggatacagccggccaagaaagataccgagcaatcacaagtgcatactaccgtggggctgttggagcattgctcgtttacgatgttacccgtcacatcacgttcgagaacgtcgagagatggttgaaagagctccgcgaccacacggaccagaatatcgtgatcatgcttgtcggtaacaaggcagatttacgccacctccgtgccgtctcgactgaggatggccaagcgtttgccgaaaaagaaaaaacctatttcatggagacatcagcgctcgagtctatgaacgtcgagaattcttttactgaagtactcacccaaatataccatgtagtttgccgtaaagcccttgatatcggcgatgacccttcggccttaccgaaaggacaaaccataaacgtcgggggtaaagatgatgtgtcgtctgtgaaaaaggtcggttgttgctctatatgatttgtgtttgtgtttacaatccaggcacacatacattgcatcggttttttttgctcttgtatcggttttggagttgagacgttcacagcttatgaatttcagttcttcaaattttacttagatttttcttttttacctagatttcccctatatttgtattgtttctcgcttattgactttggagattctgtattgtattatgttgcattcaatagtacaccttttattctaggaaaaaaaaaaaaaaaaacaaaaaaaaaaaaaaacaaaaaaaaaaaaaacaaaaaaaaaaaaacaaaaaacaga

SEQ ID NO: 3332 - DNA, 1173 bp, Cucurbita pepo
atcgtcttcaacaatttcaaaacgtctctctgtgtttctcttatgccttggagctccaattcccgatccattttcagaccccttcaattccaaccacaaccacagtcatccgatcccacctgaagaagcaaactatggctgcgtatagaacggacgacgattacgattacctcttcaaagtggttctcatcggtgactctggtgtgggcaaatccaatctactctccaggtttacgcgcaatgagttcagtctcgagtccaaatccacaatcggcgtcgaattcgccactcggagtattcgagtcgatgataagattgtcaaggctcagatttgggacaccgccggtcaagaagataccgtgcaatcacaagtgcatactatcgaggagcagttggtgcattgcttgtttatgatgtcacacgacacgtgacgttcgaaaacgttgagagatggttgaaagaactcagggatcacacagattccaatatagtgataatgctagttggtaacaaggcagacttgcgacatcttcgtgctgtttcgactgaagatgcctcggcctttgcagagaaggagaacactttcttcatggagacatctgccctcgagtctctgaatgtcgagagtgcttttaccgaagtgctaacccaaatctatcgtgtagtttgccgaaaagcgctcgagattggggaggatgccacaacattacctaaaggacaaaccattaacgttggaaacaaggatgatgtttcggcagtgaagaaagttggttgctgctcttcatgatgatcaactatttgaatatgaggtacatcatcaaaggagtgaatggatgagttcctaatgctatgtcttgagtttccaatcctgctggatttgctcgaccaaacattttagtgtttatggtcattttgagcttctgggagggctggattcatcatatttggagttcttttgaaattgacacttcttaatgtcaattccttgtactttctagtccgagctcactctcttatattgtttcaagtttgtaatggcccactagtctgtaattagtatcagattcttaggtagagatatctattaaattgaggttgtatgtaggttaaatgttcagttgttaaatagggaggcagaatttttagttttcttcagttacatattgtgtttga

SEQ ID NO: 3333 - DNA, 1209 bp, Musa acuminata
tcgacggcaagaaccctagcgacgacggcggcgacgacgagtcgcagctcctcgcccaaagagaaggaaaagggcggtagaagggtttgcgggatctgatttccggcggaaggcgctggaagcggtggtgctgctgctgctgcggccggcgacggtggtagtggtggcgggatggcgtacagggcggacgatgattacgactaccttttcaaggttgtgctgatcggggactccggcgtcggaaaatcgaacctgctttcgcggttcacccgggacgagttcagcctcgagtccaagtccaccatcggcgtcgagttcgccacccgaagcattcgcgtggaggacaaggttatcaaggcccagatttgggataccgctggccaagagagataccgagcgatcacaagtgcgtattatcggggagcagttggtgcgctagttgtctatgatatcacacgtcatgtgacatttgagaacatagagagatggttgaaggaactcagagatcacactgattccaatattgtcatcatgctagtgggaaacaaggcagatctgcgacatcttagggctattaatactgaggatgcaaaggaattttctgagaaggagaacgcattcttcatggagacatctgctctggaatcaatgaatgtggaaaatgcctttactgaagtgttgacccagatatatcgcgtggtgagcaggaagtcacttgaagctggtgatgatccagcagatttgccgaagggtcagacgattaatgtcggcaccaaggatgatgtatccgctgttaagaaagctggttgctgctcatcttaggtttaagaggtgagacaactgttatcccgacataccgaaacagcaggttatcacacgcttactgactacacggacaagttgtcgagcatgacactaaacgagatggttcttgctgcgaatttgtgtttttgtttaaggttttaaatgtggtctaagatgtttaaaatttgcattgtccttattgtagaaccgaagaccattttgtttgatagatcatgtattgctagtaggtttgttcaactcatctttgttgcatttttcattagatgtttgatagataatgctatgatttgatattggaagcatcatatgttttgttcagtcttttttgtgactcacagatcgcctaaatgagaagacgatccaaatacatattgttgatcgtat

SEQ ID NO: 3334 - DNA, 1020 bp, Lippia dulcis
cgcgaaactatcttccccgactctccacgcatgttgatggtgcagaagcattgagaatctcacttcagatcaggcgcctaggatacactttcacgcagtaccattactgggctgcgatggccgggggatatagggcggacgacgactacgattatctcttcaagctggtgctgatcggagattccggcgttggcaaatcgaatcttctgtcccgatttacgcggaacgagttcaacctcgagtcaaagtctaccataggcgtcgagttcgccacgcggagtattcgcgtcgacgataagattatcaaggctcagatttgggataccgctggccaggaacgataccgtgcaatcacgagtgcctactaccggggggctgttggggcgttgcttgtctatgatgtcactcggcacatcacatttgagaatgttgagagatggttgaaggagctccgtgatcacacagaccagaacatcgtgatcatgctcgtgggcaacaaggcagatctgcgccacctacgtgctgtttccactgaggatgccactgcctttgccgagaaggaaaatacctatttcatggagacatctgcccttgagtctttgaatgttgagaacgctttcacagaggcgctcacccaaatataccacgtggttagtcgtaaagcacttgatatcggagatgatccttccgctttgcccaagggacaaaccataaacattggggacgacgtctcagccgtgaaaaaggtaggttgttgctcggtatgactacaaactggtatatggttggatctgaatctggaaacacactgctttgttatttgttcgttggtagtcatcgcaaatgccagttctagtagtcttagtgtttcgatattgtattagctgcattatacatgacttttgccatattgctgtcaaccaagattgttaagtatttcattgtatttttcctgcttatgggaactgtgagtttgatagaatctattcaagtttatgattctcgagttctggtctgata

SEQ ID NO: 3335 - DNA, 1129 bp, Chrysanthemum coronarium
cacacgcataaaactcttcgtgacaccccactcctccactccccagatctcccccaaattcaacactttccaacaacagatctcacaaaaaaatgggagcatacagagcagacgatgactacgactacttattcaaagtagtcctcatcggtgactccggtgttggtaaatccaacttgctttctagattcactcgtaatgagttcagccttgagtctaagtctactatcggcgttgaattcgctactcgcagtatcaaagttgatgataaagttgtcaaggctcagatttgggatactgctggtcaagaacggtaccgtgcaattaccagtgcatactaccgcggcgcagttggtgcattgcttgtctatgatgtaacccgtcatgtcacttttgagaatgtggagaggtggttaaaggagctccgtgatcatacagattccaacattgtcatcatgcttgtaggaaacaaatcggatctgcgccatttaagggctgtgacaactgaagatgccaaaacatttgctgaaaaagagagcacttattttatggaaacttctgcgcttgaatcattgaatgttgaaaacgccttcacagaagtccttactcaaatccaccaagttgtcagcagaaaagctcttgatgttggagaagatcctggtgctttgccaaagggacagactattaatgttggcaacaaagatgatgtatcagcattgaagaaggcaggctgctgttccacttagatggaagaagcagttgcatcctttgtaagttcttattatcatatgaacatcacatttcatagtacaaatcatagttttaatcccgttttgccaagactagaaaagggttcaagggtatctctccggaactacatgattgagttgagccaaaactgtgacagaagaatttatttctatgctttatttttatgttttttagcatgatgtattgtgttatagctgtgagcaaccacatagagtaggcaaatacctgaatggtgaatgtggttttggcatttcaaatgtattaacgattctattgctatccgtgtaattttatttttcatctgacatccgtgaacaaagtgaagctttaccaatttctcaagtatcatcctttttct

SEQ ID NO: 3336 - DNA, 795 bp, Ananas comosus
aataagagaaaagagaatacgaatgcgaataaggatttataaggactattattaagaatattcaaggaggagaatagggcgagggcgagggcgagggagagaaataggagggataataagatgggttacagggcggacgacgactacgactacctgttcaaggtggtgctgatcggcgactccggcgtggggaagtcgaacctgctgtcgcgcttcacccgcaacgagttcagcctcgagtccaagtccaccatcggcgtcgagttcgccacccgcaccgtccgcgtcgacgacaaagtcatcaaggcccagatctgggacaccgccggccaggaaagataccgtgcgatcaccagcgcgtactaccgaggggcggtgggcgcgctcctggtctacgacgtgactcgccacgtcacgttcgagaacgtggagaggtggctaaaggagttgagagaccacacggactcttcgatggtcatcatgctcgtgggcaacaaggcggacctgcgccacctgagggccgtctccaccgaggacgcgcagggcttcgcggagagggagaacaccttcttcatggagacgtccgccctcgaatcacttaacgtcgagggcgccttcaccgaagtcctcactcagatctatcgcgtgaccagcaaaagagccctcgacgtcggtgacgaccccgccgctttgcccaagggccagaccattaatgtgggctccaaggacgacgtgtcggctgttaagaaagtcggctgctgctcagcgtaagttcttttgctacagggacacaca

SEQ ID NO: 3337 - DNA, 1147 bp, Amorphophallus konjac
tcccgccgctgcagagaaggaaggggaggaaggacacagagggcacggaggggaaccggaaggggagagccttggggcggcggcgacggcaatggcttacaggtcggaggacgactacgactacctgttcaaggtggtgctgatcggggactcgggggtcggcaagtcgaacctgctgtcccgcttcacccggaacgagttcagcctcgagtccaagtccaccatcggcgtcgagttcgccacccgcagcatccacgtcgacgacaaggtcatcaaggcccagatttgggacaccgccggccaggagagataccgtgccattacaagtgcatactaccggggggctgtcggtgcattgcttgtgtacgatgtaacccgccacgtcacgttcgaaaatgtggagagatggctgaaggagctcagggaccacacagattccaacatcgtgatcatgctcgtaggcaacaaggcagatctacgccacctgagggccgtttccaccgaggatgcacaggccttcgccgagaaggagagcgccttcttcatggaaacctctgcccttgaatccacgaacgtggagaacgccttcaccgaagtgctcactcagatatatcgtgtggtctgtaggaaggccctggagacggcgggggacgaccccgcggaagtgcccaaggggcaaaccatcaatatgaaggacgatgtgtcggctgtgaagaaagtcggatgttgctcggtttaaacatgcatggagatgtcccatttctggtagcttctggggttaccctccccttcccttgcaagagattgcccatggcgcattcttgcaggaaatttcacacaagatgtcctggcgtaagtagcagagggaagctacgtctagtatgtgcggtaagagataagaggatttggatctggactcaccctggattctcccccacttttccttttccttttttcttgtggggcatctcgcgttctatgcacgggatcttctctcttccatttttcctttccgttgtagacatgatccggcgtacttggtcgccggaagaagggtttgtttgttacatgcaggtcttgttgatcttgatgtcactgtacttattgaggtacttgaaaccgtcccattaaatgatttgttgttttc

SEQ ID NO: 3338 - DNA, 907 bp, Arabidopsis thaliana
attcttcttgtgcggcgtttctttttctccgtttgtccgtacgcgttttcttaccggtgacctgaaagtctcaaaataatggcggcgtatagagctgacgatgattacgatttcctctacaaggtggtattaatcggtgattccggcgtcggtaaatccaatctgctttctcgattcacgcgcaacgagttcagcctcgagtctaaatccaccatcggtgtagaattcgccacccgaagcattcatgtcgatgaaaaaatcgtcaaggctcagatttgggacaccgccggccaagagagataccgagcaatcacaagcgcatactatcgaggagctgttggggctttgcttgtttatgatgttacacggcatgtgacatttgagaacgtcgagagatggttgaaggagcttagagatcacacagaggccaacattgtgatcatgcttgttgggaataaggcggatctacgtcacctaagagctgtttcaactgaagatgctaaagcttttgctgagagagagaacacattctttatggagacatctgcacttgaagcattgaacgttgagaatgctttcactgaagtgctttctcaaatataccgtgtggctagcaagaaggcgttggatattggtgatgatcacactactcttcctaaaggacaaagtattaatgttgggtctaaggatgatgtttctgaggttaagaaggttggatgctgctcaagttgatcttgatcaagccattttgtctgtttcttaggcaagaatatagtttgattatctatggaagacatgcagatgattctttcttgtgtttttcctttagttgcttcttttggtgtaagtttctcagatcctgttttaaatattattttttacacaatcattcgtatgcgataatcta

SEQ ID NO: 3339 - DNA, 2021 bp, Cirsium arvense
aacaaaatcagcagccaaatcttttctccatctatctctctactcccactatctccttagttgttgttttctcaattctcatttctcaacacacagatctgcaaaaattctttctttctttctttctttacaaaacaaacaacaattcttgccctattttcattttgttgttcaagtgaagatcattttgttattgagataatgggtgcttacagagcagacgatgattacgattacttgttcaaggtagttctcatcggagattctggagttggaaagtctaatctcttatcgagattcacacgaaacgagttcagtcttgagtctaaatccaccatcggcgttgaattcgccactcgtagcattcgtgttgatgataaagttgttaaggctcagatttgggatactgctggccaggaacggtaccgtgcaattacaagtgcatactaccgaggtgcagttggcgctttactcgtttacgatgttacacgccatgtcacttttgaaaacgtagaaaggtggttaaaggagcttcgggatcatacagattccaacatcgttattatgctcgttggaaataaagctgatttacgccatttacgggccgtccaaaccgacgatgccacatcatttgccgaaaaagaacacacttatttcatggaaacttccgcacttgaatcactaaatgtcgaaaatgctttcacagaagttcttacacaaatctatcatatcgttagcagaaaagcgcttgaatctggagatgatcaggctgcgttaccaaaggggcagacgattaacgttgatgatgtatcggcagtgaagaaaggcggatgttgttcttcttagatggaaaaaaagatggttttttgggtgagttttgatcaaacaaattgggattttcggtataaaatcatagtttttattgtttcatcaatactgaatccgaattttatggctatccggaaggaaatgaatacgttcaataggtttacatttgattgttgtttttagggatttatgtcttttatttgtccatgtgttttgtggtattcaaattgttccaagatttagtggtatctatgtactatggtctatgagtatgattattaaaaagaaaaaagtaccgactgcttttttaatcgataccacacgaggttctcgggtcattgaatccctgactacatccctgatatcgggtgattgtataaacaagtctggcttttttctgtgtaaggatggagatgaagagggttcagagactacactttggcaagaagaggatagttctgtttgaactctcttactacaatctaaagatgacaaggccgtagacgagctagaagaagaaaatgagtttcttgatgattcaattgagactcgatgcttctctttcatgactaccttcggggttttttccttagcttgctctgattcattgctgaactcttttttaccattgtcactttgacctggaggtaacctcttctggttatggccatggcggcgttgaccaagaaggtaacgtcggtcaaacagctgaaaaattccattcatgcatcctaattgcttctgtagctcttgtttatcatcttttagggtatacacaacctccttagtagacatttgcatcaccacttcttctttcttttactaaaaagcaatcaaagacttgaaaatcttatggaagaaaagatcattggattgaaatcataaagatggtttcttttcttgtgttcaaattaaaatttataaagtctgttgctttttggccctcaaggaaagactgctagaggtttagaaggggatttggtggaatatatggaagcattgttcaattatttttttgtgggaattgaattgggtgtcaaattttaagatgagagggaaattgctgtcatttttatataatattttataaaattctagagatagagaggagagtttgtggggtcagatgtgcactggccttcccacttttccatgtggacaaatatgtgggtaggtctcttgtctggcttctt

SEQ ID NO: 3340 - DNA, 827 bp, Cleome spinosa
ggaagaatagtttctcaaaccgaaccaaaccggattttcctccgacaacgatctccgtgatctccatccctttgcgtgtcttcccttacaatctctctctctgtgagcatccgtgcatgccttcgatctcccaagagagagccttctgatcggagatcctgacaatggcggcgtatagggcagacgatgattacgattacctcttcaaagtcgtcttgataggagattccggtgtcggtaaatccaatctgctctctcgattcactcacaacgaattcagcctcgagtccaaatccaccatcggagtcgaattcgccacccgaagcatccgcgtcgatgataagatcgtcaaggcccagatttgggacaccgctggtcaggaaagataccgggcgatcacgagcgcatactacagaggagcggtgggagcattgctggtctatgatgtgacaaggcatgtaacgtttgagaacgtggagagatggttgaaggagcttcgtgaccacacagatgccaacattgtgataatgctggtcgggaacaaggcagatctccgccacttacgagccgtgtcgacagaggacgcaaaggcatttgccgagagagagaacaccttcttcatggagacatctgccctcgagtccatgaacgccgagaactctttcaccgaagttctctctcagatataccgtgtcgtgagccggaaggctctggatataggagaggatcctgctgcacttcccaaggggcagaccatcaacgtcgggtccaaggatgatgtttccgccgtctagaaggtcggatgctgctcaagttgatctcaaaac

SEQ ID NO: 3341 - DNA, 846 bp, Gossypium hirsutum
atatcttattacaatttcaaaatcgatgccaccgatctctgccacttgataaaattttccgcataaattcaaatctttattctttttcaagatccgatagaagaacccctggtgatccgaaatggcggcgtatagagcagatgatgactacgactatttgttcaagctagtattgatcggagattcgggggttgggaaatcgaacttgttgtcgagattcacgaaaaacgagtttaatctggagtcaaaatccacaatcggagtagaatttgctacccgaagtattcgggtcgatgataaggtcgttaaggcccagatttgggacaccgctggacaagaaagataccgggcgattacaagtgcgtactaccgaggagctgtcggtgcattgcttgtctatgatgtcactcgacacatcacatttgagaatgtcgagagatggttgaaggaactacgggatcacacagactccaatatcgtgattatgcttgtcggtaacaaggcagacctacgacacttgcgtgccgtttccactgaggaagctaaggcctttgccgagagagagaaaacctactttatggagacatctgccctcgagtccctgaatgtagagaatgcattcactgaagtactaactcaaatataccatgtggtaagtcgaaaagcactcgaagtaggggatgatcctgcagcattgccgaagggacaaaccatcaatgtcggcaaggacgatgtttcagccctcaagaaaattggctgctgttctgcttaactgtcagatgattttgagtgtcaaagttcccccctcaaaatttttatctcattaagcgcccccaaccccacccc

SEQ ID NO: 3342 - DNA, 1164 bp, Cryptomeria japonica
gaacgctttcttcatgtcatttgcagcggtggtgaaatgatctgaaagtagcagtgcactttctgtagagggcaagttttaaattttttgggtttttaagtttgattgggcaaaaatggcttatagagcagatgacgattatgactatttgttcaaggtggtgttgattggagattctggtgtgggaaagtccaatctgctgtcaagatttacaaggaatgaattcagcttggagtctaaatcgaccattggagtggagtttgcaaccaggagtataactgttgatgataaggtcatcaaggcccagatttgggacacagctggtcaagaaaggtaccgagctataacaagtgcttattatcgaggagctgttggtgcattattagtgtatgatgtaaccagacacgtaacctttgagaatgttgagagatggcttaaagaactcagggaccacactgatgccaatattgtgataatgcttgttggtaacaaggcagatctgcgtcatctgagagctgtttctgcagaggatgccaaagcatttgcagaacgagaatttacatattttatggagacatctgccctggaatcaacaaacgttgagaatgctttcacagaagtgctcagtcaaatctatcggattgtgagtaagaaagccctagatgtcggggaagatcaggcagcagtgcccagcaaaggacagacaataaatgttaacaataaggaggatgtgtcggccctgaagaaagttggatgttgttctgcataaacccaaagaacatttcacagtgttgtcttctaaagttttttctggattttgatgtcattttgtcaagaaattgatttcttccaaattctgccgcagttgcctgtcagttttaagagacgagcagctttctatgtttgattactctgtatgatttgccagtgaactattgctcttggattatactagagagtacttgttgccatataggttttattgttactctatattagatgaacacttcaaagatttctattgttgttatcttggaaagatcatgccagatttacacgtatatgacagtatgtaatatatagtttaaaagtaaacccaaattgacgatcaatttctgtctggatccttattccaatcattatttgttatagttttgtcctttg

SEQ ID NO: 3343 - DNA, 935 bp, Taraxacum officinale
cggccgggcagatttctattgctgttttccctttcctcaacagatctgcgtcggatcaaaaccgcaagcgtttcttacgcattgtaattttgttgtcaatatcattttgtaaacagaaatgggtgcgtacagaacagacgatgattacgactacttgtttaaagtagttctgatcggagattctggagttggcaaatcaaatctgttgtctagattcactcgcaacgagttcagtcttgagtccaaatctaccatcggcgttgaattcgccacccgtagcattcgtgttgatgacaaagttgtcaaggctcagatttgggacaccgctggccaggaaaggtaccgtgcaattacaagcgcgtactaccgaggagcagtgggagccttacttgtttatgacgtcacccgccacgtcacctttgaaaacgtggaaagatggttaaaagagcttcgggaccacacagacgccaacatcgtcatcatgctcgtgggcaacaaagccgatttgcgccatttacgcgccgtccaatcagaggacgccacgtcattcgccgaaaaagaacacacgtatttcatggaaacctccgcacttgaatcgctaaatgtggaagatgcattcacggaagttcttacgcaaatctatcatattgttagccggaaagctctggaagccggagatgatgccgccacgttgccgaaagggcagactattagtgttggcgggaaagatgacgtgtcggcggttaagaaaggcgggtgttgttcgagttaggggggaaataggtgaggtgttggttaagttaatggaaaagtggatatagatgatggtttttattgtttcattaaatggatgatgatttatgggggtatgtttgatcttgtattgttatagtctgaatagatttacatttgaattccaaaaaaaaaaaaaaaaa

SEQ ID NO: 3344 - DNA, 1088 bp, Distylium racemosum
aattctgagatagttcaattgcagtttcctttaaaatctctgcaaaaacaccaccagcaaagaggctaataggtataaacaattccttgttttgtgctatgcagtatgatgtctctgtcacgaatgtgacgactagaatgggaattgcaagccactttgccacaacaagcataaggtgagacaaacgcaatacaactctcttacaagcttccttccatggaaagtttctgactggttcgcgatacctttcgcgtttgcagcggtggagaaatggtcttgaggcaaagtgtatatttttagaagggcatcggtcattggaattctgggcattctttttttatttttgggggttctcagaagggtacagattgtgcacaatggcctacagagcagatgacgactatgattatttgtttaaggtggtgctgattggggactcaggagtgggcaaatccaatctgctctctagattcacaaggaatgaattcagtttggagtccaaatccaccattggagtggagtttgcaactagaagcatcactgtggatgataaggtcatcaaggctcagatttgggacactgctggtcaagaaaggtatcgagctataacaagtgcttattatcggggagctgttggtgcattattggtgtatgatgtaacaaggcatgtaacctttgagaatgtggagagatggctgaaagagcttagggaccacactgatgccaatattgtgataatgcttgttggtaacaaggcagatcttcgtcatcttagagctgtttctacagaggatggcaaggcatttgcagaacgagaatctacatattttatggagacatctgcccttgaatcaacaaatgttgaggcagcattcacagaagtacttagccaaatctataggattgtgagtaagaaagctcttgatgttggggaagaccctgcagcagtgcccagcaaagggcagacaataaatgtaaataaggaagatgtgtcagccctgaagaaagttggatgttgttctggataggcccaatgcacactacataatgttgtcttccaaggttttttagttttcagtgtcattttg

SEQ ID NO: 3345 - DNA, 723 bp, Flaveria ramosissima
actcaaaaccaacaattcttacaaaactttcactttagtagcttagatcactgcataaatacaaatgggtgcgtacagagccgacgatgattacgattacctcttcaaggtagttctgatcggagactctggagtcggaaaatcaaatcttttgtccagattcacacgaaacgagttcagtctcgagtccaaatccaccatcggcgttgaattcgccacccgcagcattcgagtcgatgataaagtcatcaaggctcagatttgggacactgcgggccaagaaaggtaccgtgcaattacaagtgcatactaccgaggtgcagttggagcattgctggtctatgatgtcacacgaaacgtcaccttcgagaatgtacaaaggtggttaaaggagctaagggatcatacagattccaacattgtcattatgctcgtgggtaacaaagctgatttacgccatttacgagcggtccaaactgaagacgccacatcatttgctgaaaaagagcacacctacttcatggaaacctctgcacttgaatcactaaacgtcgaaagcgcattcacagaagttcttactcaaatctatcatattgttagtagaaaagcacttgatggtggtgatgatcaggcggctttgccaaaagggcagacgattaatgtgggcgggaaggatgatgtgtcagctgtgaagaacgccggatgttgttcttcgtaagaaaa

SEQ ID NO: 3346 - DNA, 823 bp, Flaveria ramosissima
actcaaaaccaacaattcttacaaacgttcagtttagtagtttagatcactgcataaatacaaatgggtgcgtacagagccgacgatgattacgattatctcttcaaggtagttctgatcggagactctggtgtcggaaaatcaaatcttctgtccagattcacccgaaacgagttcagtctcgagtccaaatccaccatcggcgttgaattcgccactcgtagcattcgagtcgatgataaagtcatcaaggctcagatttgggacactgcgggccaagaaaggtatcgcgcaattacaagtgcatactaccgaggtgcagttggagcgttgctggtctatgatgtcacacgaaacgtcacctttgagaatgtacagaggtggttaaaggagctaagggatcatacagattccaacattgtcattatgcttgtgggtaacaaagctgatttacgccatttacgagcggtccaaactgaagatgccacatcatttgctgaaaaagagcacacttacttcatggaaacctctgcacttgaatcactaaacgtcgaaagcgcattcacagaagttcttactcaaatctatcatatcgttagtagaaaagcacttgatggtggtgatgatcaggcggctttgccaaaaggtcagacgattaatgtgggcgggaaggatgatgtgtcagcagtgaagaacgccggatgttgttcttcgtaagaaaaaggcgcgttttgatcaagggagtatagatcataacttttcattgtttctcttcaaatggttttgattctgatgtattgttatagttgatagcaagcaatct

SEQ ID NO: 3347 - DNA, 1133 bp, Gossypium raimondii
ctcctcctaaatctaagcccactttttcttttctttctttctttttttaaatatcttattacaatttcaaaatcgatgccaccgatctctgccacttgataaaattttcctcataaattcaaatctttattttttttcaagatccgatagaagaacccgacctggtgatccgaaatggcggcgtatagagcagatgacgactacgactatttgttcaagctagtattgatcggagattcgggggttgggaaatcgaacttgttgtcgagattcacgaaaaacgagtttaatctggagtcaaaatccacaatcggagtagaatttgctacccgaagtattcgggtcgatgataaggtcgttaaggcccagatttgggacaccgctggacaagaaagataccgggcgattacaagtgcgtactaccgaggagctgttggtgcattgcttgtctatgatgtcactcgacacatcacatttgagaatgtcgagagatggttgaaggaactacgggatcacacggactccaatatcgtgattatgctcgttggtaacaaggcagacctacgacacttgcgtgccgtttccaccgaggaagctaaggccttcgccgagagagagaaaacctactttatggagacatctgccctcgagtccctgaatgtagagaatgcattcactgaagtactaactcaaatataccatgtggtaagtcgaaaagcactcgaagtaggggatgatcctgcagcattgccaaagggacaaaccatcaatgtcggcaaggacgatgtttcagccctcaagaaaatcggctgctgttctgcttaactgtcagatgattttgagtgtcgaagttcccccctcaaaatttttatctcattaagccccccccccccccaaaaaaaaaaaaaaagaaaagaaaatccttactaggtttgatatcagttcctttttcatggttcttttagggtatcttatttcctcatgcaatgttgcagttcatagttctgatgttgtatttgatcactttagaatagtttgatcagacaaggtttagttttgtactttaaaataattttcatttgtcatggatgataaaatttgaattacctaattattatttatctattttttcc

SEQ ID NO: 3348 - DNA, 1145 bp, Gossypium raimondii
catagatggttaaatcaaaacaatttttgcccacacaaaaaagttattttccaaaaaatctcgtgaaaagaggttagttttttgttttaatcatagccatttttgccaagctttttttaccctatttctatttttttcttcttttttcacaccaaacaatcccaaacccagaaccaccaaattaaaaactaaatgttaaccataacaattaagatacccaattaatattgggttttttttccttcttttttctgagtttttttttctttttttggatccaatcagagaggaaatgggagcttatagagctgatgatgattatgattatttgtttaaggttgtgttgatcggtgattctggtgttggaaaatccaacctattgtctagatttacgaagaacgagtttagcgctgagtctaaatccaccattggtgttgagttcgcaactcgtagctttcatgttgatgataaagttgttaaagctcaaatttgggacactgctggacaagaaaggtaccgtgcaattaccagtgcatattatcgaggtgctgtcggtgctttactagtctacgatgtcactcgtcgtgttacgttcgagaatgtacaaaggtggcttaaggaactccgagaccacactgatccaaacattgtgattatgctagtcgggaacaaggccgacctgcgtcacttgcgagctgttgcagccgaagatgctaaagcttttgccgaacgagagaacacttttttcatggaaacatctgcgctcgagtccttaaatgttgagaatgccttcaccgaagtgttggcccagatctatcgtgtcgtgagcaggaaagctcttgacatcggagatgatccggcagctttacctaaaggtcggacgatcaatgtcggatctaaagacgatgtatcggctgtgaaaggagctggatgttgctcggcttaattatggagatggagtctcatcttccaaaacttttcttatccctttgaaagcacaaacaagagaacatcaacaatgtatttaaattgaaattattctttggattatgctttaaacacaaattctatatgctttttagtttgcaaagctagttctttctcaaaaattgaaataagaaggaaatttcttccaattgttagcg

SEQ ID NO: 3349 - DNA, 1185 bp, Lupinus angustifolius
aatcagaaggttgaaaaccattcgaactttgaataacgaatgcttctccctcctgcaacaacaaagcaacaccttctctccaatgctgaaagtttcaagctttgtatgcctttatccaattgaatttcttaaacataattaaaagaagaattaaacctaacacatttcctagaatttcgatctgaaaaaagggctcaacaatctgaaaatgggtgcatatagagcggatgatgactacgattacttattcaaggtggttctgatcggagactccggtgtcggaaagacaaatcttttatctcgtttcaccaaaaatgaattcagtttggaaaccaaatcaaccattggggttgaattcgccacccgaagcatccacgttgatgataagattgtcaaggcccaaatttgggacactgctggccaagaaagatatcgtgcaatcacaagtgcgtattatagaggagctgttggtgcattagttgtgtatgatgtcaccagacacataacttttgagaatgtggagagatggttaaaggagctaagggatcacacagatgctaacattgtaattatgcttgtcggaaacaaggccgatcttcgccacttgcgtgctgtgtccactgatgatgccaaggtgttcgctgagagggaaaaaacattttttatggaaacatctgcccttgagtccttgaatgttgacaattctttcacagaagttcttactcagatatacaatgttgttagtaggaagactctcgagattggagatgatcctgcagccttgccgaaggggcagacgatcaatgttggcggtccggatgatgtctcggctgttaaaaaggtcggatgctgctcagcttagtttgaaagaggaatgccttgacagcaaaattttacatctatatgtgcacgattcaacttatactcaacattttgggatctatatcaaatgttttaatacttttgtttttttcttctttggtgtaattttgcacaccctttttgttaagttctctgttttcttcttcttcttttttcttcctataagcattgtttgaatataggaattatctcatgtttcacatagttacatggtatgtgacaacaatttccgtgcatagtatccatttctatacaatttatcagtttttatattattattataagatttttttatgacgaaac

SEQ ID NO: 3350 - DNA, 1093 bp, Phalaenopsis aphrodite
atcgggatcccgatctgcagcgatggaaggaattctagcaacagaaactcgatccatctgctgattaccggtgcggattcttacgaagttcgatcttattggcatcaggttccacagctggagaaggaggtatgggctacagagcagaggacgactacgattacctcttcaaggttgtgctgattggggattctggcgtcggtaaatccaatcttctgtcgaggttcacgcgaaacgacttcagcctcgaatctaaatctaccatcggcgttgagtttgccacacggagcattcatgtagaagacaaaatcgttaaggcccagatttgggacactgccggccaggaaagatatcgtgcaatcacgagcgcatactatcgcggggcagttggcgcgctcctggtttacgatatcacccgccatataacgttcgagaatgtcgagagatggctgaaggagctcagggatcacaccgaagccaacatcgtcatcatgctcgtcgggaataaagccgatttacgacaccttagagctgtccccaccgatgaagctaaggcttttgccgagaaccaaaatactttcttcatggaaacatcggccctcgaatcattgaatgtcgaaaatgcattcactgaagtcctcactcagatctatcatgtcgtgagtcggaaaacattggatgtcggggacgaccccgcagctcttccgaaggggcagactatcaatgttggtaataaggatgatgtttcagctgtgaagaaagtaggatgctgctctgcctaactgtgaagaaatcatgtgttattagctccaacatttaataggtatgtgatattacttgaacttctgcttatagctgatgatcctcgttcctcgtaaatttattcgatacttcgagcatggatcgattgtttggaattttgttattgattttgcaattttagtttattcaatgaagacaatgtgtgttcttggggacttgtgttgtgttgttttgtttgctgctggaagtagtttggagctgtttttccacaatcagcttttgcttcctggtttgacttgtatcccagttaatgatttattggttggttctt

SEQ ID NO: 3351 - DNA, 1336 bp, Pseudotsuga menziesii
atcatttcaaaacaatatcataaactacttctacaaataggattattcgaagcatcatctactctgttcttctctcaatttgcagcggtggagaaatggtcagtgggcagactatcctttcctgaagggcagaccttagaattgtagggcaatttgctggtaacaaaatggcttacagagcagacgatgactacgattacctcttcaaggtggtactcattggggactctggtgtgggtaagtccaacctgctgtcgagatttactaggaacgagttcagcttggagtccaaatccaccatcggagtggagttcgcgactcggagtataacagtcgatgataaagtcataaaagctcagatttgggacacagctggtcaagagagatatcgggctataacaagtgcatattatcgaggagcagtaggtgcactgttagtttacgatgtaaccagacatgtaacctttgagaatgtggagagatggctgaaggagcttagggatcacactgatgccaatattgtgataatgcttgttggtaacaaggctgatttgcgtcatcttagagctgtttcgatagaggatggcaaagcattcgcagaacgagaaaatacatattacatggaaacatcggctctcgaatcaacaaatgttgagaatgcattcacagaagtacttagccagatttaccggattgtcagtaagaaagctcttgatgttggggaagacccagcagcggtgcccagtaaaggacagacgatacatgttggcaacaaggatgacgtgacagcaatgaagaaagttgggtgttgttctgtatagacccaatacgcaatgctctacagtgttgtcatcagaatctttttcttttaaagcaactcttttcaaggaattgatttaaatatgtcaaaggaagtataggcccaacgtgcaatgctccagagtgtcatcatctggagcttttgcatttagagcaactcttttggaggaattgatttaaatatgtcaaaggaagtattaatggttgcctgtcagttttaagagacaagcaccctgctatacttattgctctgtatgatttatcagtgaacctttgctgctcttggacgtctccaagcgcagtgttgccatatatcttttgttgctactatacgttttatcaaatatttcaattatttgtattgtggttattttggacagatcatgtcaacaaatattgggttaattttacctgtaaaggttgaactggcaaatgaagttcaattctggtggttatcctaattattcaaactactattcttaattacgcttgagtggtcttctccttcgttaacttt

SEQ ID NO: 3352 - DNA, 1045 bp, Sequoia sempervirens
aaatggcttacagagcagatgatgattatgactatttgtttaaggtggtgttgattggagactctggggtgggaaaatccaatctgctgtcaagatttacaaggaatgaattcagcttggagtctaaatctaccattggagttgagtttgcaacaaggagcataactgttgatgataaggtcatcaaggcccagatttgggacacagccggtcaagaaaggtaccgagctataacaagtgcttattaccgaggagctgttggtgcattattagtgtatgacgtaaccagacacgtaacctttgagaatgttgagagatggcttaaagaactcagggaccacactgatgccaatatcgtaataatgcttgttggtaacaaggcagatctgcgtcatctgagagctgtttctgcagaggatgccaaagcatttgcagaacgagaatctacatattttatggagacttcggccctggaatcaacaaatgttgagaatgctttcacagaagtacttagtcaaatctatcggattgtgagtaagaaagctcttgatgttggggaagatcaggcagcagtgcccagcaaaggacagacaataaatgttaacaataaggaggatgtgtcagccttgaagaaagttggatgttgttctgcataaacccaaagaacattatacagtgttgtcttctaaaatttttctggattttgatgtcattttgtcaagaaattgatttgttccaaattctgccgtggttgcctgtcagttttaagagacaagcagctttctatgtttgattactctgtatgatttgtcagtgaactttttgctcttggattataccaaagagtacttgttgccatatagcttttgttgttattctatattacatgaacacttcaaacatttatattgttcttatcttgggaagatcatgccaggtttacaggtatatgacaatatgtaatatataggttaagagtaaaacccaaattgaaaatcagtttctgtccggatccttattccaatcattattttgtagatttgtc

SEQ ID NO: 3353 - DNA, 733 bp, Silene vulgaris
attaattaataataatcaataaaatggcagcatatagagctgatgatgattacgattatttattcaaagtggtattaattggggactcgggtgtcggaaaatcgaaccttttgtctcgttttacgaggaatgagtttagcttggaatcgaaatccaccattggtgttgaattcgctactcgtagcattcgtgttgatgataaaattgttaaggctcaaatttgggacactgctggtcaagaaaggtaccgtgcaattacaagtgcatattacagaggagcagtaggagctctagtcgtgtacgacgtgacacgccacgtcacctttgaaaacgtccaaagatggttaaaagaactccgagaccacaccgatgccaacattgtgataatgttggtcggaaacaaggccgatttacgtcatttacgagctgttgcggttgaggatactaagggatttgcagaaagggagagtacatacttcatggagacgtctgcgctcgagtcgttgaatgtcgaaagtgctttcaccgaagtgctttcacaaatttaccatgtgatgagtaggaaagcccttgatatcggagatgatccggctgctttgcctaagggacagactattaatattgggtcgaaagatgatgtgtccgcggttaggaaatcgggttgctgttcaaattagatttaccgcttttcctccatttaccgtttgagaaaaagagagacgaagaaagacac

SEQ ID NO: 3354 - DNA, 967 bp, Utricularia gibba
ggggcgtctcttggcttagaaaaacccttgccgtgtctcggtaggcgtttccagtaacacattgcttgtcgatgggcgcgtatcgagctgacgacgactacgattacctgttcaaggttgtgttgattggcgattccggcgtcggcaaatctaatcttctctccaggttcactcggaatgagttcagcttggagtccaagtccacaatcggagttgagtttgctacgaggagcattcgcgttgatgagaaggtggtgaaagcgcagatttgggacactgctggtcaagagaggtatcgtgcgataacaagtgcttactaccgaggagctgttggtgcgttgctggtctacgatgtcacacgccatgttacattcgaaaatgtggagagatggctcaaggagctcagggaccataccgactccaacatagttatcatgctcgtgggaaacaaagccgacttgcgacacctgcgtgctgtttcgaccgaagacgccactgctttcgccgaaagggagaagacatttttcatggaaacctcagcccttgaatcaatgaacgtcgaaaatgccttcaccgaagtgctcacacagattcatcagattgtgagtaagaaagctctcgaagctagcgatgatcccacatctttaccaaaggggcagaccatcaacgttggctccaaggatgatgtctcagctcttaagaaagccggctgctgctctacttagacactccatttttcctgcaatgccgcgcaccagactacacggtgatggtctattctccttcgctatccatatgctttcattttggatcccttgtttgtaatgcctgtgtttgatttatttttcttggtggaagctgcttattctagtagttgctcaacttatctcatcactatgaagcttgctgtgtgctgtttcttcttccttttcatcaaattgcatgactagaaacttgaaccaacaca

SEQ ID NO: 3355 - DNA, 1050 bp, Avena sativa
atacgatctagactgagccgccaacaagaagcagctgtagcgggaggaaggagaagccgaggggaatcagcaccggacgccgcgcgccaccgattagtggaggaggaggcggccgtggtcgggaagaaggaaggaagaaagggaagggagtaatggcgtacagagcggaggacgactacgactacctgttcaaggtggtcctgatcggggactccggggtggggaagtcgaacctgctgacccgcttcacccgcaacgagttcagcctcgagtccaagtccaccatcggcgtcgagttcgccacgcgaagcatccacgtcgacgacaaggtcgtcaaggcccagatctgggacaccgcaggccaggaaagataccgagccatcacgagcgcgtactaccgcggcgcggtgggcgccctggtggtctacgacgtgacgcgccacgtcaccttcgagaacgtggagaggtggctgagggagctcaaaggaccacacggacgccaacatcgtgatcatgctcgtggggaacaaggcggacctgcgcacctcagggccggtcaccgccgacggacgccaaggcgtcgccgagagggagaacacatcttcatggagacgtcggccctggaggcgatgaacgtcgaggacgccttcaccgaggtgctctcccagatctaccgcgtggtgagcaagaaggccctcgacatcggcgatgaccccgccgcgccacccaaggggaagaccatcaacgtcaaggacgatgtgtcggccctgaagaaatcaagctgctgttcgtcttagctcaggatggttagcagatactgtactacagtaggagggcgctattttattgcagtcatagtgctggtggtgtgaatgtcttggtgtttgtttttccatattttgatacattgattcgttcaggactacaggcacgctggtatagtttagggatttgaaagtgtgtagttatcacggtgttctcagtaggcccttcctgggatgtttttacctcttgatctgtgtactgctgcttatagctgaatctgctgaa

SEQ ID NO: 3356 - DNA, 949 bp, Panax ginseng
tctctctctctctctctctctcaaatacatgcatacatactatatgtatttacatctatatctcttaatttcgtttcgtcgttagagtgaaaaagggtttgaattttgaaaacaaacggacagaaatttgatacttcctataactttctatggcggcgtacagagccgacgatgactacgattatctcttcaaggttgtgttgatcggagattcaggtgtcggaaaatcaaatcttctctccagattcactaaaaacgagtttagtttggaatctaaatctacaatcggtgttgaattcgctaccagaagtattcgcgtcgatgataagatcgtcaaggcccagatttgggacaccgctggccaagaaagatatcgtgcaatcacaagtgcatactaccgaggggcagttggtgcattggttgtctatgatgtcacccgacatgtcacgtttgagaatgttgagagatggttaaaagagctgcgagaccacacagatgccaatattgtgataatgctggtgggaaacaaggctgacttgcgtcacctgcgtgctgttgccactgacgatgcgaaggcctttgctgagagagaaagcactttcttatggagacattcaagccctcgagtcgttgaatgttgagaatggcattcacggaagttctcagtcaaatatatcatgtagtcagccggaaagcacttgagattggggatgatcctgcagcattgcctaaagggcaaacaatcaatgttaaggatgatgtttcagcagtgaaaaaagttggttgctgctctgtctaactacaaaagtaaagcccatagttgagtgatatataatttgaacttttcaagaactccacttagcagctctggtttgtcccaattattccctattactgtttcaatagttggaatggattaagattatctgcgaggcttattgctgatttt

SEQ ID NO: 3357 - DNA, 922 bp, Allium cepa
caggcaagctcgggattaaccgaagtcccattcaggtgcacccctagggtacaatacgacgtgatatggatctcctcagattcgttgcaaaattctttccttctccactcaattttacccaagctattcaataagcggtggtaagttaccgcatatcgccatggcgtacagagccgacgacgattacgactacctgttcaaagtcgtactgatcggcgattcaggcgttggcaaatcgaaccttctttcccgattcacgaggaatgagttcagtcttgagtcgaaatcgacgataggggtggaatttgctacaaggagtatacatgttgatgataaggttattaaggctcagatttgggatactgctggccaggaaaagatatcgggcaattacaagtgcatactacagaggagcggtgggagcccttctagtgtacgacgtgaccagacacgtaacatttgagaacgtggagagatggctgaaagactcagagatcacaccgactccaccatagtcatcatgcttgtaggcaacaaagcagatctgcgcctatcttaaggcggtcacgacagaagatgcaaaagcatttgctgagagagaaagcacttctttatgaaacatctgctctggaatcgatgaacgttgaaaatgctttcactgaagtgctcactcaaatttacagggtggtaagtagaaaagcacttgaagtcggcaatgacgctgctgctttgcccaagggacagaccatcaatgtagggtccaaggatgatgtatctgctgtaaagaaaggtggttgctgttcgacgtagatgatattagtgtccggttattctaacatctttgggaattcggtgcgctgatgagacgttttagttattgtcggtgcacctagttattgagataaattgctcaaattttaca

SEQ ID NO: 3358 - DNA, 1349 bp, Sarracenia psittacina
actctgaaaccccgcccccatcctttgtctctcctcctgtcattttcccctttggagtttctctctctataatcgtcctgttcaacctgcatgatttcttcctataaatttttacaaagaaaacatatctatattgcgcgtacatatatcatggttttcgtatttgatcggtaagaaccaacgatttctatagcgcgagagagagagagagagagagattggaatagattaatggcggcgtacagagccgacgacgactacgattacttgttcaaggtggttctgatcggggactcaggcgttggaaaatcgaatctgctttcaaggttcacaaggaacgagttcagcctcgaatcaaaatccaccatcggcgttgaattcgctactcggagtattcgcgtcgatgacaagatagtcaaggcacagaggttggaagactgctggccaagagagataccgtgcaatcacgagtgcatactaccgtggagctgttggtgcattgctcgtctatgatgtcacccgtcacgtcacattcgagaatgttgagagatggttaaaagagctccggggtcacacagagtcgaacatcgtgataatgcttgtggggaacaaggccgatttgcgccatcttcgtgccgtttcgaccgaggatgcaaaggcctttgccgagcgagagaacactttctttatggagacgtcggccctcgagtctatgaacgtcgagaatgcatttaccgaagcccttactcaaatacatcacgtcgtcagcaggaaagcgcttgatatcggggacgaccctgcagccttgcctaaagggcaaaccattaatatgggaaccaaagacgaggttgtgaacaaagtcggatgctgctctgcctaatgaaggaaaaaaaaaggaaaattacagaaacacctgttatactatcatcgctgttatttaacctcctgaacaaacaaaaaaagcatacaaaagaatacaaaacgacctctcaactattcgatggtaccactttaatcccttctgttacacgaacacctcttgaactatgagattgcatcactttaaccccctaaaccaagggtctggagtgattcaatcgaatagttaagagagtctatttctatgcttttttagttcgtggagttaaaatgatacacactcatagtataatggaggtctatttgtaagtttatttagttcaggagagtgaaacgatacacgctcatagtataaagggtgttcatgtaatcttaccaaaaaaataaaaaaaaaatccaataagaaatgccaagaactgtaaattgcagctcacgggtttgcatgtcggtacttttgagtcgacgagttc

SEQ ID NO: 3359 - DNA, 924 bp, Taxus baccata
agcaagtgtatacttctttagatttgcagttttaagaattgcgggacatttttttatttgttgggcaacaatggcttacagagcagacgatgattatgactattgttcaaggttgtgctgattggggactctggtgtgggggaaatccaatctgttgtcaagatttacaaggaatgaattcagcttggagtcgaaatccaccattggggtggagtttgcaacgagaagtatcactgtggatgataaggtcatcaaggcccagatttgggacacagctggtcaagaaaggtatcgagctataacaagtgcttattaccgaggagctgttggtgcattattagtgtatgatgtaaccagacatgtaacctttgagaatgtggagagatggcttaaagagctgagagaccacactgatgccaatattgtgattatgcttgttggtaacaaggcagatctgcgccatcttagagctgtttctacagaggatagcaaagcatttgcagaacgagaatctacatatttcatggaaacatcagccctggaatcaacaaatgttgagaatgcattcacagaagtgcttagccaaatctatcggattgtgagtaagaaagctcttgatatcggggaagaccctgcggcggtgcccagcaaaggacaaacaataaatgtcaacaataaggaggatgtgtcggctctgaagaaagttggatgttgttctgtatagggccaaagcgcattacggagtgttggcttctaaagttttttgtattttggtgtcattttgtcaagaaattgatttctccataattctgtcatggttgcctgtcagttttaagagacaagcagcttcctatgtttaattactctgtatgatttattggtgaactttttgctcttggatgctaccaaagagcagttgttgcc

SEQ ID NO: 3360 - DNA, 1139 bp, Petroselinum crispum
caccgacccactttgttgttttgttgtctttgttttgacaactaagaaaccaatatctccagctaatgatcaaaccccttctcccctctctctgattttcaacaaagtaaatctacactatcaacattgttcatatcacattgcaaatacatacaaaatttttacttttcaataaatgggtgcgtatagagcagaagaggattatgattacctgtttaaggtggtgttgatcggtgattctggcgttggtaaatcaaatttgctttcgagatttacgcgtaatgagttcagcttggaatccaaatctaccattggggttgagtttgctacacgtagtattcatgttgatgataaggttgttaaggctcagatttgggacactgctggtcaagaaagatatcgtgcaatcacgagtgcttactaccgaggagctgttggcgctttactagtgtatgatgttacccgcaatgtcacatttgaaaatgtcgaaagatggatgaaggagcttagggatcacactgattccaacatagtgatcatgctcgtagggaacaaagcagacttgcgtcacttgcgcgctgttaaaacagatgatgctaaagcctttgctgaacgggaaagtaatttcttcatggaaacatctgctcttgagtctttaaacgtcgaagatgctttcacagaagttttaacccaaatctatcgcgtagtaagtcggaaggctctggacatggctgaggacccgactgttctacccaagggacagactattaatgttggtggcaaggatgatgtatcagccataaagaaagctggatgttgctcttcataggtcattgttcaaagattcttgtccgtaaattaaagaagctttatttacagcccaagtgaatgtgatgtgtgcaaagagttttccagagtaggatacatctttctaagcctcattgctgatacttttgtagaaccttatgtgcttaaccatttggcacttatttttatttattcatgtcaaaattcaagcgatacttgacttggttaaagaaggtatgtgctgcttccatcacaatgtttatcaagacatattagtgtataatgtgaaatgcgcttcttgagttcttccattgtattcttatggaattaaa

SEQ ID NO: 3361 - DNA, 987 bp, Cephalotaxus harringtonia
catcaatggcttacagagcagatgatgattatgactatttgttcaaggtggtgctgattggggactctggtgtggggaaatccaatctgctgtcaagattcacaaggaatgaatttagcttggagtccaaatccaccattggagtggagtttgcaacaaggagtattaccgtggatgataaggtcatcaaggcccagatttgggacacagctggtcaagaaaggtaccgagctataacaagtgcatattaccgaggagctgttggtgcattattagtgtacgatgtaaccagacatgtcactttcgagaatgtggagagatggcttaaagagcttagggaccacactgatgccaatattgtgattatgcttgttggtaacaaggcagatctgcgtcatcttagagctgtttctacagaggatggaaaaggatttgcagaacgagaatttacgtattttatggagacatcagccctggaatcaacaaatgtcgagaacgcattcacagaagtgcttagccaaatctatcggattgtgagtaagaaagctcttgatgttggggaagactctgcggcggtgcccagcaaaggacaaacaataaatgtcaacaataaggaggacgtgtcggccctgaagaaagctggatgttgttctgcataggcccaaagcacattacagtcttgtcttctaaagttaattgtattttggtgtcattttgtcaaaaaattgatttctccataattctgttgtggttgcctgtcggttttaagagacaagcagcttcctatgtttgtttagtctgtatgatttatcagtgaaccttttgctcttggttgttgccaaagagcatttgttaccatatagcttttgttgttactctatattagatgaactcttcaaagatttctattgttatcctgggaagatcatgtcgggtttagttgtatttgtaatatatacgttaaaatgcaaattgaaaatcaattcc

SEQ ID NO: 3362 - DNA, 840 bp, Cirsium arvense
atgccagctgatcatcgaaaccgtcggcttttattcatggctactcgatgttgatcatcttctcataatccaacattttgatttgaatccacatttactactaatggcggcatacagagctgatgatgactacgattatctcttcaaggtcgttctcatcggagattccggtgttggcaaatccaatttgctttccaggtttaccagaaacgagtttagccttgaatctaagtccacaatcggcgttgaattcgccaccagaagtattcgtgttgatgataagatcatcaaagctcagatttgggatactgctggccaagaaagataccgcgcaatcacaagtgcatactaccgaggagccgttggtgctttacttgtttacgacacaacacgccacatcaccttcgagaacgtcgagagatggttgaaagaactccgagaccatagtgattcaaatatcgtaataatgctagtgggaaacaaatcagatttacgtcacttacgtgcagtttccacagaagatgcaaaaaccttcgctgaaaaagaaaacacttattttatggaaacatcggctctcgaggctctgaacgtagaaaacgcttttactgaagtacttacacaaatatatcatgtagttagccgaaaagcactcgatattgggaacgatcctgcatcattgcctcaaggtcaaaccattaatgttgggtcaaaagatgatgtttcggctgtcaagaaagtcggttgctgttctacttgatttttgaagctttcggctgataatcgggttagttttatgagcaaaaatttagtaaatactttttaagtaaagaaaaagtagag

SEQ ID NO: 3363 - DNA, 999 bp, Conyza canadensis
cttctttcgatatcaaataaatatatcaaaaaagttatataaacaattttcgttaacttgatacatataaatagttatatacatatattagagcagagcagagcagatggcagcatatagaggagatgatgattacgattatttgttcaaagtggtattgatcggggattcaggcgtcgggaaatcgaatttgttatcacgattcactcgtaatgagttcagtctcgaatctaaatcaacaattggtgttgaatttgctactagaagtattcgtgttgatgataaagtcatcaaagctcagatttgggatactgctggtcaagaaaggtaccgtgcaatcacaagtgcatactatagaggagctgttggtgcattactcgtctatgacacaacacgccatgtcacctttgagaacgttgcgagatggttgaaagagctcagagaccacagtgactcgaacattgtgataatgctagtaggaaacaaggcagacttgcgtcacttacgtgcagtttccactgaggatgcaaaggcttatgctgaaaaggaaaacacttattttatggagacatcagctctggagtccctaaatgttgaaaatgctttcactgaggttcttacccaaatctaccacgtggttagccgaaaagcacttgacattgggaacgatgctggagaattgcctaaaggtcaaaccattaatgtcgggtcaaaagatgatgtttctgcaatgaagaaagttggttgctgttctacttgaactacaatacttaaagatcaagatttttgaagtttctgctatttctagcgcatggagtgactatgaagtcttttaagaaaagtagatcaggctactggtgattcttcaagtttttatggtttttttgtattatttttttatctttttttttacctgtagtggattgtgtgttatatatttgggtgcccgttcttttagatttgaagcaatatttctattttgacattatatttagtaga

SEQ ID NO: 3364 - DNA, 909 bp, Gossypium hirsutum
tctttttttaaatatcttattacaatttcaaaatcgatgccaccgatctctgccacttgataaaattttcctcataaattcaaatctttattttttttcaagatccgatagaagcacccgacctggtgatccgaaatggcggcgtatagagcagatgacgactacgactatttgttcaagctagtattgatcggagattcgggggttgggaaatcgaacttgttgtcgagattcacgaaaaacgagtttaatctggagtcaaaatccacaatcggagtagaatttgctacccgaagtattcgggtcgatgataaggtcgttaaggcccagatttgggacaccgctggacaagaaagataccgggcgattacaagtgcgtactaccgaggagctgttggtgcattgcttgtctatgatgtcactcgacacatcacatttgagaatgtcgagagatggttgaaggaactacgggatcacacggactccaatatcgtgattatgctcgttggtaacaaggcagacctacgacacttgcgtgccgtttccaccgaggaagctaaggccttcgccgagagagagaaaacgtactttatggagacatctgccctcgagtccctgaatgtagagaatgcattcactgaagtactaactcgaatataccatgtggtaagtcgaaaagcactcgaagtaggggatgatcccgcagcattgccaaagggacaaaccatcaatgtcggcaaggacgatgtttcagccctcaagaaaatcggctgctgttctgcttaactgtcagatgattttgagtgttgaagttcccccctcaaaatttttatctcattaagacccccccaaaccccaaaaaaagaagaaacttccttaactagtatttgatatcagtttcctttttca

SEQ ID NO: 3365 - DNA, 851 bp, Flaveria ramosissima
actcaaaaccaacaattcttacaaactttcgatttagtagtgaagatcattgcataaattcaaatgggtgcctacagagccgacgatgattacgattacctcttcaaggtagttctgatcggagactctggagtcggaaaatcaaatcttttgtccagattcacacgaaacgagttcagtctcgagtctaaatccaccatcggcgttgaattcgccactcgtagcattcgagtcgatgaaaaggtcatcaaggctcagatttgggacactgcgggccaagaaaggtaccgtgcaattacaagtgcatactaccgaggtgcagttggcgcattgctggtctatgatgtcactcgaaacgtcaccttcgagaatgtacagaggtggttaaaggagctaagggatcatacagattccaacattgtcattatgcttgtgggcaacaaagctgatttacgccatttacgagcagtccaaactgaagatgccacatcatttgccgaaaaagagcacacctacttcatggaaacctctgcacttgaatcactaaacgtcgaaagcgcattcacagaagttcttacccaaatctatcatattgttagtagaaaagcacttgatggcggcgatgatcaggcggcgctgccaaaggggcagacgattaatgtgggcgggaaagatgatgtgtcagcagtgaagaacgccggatgttgttcttcgtaagaaaggcgcttttgatcaagggagtgagtataaatcataacttttcattgtttctcttcaaaatggttattttgattctgatgtattgttacagttgatagcaagcaatctacatttaaaagttcctttctggt

SEQ ID NO: 3366 - DNA, 1178 bp, Mimulus guttatus
ctctctctctctcccaccttccaccattacatttacacccccaaaataaaactctcgacacattttcatttctgttactagtatatgatctcataacctaagtgataaatctcaaggattacgtatatatatagatacacacatatatatatatatatatatacgtttctgtatactagtatagattggagatggcgggcggatatagggcagacgacgactacgattacctcttcaagctggtcctgatcggcgactccggcgtcggcaaatcgaatttgctgtccagatttgctcggaacgagttcagcttggagtcaaagtctactattggcgtcgaattcgccacccgcagcattcgcgtcgatgataaggtcgtcaaggctcagatttgggataccgccggccaggaacgataccgcgcgatcacaagtgcatactaccgaggtgccgtaggagcacttctcgtgtacgacgtgactcgccacgtcacattcgagaacgtggagaggtggttgaaggagctgcgggaccacacggaccagaacatagtgataatgctggtcggcaacaaggcggatctccgccacctacgagcagtctccacagaggacgggcaagcctttgcagagagagagaagacatatttcatggagacatctgcactcgagtccttaaacgttgaaaatgccttcacggaagtgcttacacaaatacaccaggttgttagccgtaaagcacttgacattggagatgatcctgcatcactgcccaaaggacagaccataaatgttggggcaaaggacgatgtctcggcggtgaagagagggggctgctgcactgtatgaagagaagaaacaaaggaggtggttcgttttgtggggtggctctttattgtcagttttgggaggtgggaatttgctctgcttgcgaacttttattcgaatggaatcgtgggttaattcggattttaccgggggggtttttttcctctgtatttgtgttgtaatggtccattatgaattacactgtactatgtttttcaattttcacttgactttgagattctgggatttgtattatgttttgaattttttagtggctgtcttttgacaaaacttatgatcttgttgttgtttacaaaaatgtcattacactgtttagatcttgattcttgc

SEQ ID NO: 3367 - DNA, 721 bp, Mimulus guttatus
atcaacgaagcagggaagaagaagaagaagatcgcgcagcagaaacaaacaaatgggagcgtacagagcggacgaggattacgattacctcttcaaggtggttctgattggcgattccggcgtcggaaaatcgaatcttctgtctaggttcacgaagaacgagttcagccagcagtccaaatccacgatcggcgttgagttcgcgacgcgttcgattcaggtcgacgataaggttgtcaaggcccagatttgggataccgccggccaggaaaggtaccgagcaattacaagcgcatactacagaggagcagtgggtgcattacttgtttacgacgtgacacgtaacgtgaccttcgaaaacgtcgagagatggttgaaggagcttagaggccacacagatgcaaacattgtcatcatgctcgtaggtaataaagcagatctacgtcaccttagggcggtccccacagagaaagccaaagcattcgctgagaaagaaaacacgtttttcatggaaacttctgccttagaagctctgaatgtagagaattcattcacagaagttttgacacaaatctatcatgtggtgagtaaaaaggctctcgatataggcgatgacccttcggctttgcctaagggacaaacgattcatattggaaataaagacgatgtttctgctgtcaagaacaaaggctgctgctctggctaacactagcagaaaaac

SEQ ID NO: 3368 - DNA, 1034 bp, Nicotiana benthamiana
agcagaaccagctttttaaacttcaactttcttcaactctcaactctctctctctctctttctctctctccacatagtcattcgtaattgtaattatactgcaattaagagactaacaaataaatggcaggtggatacagagctgaagatgactacgattatctgttcaagttggtcctaattggggattctggtgtcggcaaatctaatctgctttctcgattttcgcgaaatgagttcaatcttgaatctaagtctactattggcgttgaattcgctacccgtagcattcgggtcgatgataagatcgttaaggcccagatttgggacactgctggccaagaaaggtaccgtgcaattacaagtgcatactacagaggggctgttggtgcattagtagtgtatgatatcactcgacatgtcacatttgaaaatgtggagagatggttaaaagagcttcgagaccatacggaccaaaatattgtcataatgcttgttgggaacaaggctgacttacgccatttgcgtgctgtctcgacagaggatgccaaggcgtttgctgaaagagagagtaccttctttatggagacttcagcactcgaatccttgaatgttgagaatgcctttactgaagtattgaccgagatatacaaggtggtctgtcgtaaagcgctagaagttggggatgatcctgctgccttgccaaaggggcaaactataaatgttggcaaggatgatgtttcagctgtgaaaaaagttggttgttgttctgtctaagcgaaagattaagaaatcagtgggtaataactgcgattctgtgcttatacttccaaatgcttactgcaaccagcaaatgctcttcttagctgcattcagttttgaatctcttaggaaatatagcattatgttcatccttatccgcaggatgatgtcttactttattcgacatcttgtattgtttcattaacttacttttagtttgtacactactttgttttggtctttggcttcttgcatcttgcatctctttcata

SEQ ID NO: 3369 - DNA, 978 bp, Olea europaea
aaaagaaaggaatggaatagtctggcaggccatctttcataacgggtgtattaatctttgcttcaacttggattcaaattcaattcaacccctcctctcttcccaaagtgatatcatacacaaagcctagatttatatagacacatagtgtgtgtatatacatacatagacacaagtcaaaatgggtgcttacagagctgacgatgattatgattgcttgttcaagttggtgctaatcggcgattctggtgttggaaaatcgaatttgctttcgagattcagccgaaacgagttcagtttggagtccaagtcaactatcggtgttgaattcgccactcgaagcattcgagtcgatgagaaggttgttaaagcccagatttgggacactgctggccaagaacgatatcgtgcaatcacaagtgcctactatcgaggagctgttggtgcattgcttgtgtatgatgttacgcgtcatgttacatttgaaaatgtggagaggtggttaaaggaactcagggatcacacggattcaaacattgttatcatgcttgttggaaataaggcagacttgcgtcacttgcgcgctgtttctacagaagatgcaaaggcatttgctgagagagaaaacacatatttcatggaaacttctgctctggaatctacgaatgtggaaaatgccttcacagaagttcttagtcaaatatatcatgtcgtcagcaggaaagctctcgaggtcagtgatgatccagcggctttacctaagggacagaccattaatgttggctctaaagatgatgtttctgagataaagaaagttggctgttgctctgtttagaaagaaatgcaactccatttattctaatgtaatctaatgtccatgtggccggggattttcccattgaaccatcgactacatggattgttcatttgtttgaaccaaaactttatccctatagttgaagattttgttaattgcaa

SEQ ID NO: 3370 - DNA, 1055 bp, Sciadopitys verticillata
cagtgctggagtaatggtctgaaagcaaattgtactttaatagagggcacttcttagaattgttgggcaatttcatttttctctgggggaaggtaaagaaatggcttacagagcagacgatgattatgattatttgttcaaggtggtgctgataggggattcaggagtgggcaaatccaatctgctgtcaagatttacaaggaatgaattcagcttggagtccaaatccaccataggagtggagtttgcaactcgaagtattactgttgatgataaggtcatcaaggcccagatttgggacacagctggtcaagaaaggtaccgggctataacaagtgcctattatcgaggagctgttggtgcattgttagtgtatgatgtaaccagacatgtaactttcgagaatgtggagagatggctcaaagagctcagggaccatactgatgccaatattgtgataatgcttgttggcaacaaggcagatctgcgtcatcttagagctgtgtctacagaggatggcaaggcatttgcagaacgagaatccacatattttatggagacatcagccctggaagcaactaatgttgagcatgcattcacagaagtactaagccaaatctatcgaattgtgagtaagaaagctcttgatgttggggaagaccctgcagcagtgcccagcaaagggcagacaataaatgtaaacaataaggaggatgtgtcggctttgaagaaagttggatgttgttcagcataggtttaaagtgcattccatgttgttgtctactaagcttttagatttcagtatcattttgtcaagaaattgatttctccacatttctgccgtggttgcctgtcagttttaagagacaagcagcttcctatgtttgattactttgtatgattcatcggtgactttctgctcttggatgtgctgaagagcacttgctgccatatggctttcgttgcatctaatgttagaggaacactcgaaagacttctattgttgttagcttgggaagatcatgtcaaatgttgggtttagctgtatctctaat

SEQ ID NO: 3371 - DNA, 1140 bp, Glycine max
aaacaactggaaaatggaattaattgtttgtttggcactttatagttacaccagtgtcatcattatttcattccccgctaacaatttgccaactaagaaaccccaaaagttgttccaaatctggatttcaaaacaaaatatagattcgccgcaacccatttgaatctctgagagaaggggcatatcaaaatcaattttttttttctttcttcttttccctgaagagcaaatgggggcgtatagagctgatgaggattacgattatttgttcaaggtggtactgattggggactctggtgtgggaaaatcgaaccttttgtcgaggttcaccaagaacgaattcagccttgaatcaaagtccaccattggggttgagtttgccaccagaagcattagggttgatgataaagttctcaaggctcagatttgggacactgctggccaagaaaggtatcgagcaatcactagtgcatattatcgcggagctgttggtgctttattagtctatgatgttacccgccatgttacatttgaaaatgtggagagatggttgaaggagctcagagatcacacagatgccaacattgtggttatgcttgttgggaacaaagcagacttgcgtcatctgcgagcagtttccaccgaagaaactacaaattttgcggaacgggagaaaacgtttttcatggaaacatccgctctcgagtccctgaacgttgaaagtgccttcacagaagtgctgacacagatctatcatgttgtaagcaagaaggcccttgaaattggtgatgatccagcagcattaccaaaaggacagacgataaatgttgggtctcgtgatgatgcatcggctgtgaagaaagatggatgttgttctgcttgatcatgcagtaatgtatatgttctgtttatatccatgtagagtttcacccttaaagcatgaaaatgattgtctagacctttacaatctcaactttctgctttggtatgcagagaaatctgttcaatttaagtcaaatttttaggaaacatgcacttccattttgctatttggttgttgtttcatgaaggtgttaatttatcgaatttttcataggcttctttattctttttgttgttttttatgcatgcagattcatg

SEQ ID NO: 3372 - DNA, 954 bp, Eutrema halophilum
atgtgcgtttcttcttcccctttcgtctgtacgcgctttcttactggttacctgaaaatcgccgattctggaaccagaagctttattctccgatcgaagaaacccttcacaaattcacaatggcggcgtatagagctgacgacgattacgatttcctctacaaggtggttctaattggagattccggcgtcggtaaatcaaacctcctttctcgattcacgcgtaacgaattcagcctcgagtctaaatccacgatcggtgtcgaattcgccaccagaagcattcgcgtcgacgaaaaaatcgtcaaggctcagatttgggataccgccggtcaggagagataccgagcaatcacaagcgcatactatcgaggagctgtgggagctttgctcgtctacgatgctacacggcatatcacgtttgagaacgttgagagatggctaaaggagcttagagaccacacagacgccaacattgtcgtcatgcttgttgggaacaaggctgatctgcgtcacctaagagctgtttcaacggaagacgccaaagcctttgcagagagagagaacacattcttcatggagacatctgcactcgaagcactcaacgttgagaatgctttcactgaagtgctttctcaaatataccgtgtggcaagcaagaaagcgctggatattggagatgatccggctactctccctaaaggacagagtatcaatgttgggtctaaagacgatgtttctgaggtcaagaaggtcggatgctgctcaagttgatctacatttttccagtaacatttccttcttggtttcttagtgaaactatatagtttgatatacagattcttccttgtgttttccttttgctgtttctcttttcttctttggatgtaagtttctcagatccttataatgttttaaatatcttcacacaatgacaattatgttcgagaatcta

SEQ ID NO: 3373 - DNA, 1065 bp, Nicotiana tabacum
gtctgacacaagtcacaattctcaaatgaatcatttattaccagctaccttgttcgtaggagcagcagctccagctttttaaacttcaactttcttcaactctcaactctctctctctcctctctctctctctctcacacagtacacccacataatccgtaattgtatttatactgcaattaagagattaacatataaatggcaggtgggtacagagcagaggatgactacgattatctgttcaagttggttctaattggggattctggtgtcggcaaatctaatctgctttctcgattttcgcgaaatgagttcaatcttgaatctaagtctactattggcgttgaattcgctacccgtagcattcgggtcgatgataagatcgttaaggcccagatttgggacactgctggccaagaaaggtaccgtgcaattacaagtgcatattacagaggggctgttggtgcattagtagtgtatgatatcactcgacatgtcacatttgaaaatgtggagagatggttaaaagagcttcgagaccatacggaccaaaatattgtcataatgcttgttgggaacaaggctgacttacgccatttgcgtgctgtctcgacagaggatgccaaggcatttgctgaaagagagagtaccttctttatggagacttcagcactcgaatccttgaatgttgagaatgcctttactgaagtattgaccgagatatacaaggtggtctgtcgtaaagcgctagaagttggggatgatcctgctgccttgccaaaggggcaaactataaatgttggcaaggatgatgtttcagctgtgaaaaaagttggttgctgttctgtctaagcgaaagattaagaaatcagtgagtaataactgcgattttgtgcctatacttccaaatgcttactgcaaccagcaaatgctccttcttagctgcattcagttttgaatctcttaggaaatgtagcattatgttcatccttatccgcaggatgatgtcttactttattcgacatcttgtattgtttcattaacttacctttagtttgtacacta

SEQ ID NO: 3374 - DNA, 1115 bp, Nicotiana tabacum
cttttcctgtgtctaacacaagtcacaatcctcaaatgaaccctttaatacctgctaccttcttagtaggagttgcagctccagctttttaaacttcaactttcttgaactctcaactctctctctctctttttaagtacacccacataatcagtaagtatatttatactgcaattaagagattaacatataaatggcaggtgggtacagagctgaggatgactacgattacctgttcaagttggtcctaattggggattctggtgtcggcaaatctaatctgctttctcgattttcgcgaaatgagttcaatcttgaatccaagtccactatcggcgttgaattcgctacccgtagcattcgggtcgatgataagatcgttaaggcccagatttgggacactgctggccaagaaaggtaccgtgcaattacaagtgcatactacagaggggctgttggtgcattagtagtgtacgatatcactcgacatgtcacatttgaaaatgtggagagatggttaaaagagcttcgagaccatacggaccaaaatattgtcataatgcttgttgggaacaaggctgatttacgtcatttgcgtgctgtctcgacagaggatgccaaggcgtttgctgaaagagagagtaccttctttatggaaacttcagcactcgagtcgttgaatgttgagaatgcctttacagaagtattgactgagatatacaaggtggtctgtcgtaaagcgctagaagttggggatgatcctgctgcattgccaaaggggcaaactattaatgttggcaaggatgatgtttcagctgtgaaaaaagttggttgctgctccgtctaagcaaaagattaagaaatcagtgagtgatgactgcgattctgtgcctatacttccaaatgcttactgcaaccagcaaatgctcctccttagttgcattcagttttgaatctcttaggacatgtagcattatgttcatccttatccgcaggatgatgtctttaatcactttattcgacatcttgtattgtttcattaacttacctttagtttgtacactactttgttttggtctttggctctttgcatcttgcatctttttcatagcgag

SEQ ID NO: 3375 - DNA, 863 bp, Musa acuminata
ccctgcgacaacccattcccacttcctccgagtcgaaggagagcgacggcgttggagaggcacgctgagccagacggagcgcggatctgatcgccggatagaagcggcggtggcggaggctgaggaatggcgtacaggtccgacgacgactatgactacctcttcaaggtggtgctcatcggcgactctggcgtcgggaagtctaacctcctctctcggttcacccgcaacgagttcagcctcgagtccaagtccaccatcggcgtcgagttcgccacccgcagcatccgcgtcgaggataaggtcgttaaggcccagatttgggataccgccggccaagaaagataccgagcaatcactagtgcttattatcgaggagcagtcggtgcccttctggtctatgatgttactcggcatacgacatttgagaatgtggagagatggatgaaggagctaagggatcacactgattccagtattgtgattatgcttgtgggcaacaaagcggatttgcgccatctcagggctgtcacggtggaggacgcaaaggcttttgccgagagggagaactccttctttatggagacatctgctctagaatcaaccaacgtggacaatgccttcacagaagtactcacccagatatatcgtgtgacaagcaggaaggcgctcgatgctggtgatgatcccgcaacgttgccaaagggtcaaaccatcaacatcggcacccatgatgatgtatctgctgttaagaaagctggttgttgttcagcgtagatcagatgtggagcaaaatatttgttatctttatttaagtttacgttgcactgattattatttttctagtaaatattgtaccaaac

SEQ ID NO: 3376 - DNA, 813 bp, Chrysanthemum coronarium
aaaacacttttataaaaaaccaaacaaccaagcaactagattaaaaatggcgtataaagcagacgatgattacgattacctgttcaaagtggtactgatcggtgattcaggtgtagggaaatcgaatctgttatcaaggtttaccagaaatgagttcagccttgaatctaagtctaccattggcgttgaattcgccacccgtagtattcaagtcgatgataagaccatcaaggctcagatttgggacactgctggtcaagaaaggtaccgtgcaatcacgagtgcctactacagaggagctgttggtgctttgctagtttacgacacaacacgccacgtcaccttcgagaacgttgagagatggttaaaagagctcagggaccacagcgactcaaacattgtgataatgctagtaggaaacaaggcagacttgcgtcacttacgtgcagttacaacagaagatgccaaaacctatgctgaaaaggagaagacttactttattgagacatcggctttggaggccctcaatgttgaaaatgctttcactgaagtacttacccaaatataccatgttgtaagcaaaaaagcacttgatattggcaacgatcctagtgcattgcctaaaggtcaaaccattaacattgggtcaaaagatgatgtttctgcagtgaagaaagctggttgctgttctacttaaaaacaatagcagattattaagattatcagattgtttttgagcaaatttgaagtctttaacaagaaaagtagatcatggctactggttttactcacatattttctggtcttttttgt

SEQ ID NO: 3377 - DNA, 770 bp, Chrysanthemum coronarium
atttccctagattgaatcttgttaaatggcgtataaagcagacgatgattacgattatttattcaaagtggttctgatcggtgattcaggtgtaggtaaatcgaatctgttatcgagattcactagaaatgagttcagccttgaatctaagtcaactattggcgttgaatttgctaccagaagtattaaagttgatgataaaactatcaaggctcagatttgggacactgctggtcaagaaaggtaccgtgcaatcacaagtgcatactacagaggagctgttggtgctttgctagtctacgacacaacacgccacgtcacctttgagaatgttgagaggtggttgaaagagcttagagaccatagcgactcaaacattgtgataatgctagtaggaaacaaggcagacttgcgtcacttacgtgcagttacaacagaagatgccaagacctatgctgaaaaggaaaagacctattttattgagacatcggctttggaggccctcaatgttgaaaatgctttcactgaagtacttacccaaatataccatgttgtaagcaaaaaagcacttgacattgggaacgatcctagtgcattgcctaaaggtcagaccattaacatcgggtcaaaagatgatgtttctgcagtgaagaaagctggttgctgttctacttaaaaacaatagcagattattaagattatcagattgtttttgagcaaatttgaagtctttaacaagaaaagtagatcatggctactggttttactca

SEQ ID NO: 3378 - DNA, 1068 bp, Fagopyrum esculentum
ggggggaatcaaaatccatatgcaaagcttttgaccttaaggtttctcccttccttttcaaaccgatttctttcaccaaactgcgacaaatatccctaaaatgtctaatttcagagccgatgatgactacgattacctcttcaaagtcgtgctgatcggagactccggtgtcgggaagtccaatcttctctctagattcactcgtaacgagtttagtcttgaatctaagtcaacgattggagttgaattcgctactcgtagtgttcgtgttgatgagaagatcgttaaggctcagatttgggatactgctggccaagaaaggtatcgtgcgatcactagtgcatactacagaggcgctgttggtgctctactagtctatgatgtgaccagacacgtcacatttgagaatgtggagagatggttgaaggagctgagggatcacacagagaccaacattgtgataatgcttgttggaaacaaggctgatttaaggcacttacgtgctgtaagtaccgaagatggcaaaacctttgctgagaaggagaacacattcttcatggaaacatctgccctcgagtccataaacgttgagaatgctttcactgaagtacttacacaaatatacaatgtagtaagcaggaaagcacttgaaataggggagaccctgcagccttgcccaaaggacaaactatcgacatcagcggcaaagatgacgtttcagctttgaagaaggatggttgctgttcttcataaactaaaaggcaaatcacttaactttgtgatatacttgaatatgtgtcattccttcactttcaggattcaccgtgatcaaagcagtgcgaattcttgcaagactatttatcgaggtatacattttggagtgcttctgttgaggaaaaatgtgcgatccttttaatcaatccatttataggacttagactgtggaatcgaaattccagtttctcacatttgctatatgatttttgttatctttccatcagggtactgataatttggcttgtattttattctttgatttctttgttccagtcatactcttgttttgga

SEQ ID NO: 3379 - DNA, 937 bp, Tropaeolum majus
tcttacaagctgctctgcatgatccaagataactaacccacgtgtatctatcgacaattccgaaaaacaaccggaaacgagaacccgaagaaagaatggcggcgtacagagcagacgacgactacgattaccttttaaggtggtgttgatcggcgattcaggggtgggtaaatccaacttgttgtcacgatttacaaggaatgagttcagcctcgaatccaagtccacaatcggggtggaattcgctacacggagcatccaggtggatgacaagatcgttaaggctcagatttgggataccgccggccaagagagataccgtgcaatcacaagtgcatactacagaggagctgttggtgcactgcttgtctacgatgtcacccgacacgtcacattcgagaatgtcgagagatggctaaaggagctacgagggcacacagactccaatattgtcatcatgcttgttggcaacaaggccgaccttcgtcacttgcgtgctgtttcgaccgaggactcgcaggcgtttgcagagagagagaacaccttctttatggaaacatctgcccttgaatccttgaacgttgaaaatgcattcaccgaagtgctagcccaaatatatcgcgtcgtcagccggaaagccctggatataggggatgatccaacagctttgcccaaaggaaaaactattaatgttggatcaaaagatgattcagctggcaaaaatgatggctgttgctctgcttaaatcatcgataatatatactcgtatgtttttcacatggcaaggtcctcgatgtttcaatctgtttgttttggacgcctagtttatctgagagtagaacgtgctgcatcttttgtatcgatcattcatttgatttagttatttaatagtttctaatttggtgtaatgcttttgttacttcatgtatgtaatttt

SEQ ID NO: 3380 - DNA, 1103 bp, Amsonia hubrichtii
ctactatactttggtctagggttagggtttctccaaatctttaccctctcaaactgaaaatttcattttcatttttgagaggcgtgtagatatatagttgtattattttgattgttattgctgatcttttgaggatcatcataaggtttgatggcgggagtatatagggcggatgatgactatgactacttgtttaaggtggtcttaattggagactcgggcgtcggtaaatcaaatctactatcgcgatttactcggaacgagtttagtcttgagtctaagtcaaccataggagtcgaatttgctacccgcagcatccgcgttgatgagaagattgtcaaggcccagatttgggacaccgctggccaagaacgataccgtgcaattacaagcgcatactaccgaggggctgttggtgctttgcttgtgtatgatgtcactagacatgtcacttttgagaatgttgagagatggctaaaagagcttcgagaccacacagaccaaaacattgtaataatgcttgtggggaataaggctgacttacgacacttgcgtgctgtttccacagaggatgcaacggcctttgctgagagacagagcctttattttatggaaacttcagcactggaatctctgaatgttgaaaatgcatttactgaagtacttactcaaatacataatgtggttagtaggaaagcacttgaggttggggatgatcctgcagcattgcccaaagggcaaacaatcaacgttggcaataaggaagacgtttcagctgtgaaaaaagttggttgctgctctgcataagtactaaaagtaaaggattgaagagcaaagattacttctgcctagtatcgtttggtgataccctaattgctgtggttttggcagttgtatgctggagcagcagggtggctcttggtttttgacctcagagaaaatgcggcatacagattcctcaacctataccgagtttattagaaatctatctttcccaacttgtataatttcatcatttactttggtttagcatgtatcaagttacattttctataggttcttatagctacttcttgctcttggattttgcccctgctcagtta

SEQ ID NO: 3381 - DNA, 1197 bp, Catharanthus roseus
ctttctttacttttacttgcagcttcactttgcacactctctgatgctctcttcaaattccaatttttcataagtagaaaacttcacttcattctgtttgattcaccaatttccacgcttttctcccaattttattcttttctagagttagggtttctccaaatcttgccctttcaaactagaatttcagtttcgagacgcatagattgatgattgtatcattttcctgtctattgttgatattttgagtttcgatggcgggaggataccgggcagacgatgactatgattacttgttcaaggtggtcttaatcggagactccggcgtcgggaaatcgaatctgttgtctagattcactcgtaacgaattcaatcttgagtctaagtcaaccatcggtgtcgaatttgccacccgaagtattcgcgttgatgacaagattgtcaaggcccagatttgggacaccgctggtcaagaacggtaccgtgcaattacgagcgcatactaccgaggggctgtgggtgctttgcttgtgtatgatgtcactagacatgtaactttcgagaatgttgaaagatggctaaaagagcttcgggatcacacagaccaaaacattgtaataatgcttgtgggaaataagggcgacttgcgacacttgcgtgctgtttccacagaggatgcaaaggcctatgctgagagagagaacctgtatttcatggaaacatcagcactggaatcgatgaatgttgaaaatgcatttactgaagtacttactcagatacatcatgtggtcagtaggaaagcacttgaggttggagatgatccttcagcattacccaaagggaaaacaatcgatgttaaggatgatgtttcagctgtgaaaaaagttggttgctgttctgtctaacaacttagccaatactagattattcaatctagtatcatttggtagttccttcaattgatgtgctttcagctgtttttgatgcatttgcaaaaggttggctctcggtttttttacctcagagaatgcatcatgcagattcctaaacaaatacctagttgattagaatacccatctttctcaacttgtattgctttattgttttactgtggtttatcctgctgttgtatgatgatacatcttctttagggttgatcttttatttgttgggttaaatcgtaaagtaactattatt

SEQ ID NO: 3382 - DNA, 1119 bp, Nicotiana benthamiana
ctttgcctgtggctgacacaagtcacaattctcaaatgaatcatttattaccagctaccttgttagtaggagcagcagagccagctttttaaacttcaactttcttcaactctcaactctctctctctctctctctctctctctgtcttacacccacataacccgtaattgtattcatactgcaattaagagattaacatataaatggcaggtgggtacagagcagaggatgactacgattatctgttcaagttggttctaattggggattctggtgtcggcaaatctaatctgctttctcgattttcgcgaaatgagttcaatcttgaatctaagtctactattggcgttgaattcgctacccgtagcattcgggtcgatgataagatcgttaaggcccagatttgggacactgctggccaagaaaggtaccgtgcaattacaagtgcatactacagaggggctgttggtgcattagtagtgtatgatatcactcgacatgtcacatttgaaaatgtggagagatggttaaaagagcttcgagaccatacggaccaaaatattgtcataatgcttgttgggaacaaggctgacttacgccatttgcgtgctgtctcgacagaggatgccaaggcgtttgctgaaagagagagtaccttctttatggagacttcagcactcgaatccttgaatgttgagaatgcctttactgaagtattgaccgagatatacaaggtggtctgtcgtaaagcgctagaagttggggatgatcctgctgccttgccaaaggggcaaactataaatgttggcaaggatgatgtttcagatgtgaaaaaagttggttgctgttctgtctaagcaaaagattaagaaatcagcgagtaataactgtgattctgtgcctatacttccaaatgcttactgcaaccagcaaatgctcctccttagtcgcattcagttttgaatctcttaggaaatgtagcattatgttcatccttatccgcagggtgatgtctttacttactttattcgaaatcttgtatcgtttcattaacttacctttagtttgtacacttctttgttactgtctttgtctcttacatcttgcgtctttttcat

SEQ ID NO: 3383 - DNA, 1068 bp, Centaurea maculosa
atacacacctgttttaccaaattgtctcacccccaaaatcagcacccaaatcttttccaaataaaatctcaatccttcttcacattcacacccaccatctccctaaccctacttcagatttgcattcattgctttcttaacacacagatctgcaaaacccttgttcaaatcaaactcaattcttgcttattttcattcattctgttaaagatcaatgggtgcttacagagcagaggatgattacgattacttgttcaaagtggttctcatcggtgattctggagtcggaaagtctaaccttctctccagattcactcgaaacgagttcagtctcgagtctaaatccaccatcggagttgaattcgctactcgtagcattcgtgttgatgataaagttgttaaggctcagatttgggatactgctggtcaggaaaggtaccgtgcaatcacaagtgcatactaccgaggtgcagttggcgcattgcttgtttacgatgtcacacggcacgtaacttttgagaacgtagaaaggtggttaaaagagctccgggatcatacagattccaacattgtcataatgctcgtgggaaacaaagccgatttgcgccatttacgggctgtacaaaccgaagatgccacatcatttgccgaaaaagagcacacttacttcatggaaacttccgcgcttgaatcacttaatgtagaaagtgctttcacggaagttcttacgcaaatctatcaaattgtcagcagaaaagcacttgaatctggcgatgatgcggctgcggtacctaaagggcagacgattaatgtcgatgatgtatcggcggtgaagaaaggcggatgttgttcttcgtagatggaaaaaagatgggttttttgggtgagttttggtcaaatggatggaaatttgggtataaaatcatagtttttattgttttatcaaatactgaatccgagttttatggctatgcgcaaggatttttaggttgatgtgttgttttatagttgatggcaatcttctgaataggtttacatttgattgctgttttaggggttatgtcttta

SEQ ID NO: 3384 - DNA, 942 bp, Centaurea maculosa
cacattcacaccccatctccctaaacctacttcacatttgcattcattgctttcccaattctctcaacaacacacagatctgacaaaaccctaaatacaaatcaaacttacaaaaacaaacaaattcttgcttaatttcattctgttaaacatcaatgggtgcttacagagcagaggatgattacgattacttgttcaaagtggttctcatcggtgattctggagtcggaaagtccaatctcttgtccagattcactcgaaatgagttcagtctcgagtctaaatccaccatcggagttgaattcgctactcgaagcattcgtgttgatgataaagttgttaaggctcagatttgggatactgctggtcaggaaaggtaccgtgcaattacaagtgcatactaccgaggtgcagttggcgcattgcttgtttacgatgtcacacgacacgtcacttttgagaacgtagaaaggtggttaaaggagctccgggatcatacagattccaacattgtcattatgctcgtgggaaataaagccgatttgcgccatttacgggctgtacaaaccgaagatgcgacatcatttgccgaaaaggagcacacttacttcatggaaacctctgcgcttgaatcactgaatgtagaaagtgctttcacggaagttcttacgcaaatctatcaaattgtcagcagaaaagcacttgaatctggtgatgatgcggctgcggtacctaaagggcagacgattaatgtcgatgatgtatcggcggtgaagaaaggcggatgttgttcttcgtagatggaaaaaagatgggtttttttgggtgacttttggtcaaatggatggaaatttgggtataaaatcatagtttttattgttttatcaaatactgaatccgagttttatggctatgcgcaaggatttttaggttgatgtgttg

SEQ ID NO: 3385 - DNA, 943 bp, Centaurea maculosa
cattcattgctttcccaattctctcaacccacacacagatctgcaaaacccttgttcaaatcaaactcaattcttgcttattttcattcattctgttaaacatcaatgggtgcttacagagcagaggatgattacgattacttgttcaaagtggttctcatcggtgattctggagtcggaaagtccaatcttctctccagattcactcgaaacgagttcagtctcgagtctaaatccaccatcggagttgaattcgctactcgtagcattcgtgttgatgataaagttgttaaggctcagatttgggacactgctggtcaggaaaggtaccgtgcaattacaagtgcatactaccgaggtgcagttggcgcattgcttgtgtacgatgtcacacggcacgtcacttttgagaacgtagaaaggtggttgaaagagctgcgggatcatacagattccaacattgtcataatgctcgtgggaaacaaagctgatttgcgccatttacgggctgtacaaaccgaagatgcgacatcatttgccgaaaaggagcacacttacttcatggaaacctctgcgcttgaatcactaaatgtagaaagtgctttcaccgaagttcttacgcaaatctatcaaatcgtcagcagaaaagcacttgaatctggcgatgatgcggctgcggtacctaaagggcagacgattaatgtcgatgatgtatcggcggtgaagaaaggcggatgttgttcttcatagatggaaaaaagatgggtttttttgggtgacttttggtcaaatggatggaaatttgggtataaaatcatagtttttattgttttatcaaatactgaatccgagttttatggctatgcgcaaggatttttaggttgatgtgttgttttatagttgatggcaatcttctgaataggtttacatttgattgctgttt

SEQ ID NO: 3386 - DNA, 949 bp, Cirsium arvense
tctcacccccaaaatcagcacccaaatcttttccaaataaaaatctcaaatccttcttcacattcacaccccatctccctccctaaaccctacttcacatttgcatccatattgcttccccaattctcaacaacacacagatctgcaaaaccctaaatcaaaatcaaacttcaaaaacaaacaaattcttgcttaatttcattctgttaaacatcatcaatgggtgcttacagagcagaggatgattacgattacttgttcaaagtggttctcatcggtgattctggagtcggaaagtccaatcttctgtccagattcactcgaaacgagttcagtctcgagtctaaatccaccatcggagttgaattcgctactcgaagcattcgtgtggatgataaagttgttaaggctcagatttgggatactgctggtcaggaaaggtaccgtgcaattacaagtgcatactaccgaggtgcagttggcgcattgcttgtttacgatgtcacacgacacgtcacttttgagaacgtagaaaggtggctaaaagagctccgggatcatacagattccaacattgtcataatgctcgtgggaaataaagccgatttgcgtcatttacgggccgtacaaactgaagatgccacatcatttgccgaaaaggagcacacttacttcatggaaacctctgcgcttgaatcactgaatgtagaaagtgctttcacggaagttcttacgcaaatctatcaaattgtcagcagaaaagcacttgaatctggtgatgatgcggctgcggtacctaaagggcagacgattaatgtcgatgatgtatcggcggtgaagaaaggcggatgttgttcttcgtagatggaaaaaagatgggtgttttttgggtgactttggtcaatggttggaatttgggtataaatcatagttttattgtttatcaata

SEQ ID NO: 3387 - DNA, 1283 bp, Podocarpus macrophillus
caaattatggtctaagaggccaagtgtactgttccagagagcaggtgttcgaatcgcagggaatttcttgtatttatttctagggcagttttcttctccaaagtgtgcagtgaagaatccgcaatggcctacagagcagatgatgactatgactacctgttcaaggtggtgctgattggggattctggggttggaaaatccaatctgctgtcgaggtttacaaggaatgaattcagcttggagtcgaaatccaccattggagtagagtttgcgacgaggagcattaccgtggatgataaggtcatcaaggcccagatatgggacacagctgggcaagaaaggtaccgggccataacaagtgcttattaccgaggtgctgttggtgcattgttagtttatgatgtcaccagacatgttacttttgagaatgtggagagatggcttaaagagctgagagaccacactgatgccaatattgtgataatgcttgttggcaacaaggcagatctgcgccatcttagagctgtttctacagaggatggcaaggcatttgcagaacgagaatcactgtattttatggagacatcagccctggaatcaacaaatgttgaagcagcattcacagaagtacttagccagatttatcggattgtgagtaagaaagctcttgatgttggggaagacccagcatctgtacccagcaaaggacagacgataaatgttaacagcaaggaagatgtgtcggccttgaagaaggttggatgttgttctggataggtggagagtgcactagttacataatgctgtgttccaatgattcctagatttcagtgttattttgtcaacaaattgttttctcaacatttctgccctggttgcctgtcagttttaagagacaagcagcttcccatgtttgattctctgtatgatttatcagtgaacttttcgctctgggatgcacccaaagagcattttctgtcgtatagcttttgttgttactatatgttaggcaaactcttagatttttggaatgttgctatcttggtagtctgtggcaaatgtttgatttaactgtatttgtaatatatagattaaactgcaacatcatgttcaggccggagattacaattactatttcttctagatattaagcctttgtcacattgagtacacgcaagttgcttttgttttgcatcctttattgtcttgttaaatctcttggaatagagatcttcattaatataacctctttggtgcttaagtgaactatattgatgatgtta

SEQ ID NO: 3388 - DNA, 1102 bp, Fagus grandifolia
tgagtttgtattgcaacgtatacgtttctgtttcgagtttcgactctttttctttttccttcccagattcattcatttgaagctcgtgtccgcctctctctctctctcttaatatataataatattgatccgagttccgagagagtctctatggcggcgtacagagcagaagatgactacgactacctcttcaagttggtactcataggtgactccggtgtcggcaaatccaacctcttgtctcgcttcaaccaaaaacgagttcagcctcgagtccaagtccaccatcggtgtcgaattcgccacccgcaccatccgcgtcgatgacaacattgtcaaggcccagatttgggacactgctggccaagaaaggtacagagcaataactagtgcatactaccgcggagctgtgggtgcattgcttgtctatgatgtcacccgtcatgtcacgtttgagaacgtcgagagatggttgaaggagctacgggatcacacagactccaatatcgtgataatgattgtcggtaacaaggccgacctccgccacttgcgtgctgtatccactgaggatgctaccgcctttgctgaaagagagcacacttacttcatggagacatctgcccttgagtctttgaatgttgagaatgcattcacagaagtcctagcccaaatatatcgagtggtcagccggaaggcgcttgatattggggatgatcctgcagccttgcctaaaggtcaaaacataaatgtaggatccaaggatgatgtttcagctgttaagaaagttggttgctgctctgtataatcattaagagtgatatcaagggtctcttcgaatttcactgccccagaaatctgaggatttctacctgcaactaattaattttctcaccaccatttcactgttatggtggtgcttgagcttgagcttgactcaaggtttgcagtccaaagaaatgccacatatttacttttgtccctgcctctggtatattgtttcaatttatagcaatttttgtataacagtgtcttaaagatagaggttagagtatatttaatgttacattaaatgatgtttatatattaagaaaacatattaaat

SEQ ID NO: 3389 - DNA, 981 bp, Artemisia annua
caattccaaaccatcctctttccttattcatttaatcattttttatatatattttagattcacaactaatttccctagattcaatatacaaataatggcgtataaagcagacgatgattacgattatttattcaaagtggttctgatcggtgattcaggtgtaggtaaatcgaatctgttatcgaggttcactagaaatgagttcagccttgaatctaagtcaactattggcgttgaattcgctaccagaagtattaaagttgatgataaaactatcaaggctcagatttgggatactgctggccaagaaaggtaccgtgcaatcacgagtgcatactacagaggagctgttggtgctttgctagtctatgacacaacacgccatgtgaccttcgaaaacgttgagaggtggttaaaagagctcagagaccacagcgactctaacattgtgataatgctagtaggaaacaaggcagacttgcgtcacttacgtgcagttacaacagaagatgccaaaacctatgctgaaaaggaaaagacctattttattgaaacatcggctttggaagccctcaatgttgaaaatgctttcactgaagtacttacccaaatataccatgttgtaagcaaaaaagcacttgacattgggaacgatactggtgcattgcctaaaggtcaaaccattaacattgggtcaaaagatgatgtttctgcagtgaagaaagctggttgctgttctacttaaaaacaatagcagattatcagattgtttttgagcaaatctgaagtctttaacaagaaaagtagatcaggctactggttttactcacattttttctggtctttttgtatttttattattattattattattatttttaattattaactgcagtggatcatgtatcatatatttggttgcctgtttttagaatttgaatcaattttcatttttgacattagatcgaagtaaaatgtgac

SEQ ID NO: 3390 - DNA, 1232 bp, Gnetum gnemon
ctggcacttgcaaaacagcgaagagggggagtaagagcgctacaaatacacagcagtagcgcaattacaggcgcgcattcgttgtctgtgatcgcacagaagaacggccgcgtatagttgacgagcagaataagaagagaagaaaaaggaaaaaacgaatcctgcataaggatcttgtgtttctagtaaaacacagaacagagcagagttttcgttttttatttccgttttccgtttccatggcgggctatcgcgcggacgaggactacgattacctgtttaaggttgttcttatcggtgactcgggcgtcggcaaatcgaatcttttatcgaggttcaccagaaacgagttcagcctggagtccaagtccaccatcggcgtcgagttcgccacgcgctccattaacgtcgacgacaaagtcatcaaagctcagatttgggacaccgcaggccaggaaagataccgggcaataacgagtgcatattatcgtggagcagttggtgccctcttggtctatgatgttaccaggcaagtgacctttgaaaatgtggaaagatggttaaaggaacttagaggtcacacagatgcaaatattgttataatgcttgttggtaataaggctgatcttcgacatctgagagctgtttctgttgaggatgggaaggcatttgctgaaaaggaaaatctattcttcatggagacttcggccctggaatcaacaaatgttgagaacgcatttacagaagtgctttcccagatttaccggattgtaagcaagaaggctcttgatgttggggaagacgcagctgcagttcctggaaaaggacagacaatcagtgttggcaacaaagatgatgttacagcaatgaagaaagttggttgttgttctgtatagcttaccatgtgttttcagttatcctatggtctcaagtttttgttcttgttcatggattaatccttcagaaattgattcgaggaatcatttgtggcatgggagctcgcttttttaaaaagcaccttgctatacccaccttgcggttattttaagactatcatggattgcattttaagcatgatgtttgtttttattctttttgtagtctttttgttgtttttttctgtgaaaatacattggaacatcctgagatcttttattttggtcctatttttgtaactgtcaaatgtgtagccgtttaagcatctggaaagaggaacaattcaggaagatttt

SEQ ID NO: 3391 - DNA, 1203 bp, Orobanche aegyptiaca
catcattacgcctaccatgaatttctcgggaaataatacttgattctctttcttttattagcgcgtttccattttgccataacccaaagtaaaaaagaaaaatataaagaaaatcttcctctggaatacgtatataactacgtatctgtgcataaagtattagcacagtttgaagatggcaggggggtatagagcggacgacgactacgactatctcttcaagttggtcctgatcggcgactctggtgtcggaaaatcgaatttgctttccagatttgctcgagatgagttcagcttagagtccaaatctactataggagttgaattcgcgacgcgcagcattcacgtcgatgataagatcgtcaaggctcagatttgggataccgctgggcaagaaaggtaccgcgcaatcacgagtgcctactatcgcggggcggttggagcgttgctcgtctatgacgtcacccggcacgtcactttcgagaacgtcgagagatggttgaaagagcttcgggaccacacggaccagaatattgtcatcatgcttgtcggcaataaggcggatctacgtcaccttcgtgcggtctccaccgaggatggcgaagcttttgcccagaaggaaaaaacctatttcatggaaacatcggccctcgagtctatgaacgtgaaggatgccttcacggaagtactcacgcaaatttatcatatagtttgccgtaaagcccttgatataggcgacgacccttccactttgccgaaaggacaaaccataaatgtcgggaataaagatgaggtttcggctgtgaaaaaagtaggctgttgttccgtatgattctcgaaagaactttaatgccgactgggcgtactgggacaggatgcattggttcttgatggtgagttaaatcggctttgttttttggagctaaagacattcgtgaatgaatgtcggtatcttcgaattttaactagcccttttttttggtttttttcttcatttagctttcctatattcgtattgcttcggttatttgactttggaatttcttgtgttgtattatgttgcatttataagttttattccgcgacatttaatttttaacgtctgttggacgtctaagaatggtataaaaatacgatgatttgatgttcagaagtgtgcatgtagatcctatgtgatatctacattgttaaattaggattgaa

SEQ ID NO: 3392 - DNA, 1068 bp, Solanum tuberosum
agcagcaacaacctttttttcttagagctctcaactatccccttaagtaaaccaaatagttaatttgttgaattaatcgcagatggcaggtggatatagagctgaggatgattacgattatctgttcaagttggtgctaattggagattctggtgtcggaaaatccaatctcctttctcgattctccagaaacgagttcaatcttgaatccaagtctactattggcgttgaattcgctacccgtagcattaaggtcgatgataagatcgtcaaggcccagatttgggatactgctggacaagaaaggtaccgtgcaattacaagtgcatactacagaggggctgtcggtgcattggttgtgtacgatatcactcgacatgtcacatttgaaaatgttgagagatggttaaaagaacttcgagaccataccgaccaaaatatagtcataatgctcgttgggaacaaggctgacttacgtcacttgcgtgctgtttcaacagaggacgccaaggcctttgctgaaagagagagtaccttctatatggagacttcagcacttgaatccttgaatgttgagaatgcgtttacagaagtattgaccgagatatacagggttgtctgtcggaaagcactcgaagttggggacgatcctactgcattgccaaaggggcagactataaatgttggcaaggatgatgtttcagctgtgaaaaaagttggttgctgctctgtctaagctaaaaaaatcaagaaatcagtgaagttaagctttcaaatggcttctcctatagttgcattgagtattctcagttttgaatatcttaggaaatattcctcctctgtattgtttcattaacttacctttagtttgtaccctattttgctagtcttttgactctttgaaaagatttttactattatttatatactttttaccatttatactttttaacacacaaaaacaaaaaactcgaggggggggccccggttaccccaattcgcccttatagtgaagtcgtattaagcgcggctcactggcccgtcgtttttacaaccttctggacctgg

SEQ ID NO: 3393 - DNA, 1018 bp, Solanum lycopersicum
accagaagcaacaattttatttgttttccttcttagaactctcagctatctccttaagtaaaccaaaatagttgattttgttgaattaatcgcagatggcaggtgggtatagagctgaggatgattacgattatctgttcaagttggtgttaattggagattctggtgtaggaaaatccaatctcctttctcgattctcaagaaacgagttcaatcttgaatcaaagtctactattggtgttgaatttgctacccgtagcattaaggtagatgataagatcgttaaggctcagatttgggatactgctggacaagaaaggtatcgtgcaattacaagtgcatactacagaggggctgtcggtgcattagttgtctacgatatcactcgacatgtcacatttgaaaatgttgagagatggttaaaagaacttcgagaccataccgaccaaaatatagtcataatgctcgttgggaacaaggccgacttacgtcacttgcgtgctgtttcaacagaggatgccaaggcctttgctgaaagagagagtaccttctatatggagacttcagcacttgaatccttgaacgttgagaatgcgtttacagaagtattgacagagatatacagggtggtctgtcggaaagcactcgaagttggggatgatcctactgcgttgccgaaggggcaaactataaatgttggcaaggatgatgtttcagctgtgaaaaaagttggttgctgctctgtgtaagctaaaaaaatcaagaaatcggtgaagttaaactttcaaatggcttctcctatagttgcattgagtattctcagttttgaatatcttaggaaatattcacctctgtattgtttcattaacttacctttagtttgtactttgtaccctattttgctagtcttttgactctttgtaaaagagttttactattatttatatacttttacattatattattattttgtatgtttatggcatcttatgagtttaaatagagaaacatgatttgt

SEQ ID NO: 3394 - DNA, 1004 bp, Daucus carota
gttttgacaactaagaaaccaatctctccagctaatgatcaaaccccatcaacaaaagtaaatctataccaccacattgtacaccatttcaacataaattcacatttctgtgtcgaaaatgggtgcctatagagccgatgaggagtacgattacttgtttaagttggtgcttataggtgattctggagttggcaaatcaaacttgctgtcgagatttacgcgaaatgagtttagtttggagtccaagtctacgatcggagttgagtttgctacgcgaactattcatgttgatgataaggttgtcaaggctcaaatttgggacacggctggtcaagaaagatatcgtgcgatcacaagtgcttactatcgaggagccgttggtgctttactagtgtatgacgttacccgcaatgtgacatttgaaaatgttgaaagatggctgaaggaactcagggatcacacagatgccaacatcgtgatcatgctcgtcgggaacaaagcagacttgcgccacctgcgcgctgttcaaactgatgatgctaaatccttcgccgaacaggaacatactttcttcatggaaacatctgctctggagtctttgaatgttgaaaatgctttcactgaagttctaagtcagatctaccgcgttgtgagtaggaaggctcttgacatggccgaggacccaactgttttgcccaagggacagactattaatgttggtggcaaggatgatgtatccgccataaagaaaaccggatgttgctcttcttaggtcattgtccaatggttattgtctagcttcatttacaacccaagagaatgtgatccttgatagacactaaagaaggctgatttacaacccaagagaatgtgatttatgcaaagttttctgtagttaaaaacatgtttgagcctcaaaaagtaatttactattcttacactttccctcgcttatacgtttgtagagcattatgcgttttactatttgttatttattgctactt

SEQ ID NO: 3395 - DNA, 883 bp, Cichorium intybus
tcgttacacgatcatctaaatttatgcgatcggaataaatagaagaaaacttctatcatcatctaatatttgatcacttttctcgcatttctctgtttctcctaatcttcttcatcttctccatgaacacagtttcgatctccctttaaagaaatgggggggtttcatgcagatgatgattacgattacttgttcaaggttgttttgatcggggattcaggtgtcgggaaaaccaatcttttgtcgcgattctccaagaacgaattcagcctcgaatccaaatccaccatcggggttgaattcgccacccgtagcatcaacgtcgatgacaaggtcatcaaagcccaaatttgggataccgctggacaagaaaggtaccgagccataaccagcgcatactatcgaggcgcagtaggtgcattgatcgtatacgacatcacacgtcacgtaacgttcgaaaacgttgaaagatggctcaaggagcttcgagatcacactgatcaaaacattgtgattatgcttgtgggaaacaaagccgatctacgtcatttacgtgcagttcaaatggatgatgcaaaggcatttgcagaaagagagaataactttttcatggaaacatcggctcttgaatcgttaaacgtcgagaacgctttcaccgaagtgttgactcagatttatcatgtggtgagcaagaaggcgcttgatattggtaatgatccaatggttgtacccaagggacaaacgattaatgttggaggtaaagatgatgtatctgctgttaagaaagcagggtgttgctctaattaatgttttaggttgaataacatacgtatgttttgtgtagtgttaaggatttcatggtgaagaatatgtgaaatatttc

SEQ ID NO: 3396 - DNA, 1000 bp, Petroselinum crispum
attggtatttaattatatatttaggtttatagagggggcattgtaaggatggggacatttagagcagacgaggattatgattatttgtttaaggttgtgttgatcggagattcaggagtgggaaaatcgaatcttttatcaagattcacgcgtaatgagtttagtcttgaatccaagtctacaattggtgttgaatttgcaactcgtagcattactgttgatgataaggttattaaggctcagatttgggacactgctggtcaagaaaggtatcgtgcaatcacaagtgcttactatcggggagctgttggtgctctactagtttatgatgttacccgcaatgttacatttcaaaacgtggaaagatggttgaaggagctccgagatcacaccgatgccaacattgtgatcatgcttgtaggaaacaaagcagatttgcgccacttgcgtgctgtctcgacagaagatgcacaggcctttgctgaacgtgagagtaatttcttcatggaaacatcagctcttgagtcattaaatgttgagtctgcgttcacggaagtgctcactcaaatctatcgtgtagtaagtaggaaggcacttgaaatcggagaagatccaaccgttttgcccaagggccgaactatcaatgtcggaggcaaagatgacgtatctgctgtgaagaaaagtggatgctgttctgcgtgaagtcggaaataattttcaagaatcaaaaacccccccccccccccccccccgttcattatgatgttcatactaggttcatttaagattatttgaggctttctagagccaatatcctactcagtttcttgctgatgattgatgtgatttgcatgacaaaagatgccgttatacagatatttcatttgattttgactttccattcttattagtaatgtacttcatggttcgatacgctgttgtgggtttgattccagaactagtccaggcacttgagtacaatccaatgctctttattcat

SEQ ID NO: 3397 - DNA, 744 bp, Vicia sativa
cgattatctattcaaagtggttttgatcggtgattcaggtgttggtaaatcgaatcttctttccagattcacaaagaatgaattcagtcttgaatctaaatccaccattggcgttgaattcgctaccagaagcattcgtgttgatgataaggttgtcaaagctcagatttgggatactgccggtcaagaaaggtaccgagcaattacaagtgcttattatcgtggagctgttggcgctttattagtctatgatgttacccgccacgtaacatttgaaaacgtggagagatggctaaaagagctgagagatcacacagatgccaacattgtcgtgatgcttgtaggaaacaaagcagacttgcgtcacttgcgagcagtttcaacggaagattctacagcttttgctgaacgggagaatacatttttcatggagacatctgcccttgagtcattgaacgttgaaagtgccttcacagaagtgttgacgcagatataccgcgttgtaagcaagaaggcccttgagattggtgatgatccagcggctttacctaaaggacagacgattaatgttggttcccgcgatgatgtatcagctgtgaagaaaggtggatgttgttccgcttgagtatgttgtaaaagtctctgtatttttactcccaaatttatttcctgtttataccatgtagagattgaactgacagaatgaagatgattggttagacagcatcaaactaaaaagtttat

SEQ ID NO: 3398 - DNA, 826 bp, Musa acuminata
gtttcatttcccctgcgacaacccattcccacttcctccgagtcgaaggagagcgacggcgttggagaggtacgctgagccagacggagcgcggatctgatcgccggatagaagcggcggtggcggaggctgaggaatggcgtacaggtccgacgacgactatgactacctcttcaaggtggtgctcatcggcgactctggcgtcgggaagtctaacctcctctctcggttcacccgcaacgagttcagcctcgagtccaagtccaccatcggcgtcgagttcgccacccgcagcatccgcgtcgaggataaggtcgttaaggcccagatttgggataccgccggccaagaaagataccgagcaatcactagtgcttattatcgaggagcagtcggggcccttctggtctatgatgttactcggcatacgacatttgagaatgtggagagatggatgaaggagctaagggatcacactgattccagtattgtgattatgcttgtgggcaacaaagcggatttgcgccatctcagggctgtcacggtggaggactcaaaggcttttgccgagagggagaactccttctttatggagacatctgctctagaatcaaccaacgtggataatgccttcacagaagtactcacccagatatatcgtgtcacaagcaggaaggcgctcgatgctggtgatgatcccacaacgttgccaaagggtcaaaccatcaacatcggcacccatgatgatgtatctgctgttaagaaagctggttgttgttcagcgtagatcagatgtggagcaaaatatttgttatctttatttaag

SEQ ID NO: 3399 - DNA, 883 bp, Cichorium intybus
tcgttacacgatcatctaaatttatgcgatcggaataaatagaagaaaacttctatcatcatctaatatttgatcacttttctcgcatttctctgtttctcctaatcttcttcatcttctccatgaacacagtttcgatctccctttaaagaaatgggggggtttcatgcagatgatgattacgattacttgttcaaggttgttttgatcggggattcaggtgtcgggaaaaccaatcttttgtcgcgattctccaagaacgaattcagcctcgaatccaaatccaccatcggggttgaattcgccacccgtagcatcaacgtcgatgacaaggtcatcaaagcccaaatttgggataccgctggacaagaaaggtaccgagccataactagcgcatactaccgaggcgcagtaggtgcattgatcgtatacgacatcacacgtcacgtaacgttcgaaaacgttgaaagatggctcaaggagcttcgagatcacactgatcaaaacattgtgattatgcttgtgggaaacaaagccgatctacgtcatttacgtgcagttcaaatggatgatgcaaaggcatttgcagaaagagagaataactttttcatggaaacatcggctcttgaatcgttaaacgtcgagaacgctttcaccgaagtgttgactcagatttatcatgtggtgagcaagaaggcgcttgatattggtaatgatccaatggttgtacccaagggacaaacgattaatgttggaggtaaagatgatgtatctgctgttaagaaagcagggtgttgctctaattaatgttttaggttgaataacatacgtatgttttgtgtagtgttaaggatttcatggtgaagaatatgtgaaatatttc

SEQ ID NO: 3400 - DNA, 691 bp, Cucumis sativus
attcttgttgtgttcatcaaatgggtgcgtacagagccgatgatgattacgattatctgttcaaggtggtgctgattggggactccggcgtcggaaaatccaatctcttgtcgcgtttcaccagaaatgaattcagcctcgagaccaaatccaccatcggcgttgagttcgctactcgtagtattcgtgtcgatgataagatcgttaaggctcagatttgggacaccgccggccaagaaaggtacagagcaatcacgagtgcatactataggggagcagtaggggcgttaatagtgtacgacgttacacgacacgtgacattcgagaacgtagagagatggttgaaggagctaagaagtcacacagatcacaacatagtgataatgctcgtagggaacaaggcagatttaaggcacctaagagcagtatcaacagaagatgcacaagcatttgcagagagagagagaacatatttcatggaaacttcagcactagagtcattcaacgttgagaattcatttacagaagttctaacacaaacctaccgagttgtaagcaggaaaattcttgacattggagatgatccaactgttcttcctaagggacagaccattgacattggctctaaagatgatgtctctgctgttaagaaagctggttgttgttcttcataactataccaaaaatccct

SEQ ID NO: 3401 - DNA, 672 bp, Eucalyptus grandis
gatttgtggttttcgatggggacgtataggtcggatgacgactacgactatctgttcaaggtggtgttgatcggcgactccggtgttggcaaatccaacctgctctcgaggttttcgaggaatgagttcagcatggaatccaaatccacgatcggggtcgagtttgggactcgttgcattcgagtcgatgataaggtcgtcaaggcacagatttgggacaccgcaggccaagaaagataccgtgcgatcacaagtgcgtattatcgaggcgcagtgggtgctttactagtctatgatatcactcggcatgtcacgttcgagaatgtggagaggtggctaaaggaactccgagaccacacggaggccaacatcgtgatcatgctcgtcgggaacaaggcggacctgcgccatctccgtgccgtctccctcgacgatgccaaagcgttcgccgagcaagagcacaccttctttatggagacatctgcattggaggcgctcaatgtcgaaaatgccttcacggaagtgttgactcagatctaccgtgtggtgagcaggaaagctcttgacgtcggcgatgaccctgcagcactgccaaagggacagaccatcaacgtcgggaacagggacgatgtctcggctgtcaagaaggccggttgttgctcgtcatgagaa

SEQ ID NO: 3402 - DNA, 1207 bp, Flaveria ramosissima
gaggcgtcagcgcctcttagcttttgcatgaatcaaggggcaaactccattccgttctcaccatccatcaataatcaaatctctcaagtaatactcattacattgatttacatcctctaattgttgaatcgaagttcgctataatcgatcacaaccattgaatagtattgatggcggcgtatagagctgacgacgactacgattgcctcttcaaagtcgtcctcatcggcgactccggcgtcggaaaatccaatctgctttcgaggttcactcgcaacgagttcagccttgaatcgaagtcaacaatcggcgttgaattcgccaccagaagcattcgtgttgatgataagctcatcaaggcccagatttgggatactgcgggtcaagagaggtaccgtgcaatcaccagcgcatactaccgaggagctgttggtgcattgcttgtctacgacacaactcgccacgtcacctttgagaatgttggtagatggctaaaagagctcagagaccacagtgactcaaacatagtaataatgctagtaggaaacaaatcagatttacgccacttacgtgcagtgaccacagaggatgcaaaagcctttgctgaaaaagaaagcacttattttatggaaacatcagctctcgagtccatgaatgttgacagtgctttcactgaagtgcttacacaaatataccatgtggttagccgaaaagcccttgacatgggaggcgatcctgcagcattgcctaaaggtcaaaccattaatgttgggtcaaaagatgatgtttcagccatgaagaaagttggttgctgttctacttaacatagtagagaggttaatcaggttgtttttttagcagatctgaagccttaaagaagaaaagtaaatcagactactggtatcacttcaaattttcatggtgtttttgtatctgtttaatttgttaactgcagtggatcttgtattgtacatttgggtgtgtgttcttttagggtttgaagatctttgttttttaatctggatttgaacattactttggttttgtatcatcaagatgttacctgcaaaggcatgatcataaacagttaatttgcgcatgatgtttcttttgaacggtaccttgttgtattgatgtcttgttacttacaaagcacgtggtgtataattccttatatgacatgtaaataatactaggtttgtagtag

SEQ ID NO: 3403 - DNA, 810 bp, Mimulus guttatus
aaaaaaaaaaaaaaggatgggagcatacagaggggacgaggattatgattacctgttcaaggtggtcctgatcggagactccggcgtcggtaaatccaacctcctgtcccgtttcacgaagaacgagttcagccagcagtctaaatcaaccatcggcgttgagttcgccacccgttccattcaagttgacgacaaggtcgttaaagcccaaatttgggataccgccggccaagaaaggtaccgtgcaatcacaagtgcatactacaggggggcggtgggggcactactcgtgtacgacgtgacgcgtcacgtgacgttcgagaacgtggaaagatggcttaaggagctgcgggcccacacagacaacaacattgtaataatgctcgtcggaaacaaagcggatctccgtcaccttcgtgcgatcccgactcaagatgcaaaagagtttgcagaaaaggagaacacgtttttcatggaaacttcagctctcgaagccatgaatgtcgaaaacgccttcaccgaagtgctgacgcaaatctaccacgtcgtgagcagaaaggctctggaaataggggatgaccctgctactctgcccaagggccaaactattaatattggaagcagagacgatgtttctgcggttaagaaaaccgggtgctgctctggctaaaaaccgagctcgacacgattacaaggttgtatatcatatcgtatatcataggaaactatcgaatattgtttgatgttgagttatttatatcataacattatgtatatgatgaaaccttgttacgtgactccatacgaaaa

SEQ ID NO: 3404 - DNA, 1045 bp, Helianthus annuus
taatattccccattttcaacaacagatctgcaaactctttctcaaccactaccacagcaaatgggtgcatacagagcagacgatgattacgattacttgttcaaactagttctcatcggtgattccggtgtcggcaaatccaatctcctctccaggttcacccgaaacgagttcagtctcgagtctaagtcaaccatcggcgtcgaattcgccactcgcagcattaaagtcgatgaaaaggttgtcaaggcccagatttgggacactgctggccaggaacgttaccgtgcaatcacaagtgcatactaccgaggtgcagttggggcattgcttgtctacgatgtaacacgtcatgtgacctttgaaaatgtggaaaggtggctaaaggagcttcgtgaccatacagattccaacatcgtcatgatgcttgtaggaaacaaatccgatttacgtcacttacgcgctgtaacctccgaagatgccaaaacctttgctgaaaaagaaaacatgtatttcatggaaacatccgcacttgaatcatcaaacgttgaaaacgctttcaccgaagttcttactcaaatccatcaggttgttagccgaaaggctcttgatgccggagatgatcaggctgctttgccaaagggacagacaattaacgttggcagtaaggatgatgtgtcagcgttgaagaaagttggctgctgctctacttaacggtttcactcgctgtaagttttaactaattattacgtgaacatctagtacaaatcaccggtttaagcccgtttagcttaaactaaatgcggttataaggacatttctggaacgacacaattgagcaacatcatagtttagttgagtgaggaatgtggttttggcattccaaatgtatcaaagattctattgctattcatgtattgacagtattgttaattgtcggctggcatctgtgaacaaagggaatatttaccaatttctcaatgtcaatcttttactgatggttgtatgatttgtcattgttataataagtattgcttttgcttgt

SEQ ID NO: 3405 - DNA, 686 bp, Citrullus lanatus
caaacttttgatcaaatgggtgcgtacagagccgatgatgattatgattacctgttcaaggtggtgctgatcggcgattccggcgtgggaaaatcaaatctattgtcccgttttaccagaaatgaattcagccttgagaccaaatccaccattggcgttgaattcgccactcgcagcattcgtgtcgatgataagatcgtcaaggctcagatttgggacaccgccggccaagaaaggtaccgagcgatcacgagcgcatactacaggggagcggtaggggcattgatagtgtacgacgtgacacgacacgtaacattcgagaacgtggagagatggttgaaggagctaagaggacacacagatcacaacatagtgataatgctggtggggaacaaggcggatttacgccacctaagggcagtgtcaacggaagatgcacaagcatttgcagagagagagagaacatatttcatggaaacttcagcactagagtcattcaacgttgagaattctttcacagaagttctcacacaaacctaccgagtggtaagcaggaaaattctcgacattggagatgacccaactgttcttcccaagggacaaaccattgatattggctctaaagatgatgtctctgcagttaagaaggctggttgctgttcttcataactaaccaaaacatccct

SEQ ID NO: 3406 - DNA, 1025 bp, Zostera marina
tggcctttaattgttatgtaagtcgtcgtcgacgcctcattaagtgatatttgacaaaatctctcacttcgggtgtcaatcggaaatcagaaaccggaaactcccagaaatgacttacaggacggccgacgactacgactaccttttcaaggtggtcctcatcggagactctggtgtcgggaagtcaaatcttctttcacggtttacaaggaatgagttcagtctagagtccaaatcgacgattggtgtcgaattcgccaccaagagcatccaggttgaggaaaaggtcgtaaaggcccagatttgggatactgctggtcaggaaaggtaccgtgcaattactagtgcctattatcgaggagctgttggtgcacttcttgtttatgacgtaacgcgccatgatacatttgagaatgtggagagatggttgaatgagctaagagaccacaccgatgtcaacattgtgattatgcttgttgggaacaaagcagatctacgacatttgagagctgtcactgaagaagatgcaaaggattttgccgaaaaagagaatacgttcttcatggaaacatctgcccttgattccacaaacgtggaagatgcattcacagaagtcctcactcaaatctaccgtgttgtcagcaaaaaagctcttgaagttgtcgatgatcctacagctttgcccaagggacagaacatcaacgtcggcggcaaggatgatgtttctgaggtgaagaaagctggttgttgctcatcttagattagtggatatctgcatttgttttggtcacacttgttggttccacttccacatctcgcagaatctaccagcattcagtccttaagtcctcattgataaatactttgattatgtttggtgattggaattttgtttaacacaggtattttaaaattactttgtatttttcaggaattgtgtgataatgttttttcttaagacattggactgtgcttcacttgttatgtatatgtcttatattctaaactattttctgctctgtttg

SEQ ID NO: 3407 - DNA, 1124 bp, Taraxacum officinale
acatctcttcagacttcagcctcgagatgtgacggcgactctttgcgtctacatgaatcacgcctgctcgttgccgatcatccttgaagaattcaagacgtgaagtggtttacttgatactgattgttaaagcaaagctctcactgaatcattactaactgatggcgacgtatagagctgacgatgactacgattatctgttcaaagtcgttctgatcggagactccggtgtcggcaagtctaacttgctttccaggttcaccaggaacgagttcagtcttgaatctaagtcaacaatcggtgttgagttcgccaccagaagtattcgcgttgatgacaagatcatcaaggctcagatttgggatactgccggccaagaaaggtaccgtgcaatcacgagtgcgtactacagaggagcagttggtgctttgattgtttacgatacaacacgccatgtaaccttcgagaacgttgaaagatggttgaaagagcttcgagaccacagcgactcaaacatcgtgataatgctggtaggaaacaaggctgatttgcgtcacttacgtgcagtttccacagaagatgcaaaacatttgcagaaaaagagaagacgtattttatggagacgtcagctcttgaggccacgaatgtggaggattctttcaccgaagttcttacgcagatttatcatgtggtaagtcggaaagcacttgacattgggaatgatactggatcgttgcctaaagggcaaacgattaatgttggatcaaaagatgatgtttctgctgtgaagaaagttggttgctgttctaattgatgaaaatggtggaggatcaagaattttgaaggtttggatgatatttatcaggttagtttttgagcttttaacaagaaaagtagctccaactactagtattacttcaaattttcctggtctttttgtattatttgatttgttaactgcaatggatcatgtatttatatatattttggatacctgttcttaacatttgaaacgagtatcgtttttaacatcagatcgaagtgaatttggaaaaatgaaaaaagacaccggaagcgcgattttccccttacccatctgggcggggtttcacaccacaaatggt

SEQ ID NO: 3408 - DNA, 904 bp, Flaveria ramosissima
tccactaattcaatctcaatcttcaattacatactcaattttcgaagctaatttcaccttattgtacccaataatggccgcttacagagctgacgatgactacgattacctcttcaagttagttctcatcggagactccggtgtcggaaaatccaacttgctctcgaggttcgcgaagaacgagtttaacctcgaatcgaagtcaaccatcggcgtcgaattcgccaccagaagtattcgtgttgatgacaaaattgtcaaggctcagatttgggatactgctggtcaggagaggtaccgtgcgatcacaagcgcatactatagaggagctgttggagctttactcgtgtatgacacctcacgccacatcacctttgagaatgttgaacgatggttaaaagagcttcgtgaccacacagactcaaacattgtgataatgttggttggaaacaaggctgacttacgccacttgcgtgcagtccccactgaggaagcaaaaacatttgctgaaaaagaaaacacttatttcatggagacatcagctttggaggctttgaatgttgaaaccgcgtttacagaagtccttacgcaaatttatcatgtggttagccgaaaagcacttgatgcaggtgatgatccttcagctttgccgaaaggtcaaaccattaacgtggggtcaaaggacgatgtttctgctgttaagaagtcggttgctgctctgcgtaagaattgttttgtaggatttgagactagttttgagcctgcaagttcactgatatggtaattaaagttttaactttagttttgtattcttgaaacaagacaaggattgaatgagaatgatcttgttgggtctttgactgtattaataacatatgtgattttatatattcagacatgtttt

SEQ ID NO: 3409 - DNA, 1133 bp, Daucus carota
ttcaaagtcatcaagatttcaagttacaaaacactgtacataaatctacaaacaaatggctgcatacagagcagatgatgactatgattatctcttcaagctggttctaattggagattctggggtgggcaaatcgaatcttctgtctagatttaccaagaatgagtttagcctagagtctaaatcaaccattggtgttgaatttgctaccagaactatcaaggttgatgacaagattgtcaaggcccagatttgggacactgctggtcaagaaaggtaccgtgcaatcacaagtgcttactaccgtggggcagttggtgcattgcttgtgtatgatgttactcgtaatatcactttcgagaatgttgagagatggttaaaagagctcagagaccacacagatgccaatattgtgataatgctggtaggaaacaaagctgacttgcgtcacttgcgtgctgttccgaccgagaccggaaagtcctttgctgaaaaagaggagacgttctttatggagacgtcagcccttgaatctttgaatgttgaaagtgcattcacagaagttcttagccagatttatcatgtagtcagccgaaaagcacttgaggttggagatgatcctgtggcacttcctaaaggacaaacaatcaatgttggctccaaggatgatgtttcagcagtcaagaaaattggttgctgctctgcctaattacacagtatggcatcggtgagtgtttgatattggattttcaaaaccaaatccatttagcagctaaagctccttgacagcccccttagtttatctttccagtagttggaatggttaatgatattatgggtgcgtattgctgagtttgaagtctacataccttaggccacctcctcttgctacctttttctcttttttaaggattaattctcccgtctggttatagatgtagtttacattgtattctagcttactgctctagatttttgagtataggtctgaatttgtgattcgcagcctgtatctacgacattgagttgaattttggttttaactcttatagaatgatcaagtacccctaatgttcaattgtttcacattggtgtcttttgttcaaaaccccagtattttgccacactaccga

SEQ ID NO: 3410 - DNA, 829 bp, Ambrosia trifida
tattatctgcataacaaatgggtgcttacagagcagacgatgactacgattacctcttcaaactagtcctcatcggtgattccggtgtcggcaaatccaatctgttgtcaagattcactcgaaatgagttcagcctcgagtcaaagtcaaccattggagtcgaattcgctactcgtagcattcgagttgatgaaaaggttgtaaaggcacagatttgggacactgctggtcaagaacgataccgtgcgattacaagtgcatactaccgaggtgcagttggggcactgcttgtctatgatgtaacacgccatgtgacctttgagaatgtcgaaaggtggttaaaggagcttcgtgaccatacagattccagcattgtcatgatgctcgtaggaaacaaatctgatttacgccatttacgggccgtaacctctgaagatgccaaaacctttgctgaaaaagaaaatatgtatttcatggagacatctgcacttgaatcatcgaatgttgaaaacgctttcacagaagttcttactcaaatccatcaagttgttagcagaaaagctcttgatgctggagatgatcaggctgctttgccaaagggacagacgattaacgttggcaacaaggatgatgtctcagcattgaagaaagtaggctgttgctctacttaacagttccactctctgtaagttttaactaattatgacgtgaacattgagtacaaaacatacttaagcccgtttagcttaaactaaatgcggtgtaagggcatttcaggaactacacagttgagcaacatcatagtttagttgagtgaggaatgtggttt

SEQ ID NO: 3411 - DNA, 2763 bp, Brassica rapa
ttcatgtgcatgtgcgtctcttcttcttcttcttcgtctgtacgcgcggttacctgaaaaatctccgatctacaatggcggcgtatagagctgacgacgattacgatttcctctacaaggtggtcctgatcggagactccggcgtcggcaaatccaacctcctctctcgcttcacccgcaacgagttcagcctcgagtccaaatccacgatcggcgtcgagttcgccaccagaagcatccgcgtcgacgaaaaagtcgtcaaggctcagatttgggacaccgccggccaagaaaggtaccgagcgatcacgagcgcgtactaccgaggagccgtaggagcgttccttgtctacgacgttacgcggcgcgtgacgttcgagaacgtcgagaggtggctcaaggagctcagagaccacaccgacgccaacatcgtctgtatgctcgtcggcaacaaggctgacttgcgtcacctacgagccgtttcaaccgaagacgctacggcctttgcggagagagagaacactttcttcatggagacatcagcgctcgaagctttgaacgtcgaggacgctttcactcaagtgctttctcagatataccgcgtggcgagcaagaaagcgttggatgttggtggagacgatcatgctgcgttgcctaaagggcagagtattaacgttgggggtaaggatgatgtctctgaggtcaagaaggttggttgctgctcaagttgatgtgtttccttgtaatgttttgaatctatttttttttcacgttatcatattcaacaatctatgaacaaagaacataaaataaaaaacttcaggggccaaccaaagaaagcatgtacagtttttttttatagtcactaagccaatcttagctatagattgtaacacaagctaagtgcatttttttacagaacttggggctttgaaacttgccttgactctgtttctcttataataaaaaaaaaaaaaaacaaaaaccatataagttgttataacctttatcgttccttgttcttgtccatgaccagtgcctctgatttacagattgggcagatgttcttgatgaccaaccacttctccaagcatgctggatggtactcgtgcttgcagtccagcattgcgatcttatctcggttcttgtaggtttcctgtcagtaaataaaagcgagatgttaattagtaagattaacgtttgcataagcttggaggatgtagtcttggcttttacctggcatatggtgcaagaatctgtttctagatcggtagatggagcttcctccaggttgattctggtggatatgtaggttcttcttttcacaagatctttaacggtttcttctgataagccagtcttcactgttccaatatggtcgctcaaatcaagaagctcctgcgccatcacagtttagaatgttaatagttaattcattcattaaatatctatatatggtgaaagatttagccatgtggtagagagtaacggtggactcacctcatatgacatgtcctctatgtccaagcgcatgtcttgatgatcatcaacctcatcatcgtcgaagaactctccttccacgaaaaatgcatcttcctacacatattaacattaaaaaaaaagagttaatctataagagcaaaacactcttgagcaaactgacactagaagagggtattacataagcggggaatgctctaaggtgaggaggcagtccatagtgtctaagactcgctgcaggagaaaaaccatctcgaggatgttgccggttaatcctcagcccagttgattgaaccggccccacgtttctgtacggagcatcatgaatagtcatgggaacagtgtatgaggctgacgtcatgcgaggagggtataaggtgggaggaggaggaggaggtgccggatgatggctaaagtagttaggagtagggtacgcaaatggtacatcgtttctgctactagatgcttcatggaacctcggagcagcattacctaagagagatcaatcaagaataagatttataagaacttgcataaagataagtttatgtgcttagaataaaaaatattaccattaccatgcataaaaggtatagagggtggttggagccaatacgaagaggatgatgatccatcagacgtgttgttgtcattaacatgttggtcataccagattggggcaggaggtggaaaaggatagtttccttgagagtaaggaggatccattgtgactgctcctagtctgctcctcacacttcgctgatccattggttgtgggtaagcattagtagcatagtgtgggaatgccaaaggcgctgtctccggaggtggtgctggttcagtaagatactgatagtttccaggtataataacttcgtcgctctttctcttgtatccatggcccataaaatgtggattactctcatgacttccaagagctaagggatgagcatgaagaggctcgtaagggaggtagagatttggtggggttgacatggtaggaccaagattggaagcacgttgatgatgatggtgatgatgatggtgatgaggagggggaggaggaggatactgtggaagaccgttaagcatagagttgttgtcataaggctcttgcaagaaagtaggaacagggttcatgtgtggggtgtctggatgagaatgctgctccatgtcgaagccagtcactatatgtctctgtctcataatgctagttagttgcagaaacagcctcctgatatattaaattgtagaaaagatcag

SEQ ID NO: 3412 - DNA, 1096 bp, Musa acuminata
ccgaatctaggtgtcgtaccaagaaccctaacggcggcggcgacgacgacccgccacttcgtcgcctgagaccgagggaagggaggcggatgggtcgcggcatctgacctccggttggaggagttggaagcggtgttgatcctgctgcgaccatcgacagtggtggtagcggcggaatggcgtatagggcggatgacgaatacgactacctcttcaaggtggtgctaatcggggactccggggtcgggaaatcgaacctgctctcgcggttcacgcgggacgagtttagcctcgagtctaagtctaccattggcgtcgagttcgccacccgaagcattcgcgtcgaggacaaggtcatcaaggctcagatctgggacaccgccggtcaggagagatacagagcaatcacaagtgcatattatcgaggggcagttggtgcactggtcgtctatgatatcactcgtcatgtgacattcgagaacatagagagatggttgaaagaacttagggatcacactgataccaacattgcgatcatgctagtgggtaacaaggcagatttgcgtcatcttagggctgttagtattgaggacgcaaaagacttttctgagagggagaacaccttctttatggagacatctgctctggaatcaacaaacgtggaggatgcctttaccgaagtgctcacccagatctatcgcgtggtaagcaggaaggcacttgaagcaggcgatgatgattcagcagctttgccaaaggggcagacggtcaatgttggcagcaaggatgatgtatctgctgttaagaacaatggttgctgctcatcttaggtttcagacttgtggaaacaggaaagccatcgtgtgcttagtaacttgtttctatgttctgcggaacacaaagaaggtggttctcattggacatttgtctctagttaaggttttggattgtgttcaaagttgggctaaggattaggattgtagatttgcactgtcatttaacatcaccggaaacatcattttgttcagggcattgtattgctattaggtttgttcaactcaaggctcttttcatttactaattgtcttcattcaag

SEQ ID NO: 3413 - DNA, 905 bp, Solanum melongena
tttgttcttttcttgaattccaagtttttaagttaatttcttgaattagtagtagatggcaggtggatatagagctgaagatgattacgattatctgttcaagttggtgttaattggggattctggggttggaaaatccaatctcctttctcgattctccaggaacgagttcaatcttgaatctaagtctactattggggttgaatttgctacccgaagcattaaggtcgatgataagatcgtcaaagcccagatttgggatactgctggccaagaaaggtaccgtgcaattacaagtgcatactacagaggggctgtcggtgctttggttgtgtacgatatcactcgacatgtcacatttgaaaatgttgagagatggttaaaagagcttcgcgaccataccgaccaaaatatagtcataatgctcgtggggaacaaggccgacttacgtcacttgcgtgctgcttcaacagaggatgccaaggcctttgctgaaagggagagtaccttctttatggagacttcagcacttgaatccttgaatgttgagaatgcgtttaccgaagtattgtccgagatatacaaggtggtctgtcggaaagcactcgaagttggggatgatcctgctgcgttgccgaaggggcaaactataaatattggcaaggatgatgtttcagctgtgaaaaaagttggttgctgctctgtctaagcaccaaaaaatcaagaaatcagtgaagttaagcttctaaatggctcctcctatagttgagtattctcagttttgaaaatgttataggaaatgatgtctgtacttaaattattccattcagcctttattttgctagtcttttgactctttggaaactattatttatatgcatttacattatagtttaccttttttg

SEQ ID NO: 3414 - DNA, 676 bp, Eucalyptus grandis
gatttgtggttttcaatgggaacgtatcggtcggacgatgactatgactatctgttcaaggtggtgttgatcggtgactctggcgtcggcaaatccaacctgctctcgaggttttcgaggaatgagttcagcatggaatccaaatccacgatcggggtcgagttcgggactcgttgcattcgagtcgacaataaggtcatcaaggcgcagatttgggacactgcaggccaagaaagataccgtgcgatcacaagtgcgtattatcgaggtgcggtgggcgctttattagtctatgatatcactcggcatgtcacgtttgagaatgtggagaggtggctaaaggaactccgagaccataccgaggccaacatcgtgatcatgctcgttgggaacaaggcggacctgcgccatctccgtgcagtctcactcaatgatgccaaagcattcgccgagcaagagcacaccttcttcatggagacatctgcattggaggctttcaatgtcgagaacgccttcacggaagtgttgactcagatctaccgtgtggtcagcaggaaagctctcgacattggcgacgatcctgcagccctgccaaagggacagaccatcaacgtcgggaacagggacgatgtctcagccgtcaagaaggccggttgttgctcgtcatgagaaatca

SEQ ID NO: 3415 - DNA, 1099 bp, Solanum phureja
caacataacagggtaaatttcagaaatgtaagataacagaatctacgcagattttatcattgcctcgtcttcgtcaaatgaaccctttattgccaccaacctctctttagcagtagtagcagcaacaacctttttttcttagagctctcaactatccccttaagtaaaccaaatagttaatttgttgaattaatcgcagatggcaggtggatatagagctgaggatgattacgattatctgttcaagttggtgctaattggagattctggtgtcggaaaatccaatctcctttctcgattctccagaaacgagttcaatcttgaatcaaagtctactattggcgttgaattcgctacccgtagcattaaggtagatgataagatcgtcaaggcccagatttgggatactgctggacaagaaaggtaccgtgcaattacaagtgcatactacagaggggctgtcggtgcattggttgtgtacgatatcacccgacatgtcacatttgaaaatgttgagagatggttaaaagaacttcgagaccataccgaccaaaatatagtcataatgctcgttgggaacaaggccgacttacgtcacttgcgtgctgtttcaacagaggatgccaaggcctttgctgaaagagaaagtaccttctatatggaaacttcagcacttgaatccttgaatgttgagaatgcgtttacagaagtattgaccgagatatacagggtggtctgtcggaaagcactcgaagttggggatgatcctactacattgccaaaggggcagactataaatgttggcaaggatgatgtttcagctgtgaaaaaagttggttgctgctctgtctaagctaaaaaaatcaagaaatcagtgaagttaagctttcaaatggcttctcctatagtcgcattgattattctcagttttgaatatcttaggaaatattccacctctgtattgtttcattaacttacctttagtttgtaccctattttgctagtcttttgactctttgaaaagatttttactattatttatatacttttacattatatttttatttggtatgtttatggcatgagatgagtttaatgg

SEQ ID NO: 3416 - DNA, 3496 bp, Brassica oleracea
ctcttgaggtttatagataagtactacaatgcacccatagaccagttttcatggtatgagatttacgatttcgagcctagttcatggaagactcttgatgttactccacactggcgtatatatttggtcagcgtggcgcgtctctcaaaggtaacacttactggcctgcttcacaaagaaacacaaacgatgtgcttgacgatcacatcatctgtttcgattatacaagtgagagtttcggtcctcttctgcgtctcccgtttgacgctggtgatgatgacgatgtgactttatcatgtgttagagaagagaagcttgcggttttacttactcacaacgaagcaggtccactggagtttgatatatggattagtactaagattgaggccgacaagatgttgtggagcaagttcttgagagtggaaacggaaacgggattttttgctctggttaattgtgatagtttcttcattgacgaggagaagaaagtcgcaatgggttaccacagtacatttaatattgttggagaagttggatacttgaaaaagctggagctcgtagaacgtgcaggcggagacataggctactgtaggtcaaacgtgtgctcttatgttccaactctcgtgcaaatcaagcaacctgctgcaggaggaggtgaaaggaaacgacagagcgacttagaaaagcaacgatatgatcaaaatatgtcgagacttgccgctattgaaaatcgtagcagttgcttctcttttctactcttcttcatggcgtctttagcctctcatccctccaagaaactcaaaaacttctttctaattactttgctaaccactgccgcagtaacttcagaacaacagtgtcggaatttcaagtctatcataatcttcggcgattccatcaccgacaccggaaacttgctccacctctccgaccttaacaaccttcctcagtctgcgtttcctccgtacggagaaacctttttccacgtccccacaggtcgtttctccaatggccgtctcattatcgacttcatagctgaatttttaaggcttccttatgtgcctccttactttggatccccaaatgagagcttccagaaaggagttaatttcgctgtagcgggtgcaaccgcattggaacggagttttcttgagagcagaggaatccattatgcttacaccaatgttagtttaggagttcagcttaagagcttcaagaagagtttgccaaatatatgtggttcaccttcagattgtagagagatgattggagatgctttgattatcgttggagagatcggagggaatgattataactacggactcttggttggaaaaagcatcgaggagatcaaagaactggttccgctagtgatcagtactatatcttctgtgattacggagttggttcacatgggaggcagaacgatcatggtgcctacggacctcccaatcggatgctggacatcgtttttaacgcagtatcaaacatcaaaccaagaagaatacaatcctttaacaggatgcttgaactggctaaacgagtttgtagaacatcacaacaaagagcttcaagaagaactcaacagactccagaaactctaccctcatgttacaatcctatacgctgattactacaacgccttgttacatattttccaagaaccggccagattcgggttcgtgaatcgacctttgtcagcttgctgtggaacaggaggtccatacaacttcaacaatggtagtcagtgtggaactaaaggagttgattgttgtactgatccttctaagtatgtgcattgggacggttttcatttgaccgagtctgcgtatagatgggtcgccatgggattactggagggaccctacacgcttcctgctttcgactggtcatgcccgggctttgatattaagaacagaacatcatcaggcagacagtattcttttaccactaggtgatggatgatacaagtttgttcacaaagcctttgtgagagaattaagttggtgaggaataagagttttttttttccctcctaatgtgtttgtctctacttaagttgaaaaactagagtgtaagggaggaagggaatggaagggagcttacaatattggtttagaactagagtgtaagtagttctttggtagaaaccatgattaaggactagtaaaattttgataatgtctagatgtaaaaagacttttttgatgaataaaatttaacattcattcaaaaaaaaaaaaaaaaagttgaaaaaatgaactgtttgcacttgcggaacaaactgataaaaggtttcaaactgaaacgtttttttaaaataaatagtatcagcaacttgaccgagccgaattgaagtgaaatttctcaatccagaaacaaaccggttttgaattctaaaccaaaccaaaaacaagaaactcaatttcttggccgagcgacatttgcgagttctgagtggtacctctcattgtcttcccaaattcaaaactcaaattggtgatctctccaatttagaaaacgttaaaaccaacagaaaccaaaacaaatatttttagaaccaaacaagaaaaaaacacattgagtagcatcatcccatgttcttggaacagccaaataacatttttattcttgaatataacttgtctccctacaacaaaagaggtttaagtaggtggacaaaagaagatgggagcatatagagcagaagacgattacgactacctcttcaaggtggtcttaaccggagactccggggtcggaaaatctaacctgttatctcgtttcaccagaaacgacttcagccacgactcacgcgcaaccatcggtgtagaattcgccacacgtagcatcaaatgcgatgacaaaatcgtcaaagctcaaatctgggacacggccggccaagaaaggtaccgagccatcacgagcgcttactaccgaggagccgtcggtgcgttactagtttacgacgtgacgcgtcacgtaacgttcgagaacgttgagaggtggctaaaggagctaagggaccacacagacgcaaacattgtgataatgctcgttggcaacaaagctgatcttcgtcatcttagagctatctcaacggaagacgcaaaggcctttgcggagagggagaacacttttttcatggagacgtctgcacttgaagctctgaacgttgagaatgctttcaccgaagttttgactcagatttacagagttgttagcaagaaggctcttgaagctggagatgatccaaccacggctttgcctaaaggacagacgattaatgtcggaggcagagatgatatctcagctgttaaaaaacctggttgctgctctgcttagacacacacacttgtctctctctctgtctttcttgtattttcattttaactaattatcatgcaaatttgtatacattcttgtaattatcagagaaacaaagttcatactcagtgaggacgtgatagactaggcccagggccgccggattcgg

SEQ ID NO: 3417 - DNA, 902 bp, Ambrosia trifida
tattccccattctcaacatacatacagatctacaatatctctcccctttcaccacattgctacccaaatgggtgcttacagatcagacgatgactacgattacctcttcaaactagtcctcatcggtgattccggtgtcggcaaatccaatctgctctcaagattcacacgaaacgagttcagcctcgagtcaaagtcaaccattggagtcgaattcgctactcgcagcattcgagttgatgaaaaggtcgtaaaggcacagatttgggacactgctggtcaagaacgataccgtgcgattacaagtgcatactaccgaggtgcagttggggcattgcttgtctatgatgtaacacgccatgtgacctttgagaatgtggaaaggtggttaaaggagcttcgtgaccatacagattccagtattgtcatgatgcttgtaggaaacaaatctgatttacgccatttacgggctgtaacctctgaagatgccaaaacctttgctgaaaaagaaaacatgtatttcatggaaacatctgcacttgaatcatcaaacgttgaaaacgctttcacagaagttcttactcaaatccatcaagttgttagcagaaagctcttgacgctggagatgatcaggcggctttgccaaagggacagacgattaatgttggcaacaaggatgatgtctcagcattgaagaaagtaggactgttgctctacttaacaattccaactctactgtaagttttaactaattatgacgtgaacgttgagtacaaatcatacttaagcccgtttagacttaaactaaatagacgggtataagggacatttcgggaactacacagttgagcaacatcatagtttagttgagtgcggaatgtggttttggcattccgaatgta

SEQ ID NO: 3418 - DNA, 1026 bp, Flaveria ramosissima
ccacattgctgctaaaacccccaaattatcatcttcaatcgcatagcaaatgggctcttacaaagcagacgatgattacgattacttgttcaactagttctcatcggtgattccggcgtcggcaaatccaatctgctatcgaggttcactagaaatgagttcagcctcgagtcgaaatcaactatcggcgtcgaattcgccactcgtagcattcgaatcgatgataaagttgtcaaggctcagatttgggataccgctggtcaggaacgataccgtgcaattacaagtgcatactatcgaggtgcagttggtgcattactggtctatgatgtaacacgccatgtcacctttgagaatgtggagaggtggttaaaggagcttcgtgaccataccgactccaatattgtcatcatgcttgtgggaaacaaatctgatttacgccacctacgggctgtaacctctgaagatgccaaaacgtttgctgaaaaagaaaacatgtatttcatggaaacatctgcgcttgaatcatcaaatgttgaaaacgcattcacagaagttcttactcaaatccatcaagttgttagtagaaaagctctggatgttggagatgattcagctgctttgccaaagggacagacgattaacgttggcaacaaggacgatgtgtcagcattgaagaaagtaggctgctgttctacttagataaaacatgagtttcatccttggtaagttttaactaatactatgtgaacattttctttatcaatacaaatcatagtttaagcgtgtttagctcaaactaaatatgggtattagggcatatcaggaacaccacaattaagttgagcccaaactgtgacggaaggattgatgtcgatgttttgattgttactgttacagttgtggtcgagcaagcatgtagtttaggtgaatatttgagtgatgaatgtccttttggcattcaaatgtatcaaagattctattgctattcatgtactttagttgtcagttggcatctgtgaacaa

SEQ ID NO: 3419 - DNA, 859 bp, Musa acuminata
tcgctgtctcgctcgctcatctcctgagcccggcgctgatgccaagaaccctagcggcgacgacgaagagccgccaccgccactccttccattgagtcgggagaaagggcggcggaaggagcacgtgcctcatctccggcgtcgaggcgtcggaatcagtgctgttggtgttggaggttgaatggcgtataaggcggaggacgactacgactacctcttcaaggtggtgctgatcggggactccggcgtcgggaaatcgaacctcctctcgcggttcaccaggaacgagttcagcctcgagtccaagtccaccattggcgtcgagttcgccacacgaactattcgcgtcgatgagaaggtcgtcaaggcccagatttgggacacagccggccaggagagataccgggcaatcacaagtgcatattatcgaggagcagttggtgcactggttgtgtatgatataactcgtcatgtaacattcgagagcgtagaaagatggttgaaggagcttagggagcatactgattccagcaccataatcatgctcgttgggaacaaggcagatttgcgccatcttagggcagttagcactgaggatgcaaaggattttgctgagagggaaaactccttcttcatggagacatctgctctggagtcgatgaatgtggagaatgccttcagcgaagtgcttacccagatacatcatgtggtgtgcaagaaggcacttgaagctggtaatgatcctgcagctctgccaaaggggcagacgatcaatattggctccaaggatgatgtatctgctgtcaagaaagctggttgctgctcggcctaggttcggaggtgacgtcaacgttttgat

SEQ ID NO: 3420 - DNA, 1186 bp, Musa acuminata
cgctctcctcgtttattgatctctctctctctctctctctctacatgggcgtgtcgagtgggcacgcaccaccttcccattcgatctcttagtctcacaaatatcgaacttgggagagaggaggaggaggagggagagggaggtgggtgtcgtaatggcgtacagggcggacgaggagtacgattacctgttcaaggtggtgctgatcggggactccggggtgggcaagtccaacctgctctcccgcttcgcccgcaacgagttcagcatcgagtccaagtccaccatcggggtcgagttcgccacccgcaccgtccacgtcgacgacaaggtcgtcaaggcccagatctgggacaccgccggccaagaacggtatcgtgccatcacaagtgcatattatagaggagctgtcggtgcactcgtcgtctatgatgtgactcgccatgccacttttgagaatgtggagaggtggttgaaggagctacggagtcatacagaccccagcattgtggtaatgctggtgggcaacaaggctgacttgcgtcacctgagggctgtctccctggaggacgctgaggtctttgctgagaaggagaaaaccttcttcatggagacatctgccttggagtcactgaatgtggagaatgcatttacagaagtgctatcacagatatatcgagtaacaagcaaaaaagcccttgatgttggcgacgatgctgcagtattgccgaagggacagaccatcaatatgggaggaaaagatgatgtatcagctgttaagaaacgtggctgctgctcaacttagctttcttctttggcattcttgcatggggttgccttttgcaaatttccaagtacttctctcttgaagacaaactccaagaaaatttagcatcacctgcacttccatagctagtatcagtatggctttttatacgagtggtcatcgttccagagtgcagactgcaagatttcttctcacttttatatatggcttgaactcaaactggattttgttagcaagagtgcagactgcaagatttcttctcacttttatatatggcttgaactcgaactggattttgttagcaagtgtttgttgcaaccgatgtatcgcactatgcaatcaggaatgctattttgttatatcagtgattgctcagttgttcttcccttaacctcataa

SEQ ID NO: 3421 - DNA, 836 bp, Daucus carota
tgggggcgtatagagcagacgatgattacgattacttgtttaagatagtgttgataggagactcgggcgtgggaaaatcgaacctgctttctaggtttactcgtaatgagttcagtctggagtcgaaatccacgattggggtggagttcgccactcgcagtattaccgtggaggataaagtcatcaaagctcagatttgggacactgctggtcaagaaagataccgtgcaatcacaagtgcatactatcgaggagccgtcggggcattgcttgtatatgatgtcacgcgaaatgtcacatttgagaatgtagagagatggctcaaagagctccgcaatcacacagattccagcatcgtcatcatgcttgtggggaacaaggccgatctgcgtcatttgcgtgctgtctccactgaagatgctatggcgtttgctgagaatgaaggtaccttttttatggaaacctctgctctggaatccatgaatgttgaagatgcctttacagaagtgcttactcagatacatcaagttgtgagcaaaaaagctcttgaagtaggaaatgatccagcagctgtgccgaaaggacagacaattaatgttaatgatgacgtgtcagcagtgaaaaaagctggatgttgcgctgcttagaatatggtaaattgatatgtgcactaactttccaatattcagtattatcttatgtttctgcggctgaacctttccatatcaatcatggtttagccttgcataccggttccggtcaacaaatctagagtttttggctgaattaaaagcttgaagttcactggtattcaaatatgtaggtgtggtctggga

SEQ ID NO: 3422 - DNA, 1010 bp, Phalaenopsis aphrodite
tgatgacggagaaggttgagataaacgatcgatcagctgaatagaggaggcggaagcgggttcaccggcggtgggttgacgcggcatcgacggaggtgttggaagattttgagtcatggcttacaggtccgatgacgaatatgattacttgttcaaggtggtgttgatcggcgattccggagtagggaaatcgaatcttctgtctagatttacccggaacgagttcaatctggagtcgaaatcgaccattggcgtcgagttcgcgacgcggagcattcgcgtggaagagaaggttgtgaaggctcagatttgggacactgctggtcaggaaaggtaccgcgcaatcacaagcgcatactaccgcggagccgtgggcgccctcctcgtctacgacataactcgccatataacattcgagaacgtcgagagatggctgaaagagctcagagaccacacaaaccctaacatcgtcatcatgctcgtcggaaacaaagccgatctgcgccatcttcgagccgtctcgaccgaagatgcgaaagcttttgcagagagggagagcactttcttcatggaaacatcagccctagaatcaatgaatgtcgagatcgccttcaccgaagtcctctcgcagatctaccgcgtcgtcagtcgtaaagctctcgacgtcggcgacgacccgtcggcgccgccgaggggacagacgatcaatgtcggcaacagagacgatgtgtccgatttgaagaaagttgggtgttgctccgcctaatttggagagatcagtaggttcgtatatgattactccaaaagtaatagctttttttttgctgctgcttctgcaaatatttattttggtttgagcatttgttggggtgagttaagccgtagggttctagttttgattgttatatgcatatatgaatggtgtcatgctgtttaataatttattgcttttacataggagcagcaatgttttatgttttgcctttttttttttttttgcataattcaat

SEQ ID NO: 3423 - DNA, 750 bp, Silene vulgaris
tcaaccccagatagtgaaaccctagaaatcaaaattcacaaaaatggcgtatagaacggacgacgattacgattacttgttcaaagtagtaataatcggcgattctggtgtcgggaaatcgaatcttctttctcgattcacacgtaatgagtttagtcttgaatcaaaatccacaattggggttgaatttgcgacgcgtagtattcatgttgatgataagatcgtcaaagctcaaatttgggatactgctggtcaagaaaggtaccgtgcgatcaccagtgcgtactacagaggggcagtaggtgccttactagtctatgatgtcacgaggcatatcacatttgagaatatcgagaggtggttgaaggaattgcgtgatcacacagacaacagtattgtaataatgcttgtcgggaacaaggcagatttgcggcatctacgtgctgttcaaaccgaagatgccaagggctttgccgagaaagagaatctgtttttcacggagacgtcagccctcgagtctttgaatgttgagaatgcattcaaagaggtcttgactcaaatatatcatgttgtcagccgaaaagcacttgatatgggaggcgactcgtctgctttgccaaagggtgaaaccattaatattggaaaggatgatgtttcagaggtgaagaaggttggttgttgttctgcctaattctttgttcgttatttgtttgtttatgtttttggcaatcctaaagaaccaacgttaca

SEQ ID NO: 3424 - DNA, 1186 bp, Brassica oleracea
cgataaatgaaaatttaaaatatccgacccgatgataattgtatccgacccggatccgatccgtcaacagtccgtagggcccaaaatttaaatctcactctctctctctgcgtctcttcccctttcgtaccagaaaaatctccgatcgaagaaacctcttcacaatggcggcgtacagagctgacgacgattacgatttcctctacaaggtggtcctgatcggagactccggcgtcggcaaatccaacctcctctctcgcttcacccgcaacgagttcagcctcgagtccaaatccacgatcggcgtcgagttcgccaccagaagcatccgcgtcgacgaaaaagtcgtcaaggctcagatttgggacaccgcaggtcaagaaaggtaccgagcgatcacgagcgcgtactaccgaggagccgtaggagcgttccttgtctacgacgttacgcggcgcgtcacgttcgagaacgtcgagaggtggctcaaggagctcagagaccacacggacgccaacatcgtctgtatgctcgtcggtaacaaggctgacttgcgtcacctacgagccgtttccaccgaagacgcaacggcctttgcggagagagagagcacgttcttcatggagacgtctgcgctcgaagctttgaacgtggaggacgctttcactcaagtgctttctcagatataccgcgtggcgagcaagaaggcgttggatgttggtggagacgatcacgctgcgttgccaaaagggcagagtattaacgttgggggtaaggatgatgtctctgaggtcaagaaggttggttgctgctcaagttgatgttttcttgtaatgttgtatctatttttttttgttcacgttatcatattcaacaatctatgaacaaagaaggtaaaataaaaacttcaggggccaaccaaagaaagcatgtacagttttttttttatagtcactaagccaatcttagctatagattgtaacacaagttaagtgcattttttttacagaacttggggctttgaaacttgccttgactctgtttctcttatataataataaaaaaacaaaaccatataagttataaccttttatcgttccttgttcttgtccatgaccagtgcctctgatttacagattgggcagacgttcttgatgaccaaccacttctccaagcatgctggatg

SEQ ID NO: 3425 - DNA, 913 bp, Brassica rapa
agaaccaaacaaaaaaaaacacattgagtagcatcatcccatgttcttggaacagccaaataacatttttattcttgaatataactcgtctcccgacaacaaactcataaaaacaaaagaggtttaagtaggtggacaaaagaagatgggagcatatagagcagaagacgattacgactacctcttcaaggtggtcttaaccggagactccggggtcggaaaatcaaacctgttatctcgtttcaccagaaatgacttcagccacgactcacgtgcaaccatcggtgtggagttcgccacacgtagcataaaatgcgatgacaagatcgtcaaagctcaaatctgggacacagccggccaagaaaggtaccgagccatcacgagcgcttactaccgaggagccgtcggtgcgttactagtttacgacgtgacgcgtcacgtaacgttcgagaacgttgagaggtggctaaaggagctaagggaccacacagacgcaaacattgtgataatgctcgttggcaacaaagctgatcttcgtcatcttagagctatctcaacggaagacgcaaaggcctttgcggagagggagaacacttttttcatggagacgtctgcacttgaagctctgaacgttgagaatgctttcaccgaagttttgactcagatttacagagttgttagcaagaaggctcttgaagctggagatgatccaaccacggctttgcctaaaggacagacgattaatgtcggaggcagagatgatatctcagctgttaaaaaacctggttgctgctctgcttagacacacacacttgtctctctctctgtctttcttgtattttcattttaactaattatcatgcaaatttgtatacattcttgtaattatcagagaaacaaagttcatactcag

SEQ ID NO: 3426 - DNA, 698 bp, Brassica napus
acgcgcggttacctgaaaaatctccgatctacaatggcggcgtatagagctgacgacgattacgatttcctctacaaggtggtcctgatcggagactccggcgtcggcaaatccaacctcctctctcgcttcacccgcaacgagttcagcctcgagtccaaatccacgatcggcgtcgagttcgccaccagaagcatccgcgtcgacgaaaaagtcgtcaaggctcagatttgggacaccgccggccaagaaaggtaccgagcgatcacgagcgcgtactaccgaggagccgtaggagcgttccttgtctacgacgttacgcggcgcgtgacgttcgagaacgtcgagagatggctcaaggagctcagagaccacaccgacgccaacattgtctgtatgctcgtcggcaacaaggctgatcttcgtcacctacgagctgtttccaccgaagacgctacggcctttgcggagagagagagcacgttcttcatggagacgtcagcgctcgaagctttgaacgttgaggacgctttcactcaagtgctttctcagatataccgcgtggcgagcaagaaggcgttggatgttggtggagacgatcatgctgcgttgcctaaggggcagagtattaacgttgggggtaaggatgatgtctctgaggtcaagaaggttggatgctgctcaagttgatgtgtttc

SEQ ID NO: 3427 - DNA, 1066 bp, Musa acuminata
aggtgtcgtaccaagaaccctaacggcggcggcggcgacgacgacccgccacttcgtcccctgagaccgagggaagggaggcggaggggtcgcggcatctgacctccggttggaggagttggaagcggtgttgatcctgctgcgaccatcgacagtggtggtagcggcggaatggcgtatagggcggatgacgaatacgactacctcttcaaggtggtgctaatcggggactccggggtcgggaaatcgaacctgctctcgcggttcacgcgggacgagtttagcctcgagtctaagtctaccattggcgtcgagttcgccacccgaagcattcgcgtcgaggacaaggtcatcaaggctcagatctgggacaccgccggtcaggagagatacagagcaatcacaagtgcatattatcgaggggcagttggtgcactggtcgtctatgatatcactcgtcatgtgacattcgagaacatagagagatggttgaaagaacttagggatcacaccgataccaacattgcgatcatgctagtgggtaacaaggcagatttgcgtcatcttagggctgttagtattgatgacgcaaaagatttttctgagagggagaacaccttctttatggagacatctgctctggaatcaacaaacgtggaggatgcctttaccgaagtgctcacccagatctatcgcgtggtaagcaggaaggcacttgaagcaggcgatgatgattcagcagctttgccaaaggggcagacggtcaatgttggcagcaaggatgatgtatctgctgttaagaacaatggttgctgctcatcttaggtttcagacttgtggaaacaggaaagccatcgtgtgcttagtaacttgtttctatgttctgcggaacacaaagaaggtggttctcattggaaatttgtctctagttatttaaggttttggattgtgttcaaagttgggctaaggattaggattgtagatttgcaatgtcatttaacaccgccggaaacatcattttgttcaggacattgtattgctattaggtttgttcaactcaaggctc

SEQ ID NO: 3428 - DNA, 773 bp, Daucus carota
tttatagtaaacacaaaccctgtgactctcatttctccaatattatcagcctcacctaccgctcataacacgtacttagtggcgtgctactaagtaaaaataattcccaagagctccgagacttgagttagtttaacttcaatggctgcgtatcgaggcgacgatgactatgattatttgtttaaggttgttatcattggtgactcaggtgtcggcaagtcgaatcttttgtcaagatttactaaaaatgagtttagcttggattcgaagtctactattggcgttgagtttgctactagaagtattcgtgtcgatgataaagtcgttaaggctcagatttgggacactgctggccaagaaagatatcgggcaattactagtgcatactatcgaggggcagtgggggctttgcttgtctacgatgttactcgacacgttacttttgagaatgttgagagatggttgaaagaattgagagaccacacggatgcaaatatcgtgataatgctggtaggcaataaggctgacttgcgtcacttgcgtgcagtttctactgaggatgcaaaggcttttgctgagagggagaaaacttacttcatggagacatccgctctggagtccatgaatgttgagaattctttcacagaagttctcagccaaatacatcatatagtcagccgaaaagcccttgaaatgggggatgatcctgctgcattacccaagggacagacgatcgctgttggttctaaagacgatgtttctgcagtgaaaaa

SEQ ID NO: 3429 - DNA, 972 bp, Ambrosia trifida
cgggactctctctagcagcaataatatagatctgtacaataacaataataatattccccattctcaacatacatacagatctacaatatctctctctcccctttcaccacattgctacccaaattatcctctgcataacaaatgggtgcttacagatcagacgatgactacgattacctcttcaaactagtcctcatcggtgattccggtgtcggcaaatccaatctcttgtcaagattcacacgaaacgagttcagcctcgagtcaaagtcaaccattggagtcgaattcgctactcgcagcattcgagttgatgaaaaggtcgtaaaggcacagatttgggacactgctggtcaagaacgatatcgtgcgattacaagtgcatactaccgaggtgcagttggggcattgcttgtctatgatgtaacacgccatgtgacctttgagaatgtggaaaggtggttaaaggagcttcgtgaccatacagattccagtattgtcatgatgcttgtaggaaacaaatctgatttacgccatttacgggctgtaacctctgaagatgccaaaacctttgctgaaaaagaaaacatgtatttcatggaaacatctgcacttgaatcatcaaacgttgaaaacgctttcacggaagttcttactcaaatccatcaagttgttagcagaaaagctcttgacgctggagatgatcaggcggctttgccaaagggccagacgattaatgttggcaacaaggacgatgtctcagcattgaagaaagtaggctgttgctctacttaacaattccactctctgtaagttttaactaattatgacgtgaacgttgagtacaaatcatacttaagcccgtttagcttaaactaaatgacgggtataagggcaatttcggtaactacacagttgagcaacatcatagtttagttgagtgcggaatgtggttttggcattccgaatgta

SEQ ID NO: 3430 - DNA, 1081 bp, Artemisia annua
gggggtgttttattatctaaatagcaaatcttgatattttcgaaacgcgtacgcgcctctctatttctctttatctcccaaatctcgtgaatcaatcaatcttatcaaacaaacagatactctttattcaacaacagatcttcagattcacataaaccctagaataaattcatcatcaatcagaatctgatattataaatggcggcttacagagccgacgatgactacgactacttgttcaagctagtcctgatcggcgactcgggcgttggcaaatcaaatctgctatctagatttgctaaaaatgagtttaatctagagtcaaagtcaaccattggcgttgaatttgctactagaagtattcgtgttgatgataaaattgttaaggctcagatttgggatactgctggccaagaaaggtaccgtgcaattactagtgcatactacagaggtgctgttggtgctttactcgtctacgacacatcacgtcacgtcacctttgaaaacgttgaaagatggttaaaagaacttcgagaccacactgaccaaaacattgtgataatgttggtaggaaacaaagccgatctacgccacttgcgtgcggtccccacggaggaagcaaaggcgtatgctgaaaaggaaaacacttactttatggaaacatcagctctcgaggcgttgaatgttgaaactgctttcactgaagtccttacacaaatatatcacgtggtaagccgtaaagcacttgatgcagggaatgacccttcggctcttcctaaaggacaaactatcaatgtgggatcaaaggatgatgtttctgctgtgaagaaaacgacttgctgttctgcttaagatgttctacattcgagatttgggacagttttcctgaagtacatttggaatggtggttctcgaaatgagtttgagtctcaaattcattgatacggtataaattcttgaactgaggatggtttgtgttggggtataacttataaaactatattaagtaacatatgtgatttctacgaattttttgtaatatctaagacaccattttgtcgacatttaatgactcactgaa

SEQ ID NO: 3431 - DNA, 959 bp, Artemisia annua
acgagtgcgtatcagaatctgatagataaatggcggcttacagagccgacgatgactacgactatttgttcaagctagtcctgatcggcgactcgggcgttggcaaatcaaatctgctatctcgatttgctaaaaatgagtttaatctagagtcaaagtcaaccattggcgttgaattcgctactagaagtattcgtgttgatgataaaattgttaaggctcagatttgggatactgctggtcaagaaaggtaccgtgcaattactagtgcatactacagaggtgctgttggtgctttactcgtctacgacacatcacgtcacgtcacctttgaaaacgttgaaagatggttaaaagaacttcgagaccacactgaccaaaacattgtgataatgttggtaggaaacaaagctgatctacgccacttgcgtgcggtccccacagaggaagcaaaggcgtatgctgaaaaggaaaacacttactttatggaaacatcagctctcgaggcgttgaatgttgaaactgctttcactgaagtccttacacaaatatatcacgtggtaagccgtaaagcacttgatgcagggaatgacccttcggctcttcctaaaggacaaactatcaatgtgggatcaaaggatgatgtttctgctgtgaagaaagcgacttgctgttctgcttaagatgttcttcattcgagatttgggacagttttcttgaagtaaatttggaatgatggttctggatatgagtttgagtctgcaaattcattgatacggtataaattcttgaactgaggatggctgtgttgggtataacttataaaactatattaagtaacatatgtgatttctacgaattttttgtaatatctaagacaccattttgtcgacctttaatgactcactgaattgttttatcgcctgttagcttcttcgtgttcaactacaactgtcttt

SEQ ID NO: 3432 - DNA, 833 bp, Musa acuminata
ctgtctcgctcgctcatctcctgagcccggcgctgatgccaagaaccctagcggcgacgacgaagagccgccaccgccactccttccattgagtcgggagaaagggcggcggaaggagcacgtgcctcatctccggcgtcgaggcgtcggaatcagtgctgttggtgttggaggttgaatggcgtataaggcggaggacgactacgactacctcttcaaggtggtgctgatcggggactccggcgtcgggaaatcgaacctcctctcgcggttcaccaggaacgagttcagcctcgagtccaagtccaccattggcgtcgagttcgccacacgaactattcgcgtcgatgagaaggtcgtcaaggcccagatttgggacacagccggccaggagagataccgggcaatcacaagtgcatattatcgaggagcagttggtgcactggttgtgtatgatataactcgtcatgtaacattcgagagcgtagaaagatggttgaaggagcttagggagcatactgattccagcaccataatcatgctcgttgggaacaaggcagatttgcgccatcttagggcagttagcactgaggatgcaaaggattttgctgagagggaaaactccttcttcatggagacatctgctctggagtcgatgaatgtggagaatgccttcagcgaagtgcttacccagatacatcatgtggtgtgcaagaaggcacttgaagctggtaatgatcctgcatctctgccaaaggggcagacgatcaatattggctccaaggatgatgtatctgctgtcaagaaagctggttgctgctcggcctaggttc

SEQ ID NO: 3433 - DNA, 1173 bp, Phaseolus vulgaris
ggatgaaaaaatggagttaaatgtgtttggcagtgttaccacactgtcatcattcccttcaaacaatttgccaactaagaaacgcacatttccagctttgcaacacttgttattgttactgagagttgttccaaatctggattttaaaacaaactatctttctttgataataaatatagattcacagcaacccatttgaatctctgatagaaggggcatatcaaaatcacttttttttttccccttgattctgtctgtagcaaactccagagagaaaaaaagggtgtgcgtgtagtggctaatgggggcgtatagagctgatgaggattacgattacctgttcaaggttgtgctgattggggactctggcgtgggaaaatccaaccttttgtcgaggttcaccaaaaatgaattctgccttgaatcaaagtccactattggggttgagtttgcaaccagaagcattagggtggatgataagattgtcaaagctcagatttgggacactgctggtcaggaaaggtaccgagcgatcactagtgcatattatcgtggagctgttggtgctttgttagtgtatgatgttaccaggcatgttacatttgagaatgtggagagatggttcaaggagctcagagatcacacggatgccaacattgtggtgatggttgttgggaacaaagcagacttgcgtcatctgcgagcagtttccaccgaagatgctacaacttttgcagaacggaaaaaaacatttttcatggaaacctctgccctcgagtccatgaacgttgaaaatgccttcacagaactgctcacacagatctaccatgttgtaagcacgaaggcccttgaaattggcgatgatccagcagcattaccaaaaggacagacgttaaatgttgggtctcgtgatggtgtatcagatgtgaagcagaatggatgctgttctgcttgaccatgcagcaaaaacctgtatttttactttaaacccatgttctgttgatatcctatgtagagttcagccttaaaacatgaaaatggttgtccagagagcattacaatctcaactttctactttgctaagtagagaaatctgttatttggttgttgtttcatgaagttgataattgatctattttcagatttatcagaatttttcatggcttctttttt

SEQ ID NO: 3434 - DNA, 1105 bp, Vitis vinifera
ccatgagtaaaattaaaagtataaaaccccgatttcccatctccaaaacctcacactggtgtgatttcaaaatcccaagaaagtgaaaaatgggtgcatacagagctgaagatgattatgactacctcttcaaggtggtcttgatcggcgactcgggtgtcggcaaatccaatcttctttccagattcaccaagaatgagttcagtctcgagtccaaatccaccattggtgttgaattcgccactcgcagcattcgcgttgatgaaaaagtcgtcaaggcccagatttgggacactgctggccaagagagatatcgtgcaataacaagtgcttattaccgaggagctgttggtgcattgctggtctatgatgtaactcgacacgttacatttgagaatgttgatagatggttgaaggagcttcgcgatcacaccgattccagcattgtgatcatgctggtgggaaacaaggcagatttaggtcacttgcgagctgtttccaccgaggatgccaaagcatacgccgagaaagaaagcaccttcttcattgaaacctcagctctagagtccacaaacgtcgaaaatgccttcacagaagtgctaactcagatatatcatgttgtgagcaggaaggcccttgagacaggagacgaagctgcaactgtgccaaagggacagaccatcaatgtcgggaaagatgatgtatcagctataaaaataggtggttgctgctctgcatagactgacgaaacaaaaaaagacagatgctcttctttctcaagtactttcccatttccatgcagccctgatgccttcagttttaccatcccccgagttcatagccgacaaagttttagctttatgccatatatatatatatatgatcatgtactgaggcacttgaagagactaaaacttgtaccagagttttagcaaaacccctcaagactaggatgatcccagcaattttttggttgcagttggcccaaactacttgttatttacttcaatttctgtctcctgtttttcatatgtatatttaaattctaaaacattgctttctccctttagtattgaactggattgaatagttttcattgttcttt

SEQ ID NO: 3435 - DNA, 870 bp, Silene vulgaris
aattgagcaactatggcgtatagagcagatgatgattacgattacttattcaaaatcgtattaattggcgattccggtgtcggaaaatcgaacttattatcgcgattcactcgaaatgagtttagtcttgaatcgaaatcaacaattggtgttgaatttgctacgcgtagtattcatgttgatgataagattattaaagctcagatttgggatactgctggtcaagaaaggtaccgtgctatcactagtgcgtactatagaggagcagtcggtgctctactggtctatgatgttaccaggcacgttacatttgagaatatcgaaagatggttgaaggaactgcgtgaccacacagagagtagtatcgtgataatgcttgtcgggaacaaggcagatttgcgtcacctgcgtgcgatctccaccgaggatgccaagagctttgccgaaagagagaatctgtttttcatggagacatcagcacttgaatcattgaatgtcgaaaattcatttaccgaggttctcactcaagttcatcatgtttttagtcgaagagcacttgatattggaggtgatcccactgctttacccaagggtcaaaccatccatgtcggaaaggatgatgtttccgaggtgaagaaggttggttgttgttctgcctaagttctaagtcatttgttcacatacggaattacggagtaacaccatgcaaagctcaatttttgtaaaggattcagacattatgggtttttataaagccattgtagtgattaatcttctaaacttttcgtcttattacacatttacacttcctcaagagttcagccggaatatcttcctttttttccttccgtttttcgtgtaatatatgtc

SEQ ID NO: 3436 - DNA, 830 bp, Helianthus annuus
cctttcaacctcgagacgcgtcggcgcctattcacttttgcatgaatcaaggccctttccactccatcttcatcatcttttcatactccaaaactttcaactcattcgttgaatttgatggcggcgtatagatctgacgatgactacgattacctcttcaaagtcgttctcatcggcgactccggcgtcggaaaatccaatttactttccaggttcaccagaaacgagttcacccttgaatccaagtcaaccatcggcgttgaattcgccaccagaagcatccgtcttcatgacaagatcatcaaggctcagatttgggatactgctggtcaagagaggtaccgtgcaatcacaagtgcatactacagaggagctgttggcgctttgctagtctacgacacaacccgccacgtcaccttcgagaacgttgaaagatggctaaaagagctcagagaccacagtgactcaaacatagtaataatgctagtaggaaacaaatcagatttacgccacttacgtgcagttaccacagaagatgcaaaaacctttgctgaaaaggaaaacacatatttcatggaaacatcggctctcgagtccctaaacgttgacaatgctttcaccgaagttttaacacaaatataccatgtggttagccgaaaagcccttgatatcggagaagattctgcagcgttacctaaaggtcaaacaattaatgtcgggtcaaaagatgatgtttcggccatgaagaaagtcggttgctgttctacttaacaacaatagtagagatcaaactactggtattacttcaaattttcatggtgttttgtatt

SEQ ID NO: 3437 - DNA, 1020 bp, Tragopogon dubius
tcttcaatttcgaaacgcgtccgcgcttctctctcgtgaatcttgtctgcacgattttgatgatcttctgataaacccggagagagaggaattgataaacgtagaagtcgagtcgtttcgtctcaaattctccatcagatactgaactttcgaagttaattccacattattgtatataatcatggcggcttacagagccgacgatgactacgattatctgttcaagttagttctgatcggagactccggtgtcggcaaatcgaatctgttatctagatttgctaagaacgagttcaatctcgaatcaaagtcaactatcggcgtcgaattcgccacaagaagtattcgtgttgatgacaaaattgtcaaggctcagatttgggatactgctggccaagaaaggtaccgcgcaatcacaagcgcgtactaccggggcgcggtgggcgcattactagtctacgacacctcacgccacgtcaccttcgaaaacgtcgaaagatggttaaaagagcttcgcgaccacaccgactccaacatcgtgataatgttagtaggaaacaaatccgacttgcgtcacctacgcgcggtccccaccgaagaagcaaaggcatttgccgaaaaagaaaacacttatttcatggagacatccgcactcgaagctctgaacgttgaaacggctttcactgaagttttgacacaaatacatcacgtggtgagccgaaaagcgcttgatgcgggtgatgatccgtctgctttgccgaaagggcagacgattagtgttggagggaaagatgatgtttctgctgttaagaaagttggttgttgttctgcttaaaagatgatgttgtttgtggtctatttttatttgaaattattgggttcaattgtggttttatttgtagtggagaatgtttttaggatttgagatggttttattgaagtaaaaacttggaatattattggttcttgaaatgagtttgagatagggtataaagtgacaaaaaaaaaaaaaaaaaagta

SEQ ID NO: 3438 - DNA, 985 bp, Amaranthus tuberculatus
tggcggcatacagagctgaagatgactacgattacctgttcaaagtagtattgattggtgattctggtgtcgggaaatctaaccttctttctcgttttactcgcaatgaatttaatcttgaatcaaagtctaccatcggggttgaatttgctactcgtagcatccatgttgatgataagatcgtcaaagctcagatttgggatactgctggtcaggaaaggtatcgtgctatcacaagtgcatattacagaggggctgttggtgctctactggtgtatgatgttacgaggcatgtgacatttgagaatatcgagagatggttaaaggaattacgggatcatacagaatcaagcatcgtgataatgcttgtagcaaacaaggccgatttgaggcacttgcgtgctgtttccaccgaagatgccaaggcctttgcagaaagagagaacctcttcttcatggaaacatctgccctcgagtctctgaacgtcgaaaacgcattcagcgaagtcctcacccaagtataccatgttgtctgtcgtaaagctcttgatgtcgggggtgacccaacagctttgccccggggtcaaaccattgatatcggaaaggatgatgtctccgaagtgaaaaagtcggttgttgttctgcctgataaggatcatctcgtcacacacgacatttttgtaaagtgctcacattagttgtgggttttgtgaaaatcattccaaatacacactcattcatgtcaagactttgaactttaaaaagggcatatgatttttaaataccctgttgaaatgtaaccttcccctcctttttctgttatataaaggcagattctgtttgttctttacaatttacagtgctaataatagtttagacatgttttccgaatgataatttttgtaaagcagtgatatattcctaagacttcaattcaaacacttgagtaccgtttataatataatattttattatttcgatgtac

SEQ ID NO: 3439 - DNA, 645 bp, Ambrosia trifida
aataatggcggcatacagagctgacgatgactatgattacctcttcaagttagtcctcatcggagactctggtgtcggtaaatcaaacctgctctctagattcgctaaaatgagtttaatcttgaatcaaagtcaacgatcggcgtcgaatttgccaccagaagtattcgtgttgatgataaagttattaaggctcagatttgggatactgctggccaagaaaggtaccgcgcaattacaagtgcatactacagaggagctgttggagctttacttgtgtatgacacgtcacgccacgtcacctttgagaacgttgagcgatggctaaaagagcttcgtgaccacacggattcaaacattgtgataatgttagtcggaaacaaggctgacttacgccacttgcgtgcagtcccaactgaggaagcaaaaacatttgctgaaaagagaacacttatttcatggagacatcggcgctggaggctttgaatgttgaaaccgcgtttacagaagtccttacacagatttatcatgtggttagccgaaaagcacttgatgcaggtgatgatccttcagctttgccgaaaggtcaaaccattaacgtagggtcaaaggacgatgtttccgctgttaagaagtcggttgctg

SEQ ID NO: 3440 - DNA, 775 bp, Flaveria ramosissima
cacaaaattcgccataattcactctcaatctctccattaaacactcaattctcgaagctaacaccacctatcatggcggcttacagagccgacgacgactacgattacctcttcaagttagttctgatcggagactccggcgtcggaaaatcaaatctgctatcgagattcgctaaaaacgagttcaatctcgaatcgaagtcaacaatcggcgtcgaattcgccaccagaagcattcgtgttgatgataaaattgttaaggcgcagatttgggataccgccggccaggaaaggtatcgcgcgattacaagtgcatactacagaggagccgttggggcgctggttgtgtacgacactcacgccacgtgacctttgagaacgtggcgaggtggttaaaagagcttcgtgatcacaccgactccaacattgtgataatgttggtaggaaacaaggctgacttacgccacttgcgtgcagtccccactgaagaggcaaaagcgtttgctgaaaaggagaacatttactttatggagacatcagctcttgaggctttgaatgttgaaaccgcgttcacagaagttcttacacaaatataccatgttgtaagccgaaaggcacttgaagcaggcgatgatccttcggctttgcctaaagggcaaacgattaatgtggggtcaaaggatgatgcatctgctgtcaagaaagttggttgctgctctgcttaagaatgccctgaggtttatctgagatttgagacagtattcttgaagttggt

SEQ ID NO: 3441 - DNA, 940 bp, Chrysanthemum coronarium
ataataataaaccctagataaatctcattcattcacagatcagagttattgaatcaatggcggcttacagagccgacgatgactacgactacctgttcaaactggtcctgatcggagactcaggtgttggtaaatcaaatctgctttctcgatttgctaaaaacgagtttaatctcgagtctaagtcaaccattggggtcgaattcgctaccagaagtattcgtgttgacgataagattgtcaaggctcagatttgggatactgctggtcaagaaaggtaccgtgcaattacaagtgcatactacagaggtgctgtcggtgctttactcgtctatgacacatcgcgtcacgtcacctttgaaaacgttgaaagatggttaaaagaacttcgagaccacaccgattccaacattgtgataatgttggtaggaaacaaagccgatctacgccacttgcgtgcggtccccacagaggaagcaaaggggtatgccgaaaaggaaaatacttacttcatggaaacgtcagctctggaggcgttgaatgttgaaaccgctttcactgaagttttaacacaaatatatcacgtggtaagccgtaaagcacttgatgcagggaatgacccttcggctcttcctaaaggacaaactatcaacgtgggatcaaaggatgacgtttctgctgtgaagaaagcgacttgctgttctgcttaagatgtattgttttacattcgagatatgggacggttttcttgaagtacatttggaatgatggttctggaaatgagtttgagcctgcaaattcattaatacggtataaattcttgaactgaggacgattctattggcctatttggtataacttataaaactatattaagtaacatatgtatttctacgaatttttttgtaatatttaagagaccattttgtcgacatttaat

SEQ ID NO: 3442 - DNA, 1231 bp, Chrysanthemum coronarium
atctgttatctagcaaatcttgatatttcgaaacgcgtacgcgcctctctttctctcccaaatctcgtgaaccccataactaacaaagatatttatcattcaacaggtcaagttttcaacagatcttcattcattcattcacataataaaccctagataaatctcattcaccgatcagagttataccaaatggcggcttacagagccgacgatgactacgactacctgttcaaactagtcctgataggagactcaggtgtcggtaaatcaaatctgctttctcgatttgctaaaaatgagtttaatctcgagtctaagtcaaccattggggtcgagttcgctactagaagtattcgtgttgatgataagattgttaaggctcagatttgggatactgctggtcaagaaaggtaccgtgcaattacaagtgcatactacagaggtgctgtcggtgctttactcgtctatgacacatcgcgtcatgtcacctttgaaaacgttgaaagatggttaaaagaacttcgagaccacaccgactccaacattgtgattatgttggtaggaaacaaagcggatctacgccacttgcgtgcggtccccacagaggaagcaaaggggtatgctgagaaggaaaatacttacttcatggaaacatcagctctcgaggcgttgaatgttgaaaccgctttcactgaagtcctaacacaaatatatcacgtggtaagccgtaaagcacttgatgcagggaatgacccttcggctcttcctaaaggacaaactatcaatgtgggatcaaaggatgatgtttctgctgtgaagaaagcgacttgctgttctgcttaagatgttctgcattcgagatatggggacggttttcttgaagtacgtttggaatgatggttctggaaatgagtttgagcctgcaaattcattaatacggtataaattcttgaactgaggatgattctattggcctattgggtataacttataaaactatattaagtaacatatgtatttctacgaatttttttgtaatatttaagagaccattttgtcgacatttaatgactcactgaattgttttatcgcctgttagcttcttcgtgttcaactacaactgtctttcacaattcactctagtttctttaatgggtttattgttcaatgttttggcttcttcaatgtttttgtcaacatcgataacttcctttaaaattaaaatcgagaa

SEQ ID NO: 3443 - DNA, 880 bp, Chrysanthemum coronarium
aatggcggcttacagagccgacgatgactacgactacctcttcaagctagtcctgatcggcgactcaggtgttggcaaatcaaatctgctatctcgatttgctaaaaatgagtttaatctagagtcaaagtcaaccattggcgttgaatttgctactagaagtattcgtgttgatgataaaattgttaaggctcagatttgggatactgctggtcaagaaaggtaccgtgcaattacaagtgcatactacagaggtgctgtcggtgctttactcgtctatgacacatcgcgtcatgtcacctttgaaaacgttgaaagatggttaaaagaacttcgagaccacaccgactccaacattgtgattatgttggtaggaaacaaagcggatctacgccacttgcgtgcggtccccacagaggaagcaaaggggtatgctgagaaggaaaatacttacttcatggaaacatcagctctcgaggcgttgaatgttgaaaccgctttcactgaagtcctaacacaaatatatcacgtggtaagccgtaaagcacttgatgcagggaatgacccttcggctcttcctaaaggacaaactatcaatgtgggatcaaaggatgatgtttctgctgtgaagaaagcgacttgctgttctgcttaagatgttctgcattcgagatatgggacggttttcttgaagtacatttggaatgatggttctggaaatgagtttgagcctgcaaattcattgatacggtataaattcttgatctgaggatgattctattggcctatttggtataacttataaaactatattaagtaacatatgtatttctacgaatttttttgtaatatttaagagaccattttgtcgacatttaat

SEQ ID NO: 3444 - DNA, 1192 bp, Chrysanthemum coronarium
ccgatctgttatctagcaaatcctgatattttgaaacgcgtacgcgcctctctttctctcccaaatctcgtgaatcaatcaaacagatatttatccaacaaacagatcttgattcacataaaccctagaacacattcaccaatcatctgataaaccaatggcggcttacagagccgacgatgactacgactacctgttcaagctagtcctgatcggcgactcaggtgttggcaaatcaaatctgctatctcgatttgctaaaaatgagtttaatcttgagtcaaagtcaaccattggcgttgaatttgctactagaagtattcgtgttgatgataaaattgttaaggctcagatttgggatactgctggtcaagaaaggtaccgtgcaattacaagtgcatactacagaggtgctgtcggtgctttactcgtctacgacacatcacgtcacgtcacctttgaaaacgttgaaagatggttaaaagaacttcgagaccacaccgaccaaaacattgtgataatgttggtaggaaacaaagccgatctacgccacttgcgcgcggtccccacagaggaagcaaaggggtatgctgaaaaggaaaacacttactttatggaaacatcagctctagaggcgttgaatgttgaaaccgctttcactgaagtccttacacaaatatatcacgtggtaagccgtaaagcacttgatgcagggaatgacccttcggctcttcctaaaggacaaaccatcaatgtgggatcaaaggatgatgtttctgctgtgaagaaagcgacttgctgttctgcttaagatgttctacattcgagatttgggacagttttcttgaagtacatttggaatgatggttctcgaaatgagtttgagtctgcaaattcattgatacggtataaattcttgaactgaggatggttgtgttgggtataacttataaaactatattaagtaacatatgtgatttctacgaattttttgtaatatttaagagaccgttttgtcgacatttaatgactcactgaattgttttatcgcctgttagcttcttcgtgttcaactacaactgtctttcacaattcactctagtttctttaatgggtttattgttcaatgttttggcttcttcaatgtttttgtcaacatcgataacttcctttaaaattaaaatcgagaatg

SEQ ID NO: 3445 - DNA, 795 bp, Cichorium intybus
attttgatcttcagataaaccccaagaggaattgataatcgtagaagtggagtaatttcatctcaagctgtccattagatactgaatttcgaagttaatttcaccttattgtatctaatcatggcgtcttacagagccgacgatgactacgattatctgttcaagttagttctgatcggagactctggtgtcggcaaatcgaatttgttgtctagatttgctaaaaacgagttcaatctcgaatcgaagtcaactatcggcgtcgaattcgcgaccagaagtattcgtgtcgatgacaaaattgtcaaggctcagatttgggatactgctggccaagaaaggtaccgagcaatcacgagcgcgtattaccgcggcgcggtgggagcgctattagtctacgacacctcacgccacgtcaccttcgagaacgtcgaacgttggttaaaggagcttcgcgaccacacggactcaaacatcgtgataatgttggtaggaaacaagtccgatttgcgacacttgcgcgcggtccccaccgaggaagcaagggcatttgcggaaaaggaaaatacgtattttatggaaacgtcagctctcgaagctttgaatgttgaaacggcttttaccgaagtgttgactcaaattcatcaagtggtgagtagaaaagcgctcgatgcgggagatgatccctcggctttgcctaaaggacagacgattagtgtcggaggtaaggatgacgtgtccgcggttaagaaagttggttgttgttcggcttgaggggtattatgggaaatttgt

SEQ ID NO: 3446 - DNA, 859 bp, Petroselinum crispum
tattatctccacaactgcagaaccaaaattattttcctaaccatttcaagatttgcagttgtagaatccattacacaaaatttaagagtgacaactaatgtaagcaatatcgatactacaaaaattttacaacttcacctaccacttttgctacacgtacttagtgcagtgctactaagtagagataaatttttcgaaaaacagcaagagacttgagctagtttagctgcaatggctgcatatagaggtgatgatgactatgattatctgttcaaagttgttatcattggtgattcgggtgtcggtaagtcgaatctcttgtcgagatttactaagaatgagtttagtttggattcgaagtctactataggtgttgagtttgctactaggagtattcgtgtcgatgataaagtcgtaaaggctcagatttgggacactgctggccaagaaagatatcgggcaattactagtgcatactaccgaggggcagtaggtgctttgcttgtctacgatgttactcgccatgttacttttgagaatgtcgagagatggctgaaagaattgagggaccacactgatgcaaacattgtgataatgctagttggcaacaaggctgacttgcgtcatctacgtgcagtttctaccgaggatgcaaaggcttttgctgagagggaaaagacatacttcatggaaacatccgctctagagtccatgaatgtcgagaactcattcacagaagttctcagccaaatatatcacgtagtcagccgaaaagcacttgaaatgggggatgatcctgctgtattaccaaagggacaaactatagctgttggttctaaagatgatgcttctgcagtga

SEQ ID NO: 3447 - DNA, 1376 bp, Ambrosia trifida
cgtgaatcttcattttcgtaaaggcgtccgcgcctctcgctcgtgaatcttgccgatcagatttaaaagatctacgaataacaataataaacacttacaaaaccaatccacaatcacgaacctcagcaatccaacctcaattcctccattacttactaaattctcaacccaatatcttaatggccgcatacagagctgatgatgactatgattatctcttcaagttagtcctcatcggagactctggtgtcggtaaatccaatttgctctctagattcgctaaaaatgagtttaatcttgaatcaaagtcaacgatcggcgtcgaattcgccaccagaagcattcgtgttgatgataaagttattaaggctcagatttgggatactgctggccaggagaggtaccgcgccattacaagtgcatactacagaggagctgttggagctttacttgtgtatgacacgtcacgccacgtcacctttgagaacgttgagcgatggttaaaagagcttcgtgaccacacggattcaaacattgtgataatgttagttgggaacaaagctgacttacgccacttgcgtgcagtccaaactgaagaagcaaaaacatttgctgaaaaagagaacacttatttcatggagacatcggctctggaggcattgaatgttgaaaccgcgtttacagaagttcttaccgaaatttatcatgtggttagccgaaaagcacttgatgcaggtgatgatccttcagctttgccgaaaggtgaaaccattaacgtggggtcaaaggacgatgtttctgctgttaagaaagtcggttgctgttctgcttagtatttgttttttttttttttttttcgtcataacatatttcttaattaaaaaactataacaatacaataacgtatgataaagttatgaccaatctaaaatcatgagaatggtttgtttagaaattgatgacataggtgggctcaagaaaagatacttaaaacctaccaactttagataaacttctaagcttaaatggcaaaagtcttaaaaacatctatttgatcggatgtctacagcgatacccatcagtctccatccgccgaatacacatacccagacactcagtcgcacatgattgagtaggggatcatattgtccagcatgtaacggccttgctcgacctaaaagggtaatcttgtttgcgtccgagaaatcatagaaacaattgtcgtttcgcgatcacctaccgaagttgaataacaggctatggttgtcgtggttagcgagattagttgtggctccgatggctactaaaggccttgatgttctaagagaccaaggattgttggataccagcgccaggaggctagcaagcccatcttc

SEQ ID NO: 3448 - DNA, 773 bp, Centaurea maculosa
caaattctcacatcaatcaattttggatcgctttcttcccgttcgttcgcaccactattttgttcatcctctcatgaacataatttcgatctccgttgtttaacgtcacgagagaaagaaatggggggatatcacggagacgatgactacgactatttgttcaaggtcgttttgattggggattcaggtgtcggtaaaaccaatcttttgtctcgattttccaagaacgaatttagccttgaatccaaatccaccattggggttgaattcgccacacgtagcatcaacgtcgatgacaagatcatcaaggcccagatttgggacacggccggtcaagaaaggtaccgtgctataacaagtgcatactaccgaggagccgtaggtgcactaatcgtatatgacatcacacgtaacgtaacattcgacaacgtcgaaagatggctcaaagagcttcgagatcatacggatcaaaacatcgttatcacgcttgtggggaacaaagccgatctacgtcacctacgagccgttcaaacggaggatgcaaaggcatttgcggagaaagagaacaatttcttcatggaaacatccgctctcgaatctttcaacgtcgaaaacgctttcacggaagtattgactcagatttatcacgtggtgagcaagaaggcgctagatatcgggaatgaccccatggtcatacccaaaggacaatcgattagtgttggaggtagagatgatgtatctgctgttaagaaatcagggtgttgctctaacta

SEQ ID NO: 3449 - DNA, 963 bp, Cynara scolymus
ttggcgggggatcttcagtttcgaacgcgtccgcgcctctctccttctctctctctctctcttgaatctcgaatcttgtcgacacgattttgatgatcttcagataaacccaaaagcaatttataatcgtagaacaggagtaattcaattctccatttagatactgaatttttgaagctaatttcaccttatcgtttctaatcatggcggcttacagagccgatgacgactatgattatctgttcaagctagttctgatcggcgactctggtgtcggcaaatcgaatttgctgtccaggtttgctaagaacgagtttaatctcgaatcgaagtcaactatcggcgtcgaattcgccaccagaagtattcgtgttgatgataaaattgtcaaggctcagatttgggatactgctggccaagaaaggtaccgtgcaatcacaagtgcatactacagaggggccgttggtgctttgcttgtctacgatacatcacgccatgtgacctttgagaatgttgaaagatggttaaaagagctccgagaccacaccgactcaaacattgtgatcatgctggtaggaaacaaggcagatttgcgtcacttgcgtgccgtccccacagaggaggcaaagacgtttgccgagaaggaaaacacgtattttatggagacatcggctctggaggccttgaatgtcgaaacggctttcacggaagtcctgacacaaatacatcatgtggtcagccgaaaagcactcgatgcaggggacgatccttcggctctgcctaaagggcaatccattaatgtgggatccaaagatgatgtttctgctgtgaagaaagttggctgctgttctgcttaacaagagattggggaactaaatttggaatggtggttcttgaatgagttgagcctgcagatcattgagaagatataagtataactgcagtctgatttctgaagcaaga

SEQ ID NO: 3450 - DNA, 1004 bp, Flaveria ramosissima
ttttcgaaaagcgtccccgcttctctctctctccggtgaatctcgttgatcaagatttcaataatcttcagataaacaaaccccaatcgaatcaacaatcacaaaattcgccataattcactctcatcaaacactcaattctcgaagctaacaccacctaccatggcggcttacagagccgacgacgactacgattacctcttcaagttagtcctcatcggcgactccggcgtcggcaaatcgaacttactatccagattcgcgaagaacgagttcaatctcgaatcgaagtcgacaatcggcgtcgaattcgccaccagaagcattcgtgttgatgataaaattgttaaggctcagatttgggataccgctggccaggaaaggtatcgtgcaattacaagtgcgtactacagaggagctgtgggagcattggttgtgtatgatacgtcacgccacgtgacctttgagaacgtggctaggtggttgaaagagcttcgtgatcacaccgacgccaacattgtgataatgttggtgggaaacaaggctgacttacgacacttgcgtgctgtgcccactgaggaggcaaaagcgttcgctgaaaaggagaacatttactttatggagacatcagctctcgaggctttgaatgttgaaaccgcgttcacagaagttcttacgcatatataccatgttgtaagccgaaaggcgcttgaagctggcgatgatccctcggctttgcctaaagggcaaacgattaatgtggggtctaaggatgatgcatctgctgtcaagaaagttggttgctgttctgcttaaggatgccctaaggcttatctgagatttgagacaatattcttgaagttggttctggaaatgagtttgagcctgcgaattaagtgacggtacaagctatagactctagtaacataggtgatttctatgattctttttgtaatattaagagattttttttttgacattaatcgattcgatgaattgttacc

SEQ ID NO: 3451 - DNA, 1075 bp, Musa acuminata
gggagagaggaggaggaggagggagagggaggtgggtgtcgtaatggcgtacagggcggacgaggagtacgattacctgttcaaggtggtgctgatcggggactccggggtgggcaagtccaacctgctctcccgcttcgcccgcaacgagttcagcatcgagtccaagtccaccatcggggtcgagttcgccacccgcaccgtccacgtcgacgacaaggtcgtcaaggcccagatctgggacaccgccggccaagaacggtatcgtgccatcacaagtgcatattatagaggagctgtcggtgcactcgtcgtctatgatgtgactcgccatgccacttttgagaatgtggagaggtggttgaaggagctacggagtcatacagaccccagcattgtggtaatgctggtgggcaacaaggctgacttgcgtcacctgaggtctgtctccctggaggacgctgaggtctttgctgagaaggagaaaaccttcttcatggagacatctgccttggagtcactgaatgtggagaatgcatttacagaagtgctatcacagatatatcgagtaacaagcaaaaaatcccttgatgttggcgacgatgctgcagtatttccgaagggacagaccatcaatatgggaggaaaagatgatgtatcagctgttaagaaacgtggctgctgctcaacttagctttcttctttggcattcttgcatggggttgccttttgcaaatttccaagtacttctctcttgaagacaaactccaagaaaatttagcatcacctgcacttccatagctagtatcagtatggctttttatacgagtggtcatcgttccagagtgcagactgcaagatttcttctcacttttatatatggcttgaactcaaactggattttgttagcaagagtgcagactgcaagatttcttctcacttttatatatggcttgaactcgaactggattttgttagcaagtgtttgttgcaaccgatgtatcgcactatgcaatcaggaatgctattttgttatatcagtgattgctcagttgttcttcccttaacctcataa

SEQ ID NO: 3452 - DNA, 1089 bp, Curcuma longa
gcacgcggtaattccaaaggtcggagaaccctagcggtggaggcgaccaccaattcgctgccatttcttcccctggtacagctttgcatctgatctccgtcagtatccgcatgaggaacactatgtgcttgtagtgctgctgcggtcggcgtcggacgcggtggagcaatggcatacagagcggacgacgaatacgactacctcttcaaggttgttctgatcggggactctggcgtcgggaaatctaacctcctctcccggttcaccaggaatgagttcagtctcgagtccaagtccactattggggtcgagttcgctacccgaagcattcgggtcgatgataaggtcatcaaagctcagatttgggacaccgctggtcaggaaagataccgagcaatcacaagtgcatattaccggggagcagtgggtgcattgattgtatatgacatcactcgtcatgtaacttttgaaaatcttgaaagatggttgaaggagcttagggatcatactgattccaacattgtgatcatgcttgtgggaaacaaggcagatttacgccaccttagagccgtcagcactgaggacgcaaaggattttgcagaaagggagcgtgcattcttcatggagacatctgcactggaatcagtgaatgtggaagaagccttcactgaggtgctgagtcagatctataacatcgcgagcaggaaggcgctggaagctgctgatgactcggcaactttgccaaagggacaaaaaatcaacgttggcaaagatgatgtttcagccgttaagaaagtcggttgttgttcaacttaacccgaatgacaactattcaaaaaattatcaaagcatttactggcatcttgctatgtttagtttgtcttgtggcattgatggaagtggttccccttggaaggttactggtatgttattgtaagtttaatgagatgatttaaaagtaggatcttaaaactgcattcttgtctcaagacttctgtttaggcatattgaaactaagatttgccttcatgtgtcgattgtttccctgcaaaacaaagggcctttcttaattcggcttatacttttctc

SEQ ID NO: 3453 - DNA, 934 bp, Saccharum officinarum
cgcttcctcctcttgtttcttatacgcgccacccacacgcctcgcgtccgccttccgtcctacacctcgccatcctccccgagaagcgctgagggcctcacctgcccgtcctcctgccccaagaaccgcggttcaggaaggaaggaaaggcaagtgcctgcctctgcctgccggggctcagcagcgatggcgtacagggcggaggacgactacgactacctcttcaaggtcgttctcatcggcgactccggcgtcggcaaatccaacctgctctccaggttcacgcgcaacgagttcagcctcgagtccaagtccaccatcggggtcgagtttgccaccaggagcatcagggtcgacgacaaggtcgtcaaggcccagatctgggacaccgccggccaggagaggtatcgagcaattacaagtgcgtactacagaggggccgttggcgcacttgtcgtgtacgatgtgacacgccatgtgacctttgagaatgtggagaggtggttaaaggagctccgggatcacactgatgcaaacattgtcatcatgcttgttggcaacaaagctgatctgcgacaccttagagctgtatccgtggaggatgccaagggcttcgccgagagggaaagcaccttcttcatggaaacatccgcactggagtccatgaacgtcgagagcggcttcaacgagggcctaactcaaatctatcgtgtggtcagcaagaaggcctttacattggcaataacctggtggtccaccaaaaggggaaaccatcaagttggtgggcaagatgatttttttctgttaataaattagggtgcgggttccccttaatccctttacccttaaaaggaacctttactcccccattctattatggtaatgaaaaatgacccttgtggcaccaacctggggggtataaaaatatgtggtg

SEQ ID NO: 3454 - DNA, 2663 bp, Brassica oleracea
ttagcatcgaattcaatcagatacgatggagagcgagagcagtgaagaagagattgctacctcagggatcccaagaggaggcccaatctatcttcccaacatggtgggacaagtttccactgtgcccgagtttcaatcttcgtatctcagtctcctccacgatttggaaactcaattagcttcctcctcctctcaccaacatgatctctcaactgatggtctcaagatttatactgatgaggaactcactgatatggctctgaaggaagcctttaaggaagatagcctctctttacgggatgatgatactcttcctctaaacgagctcgagcaatctcagatcgtttctcaccctgaaaatccatcagctgagaacgaaagaggtacgaaaagaaggcggacggtaaagacgggtgcagtgaagaagactgaggtgaagagaacagtaaagaaacctgaggaaccttatatagccagagtagagcagcttgctaaacttaaacaaaagcaggatgaggataaagcacatgtgaggctacactgcttcagcgaaacttgggaagatgttgaagatgcaagtacatctctagaaagctttgagaagttgcaatctctgaagtccattgataactatacgctggtgaagccatcagagatccaggggacagtagatacgctatttcctgaagtcattctgtgtgttgagatttataacaatcgcaaatccaaggtaactgcattgttctctacatctttaattcactatattataatgttttttttgagaagtctaacgccttcttcagcccatgtagatactaaatcttgttcagtcagtatagttgattagacatagatgcagtatgcatatgcaaacaccattaataatagtatctgtgtgaattttttgtccagacccaagaatttttggttctgggacgtcaaatgttaactgaattaaaggacaagatacactgtgttacagaccaggtgatggaaaaggctggcaagtatgatccctctggatacttcctcattgaagatatctttcacaacgatttaaggaatcgcaaggcaacagattacagcaaacctatactaaactggctatggaactcaaaagatgaagcacttaaaaaatgggaaggcattataacgggagaactacagcaaaagcagagaacggctctcggtgtaacgaaagccatggatttacctcgttttggatctgcagagatgcagagtactcgcttctgtgatttaagattcagactcggagctagttatctttactgtcatcagggagattgcaagcacatgatagtgataagggacatgaggctgagtcatccagaggatgttcagaacagagcggcttacccgagactcatatatcagttgaaaacgagggctcagaaatgcagcgtttgcaagatatacagagcttctaaggttgtattggatgacaagtggggaaatgagaatcaatgctattactgtgatatttgttttggccatctgcacaacgagggtggtcctctgtattgtgacgtcccagtctttgattatgtgtatgagtagatattcatctcgttacagaatatcattagaagatagaaagaagaatatagttgcagatgcacgaagcatgagtcttttgtttttgtttttttaaatcgaagtacgagtcttttcttgtttacacaatacaaaaaaaagataaatagaaatgtttatgtttagcctatctgaaatagaggagattccttgaatctctctgtcttctctaattcaaaactgaaatttgtgtcctctccaatctagaaaacgtcaaaacaagaacaacagaacaaaactaatgttttagaagtattgttgttggaacatccaaataacattttttcattgttgaatataacttgtctcaagaacaaactcataaagacaaaaaaaaaaagaggttaagttttggacagaagatgggagcatatagagcagaagatgattatgattacctcttcaaggtggtcttaaccggagactccggcgttggaaaatctaatctgttatctcgtttcaccagaaatgacttcagcaacgactcacgtgccaccatcggtgttgagttcgccacacgtagcatccaatgcgatgacaagatcgtcaaggctcaaatatgggataccgccggtcaagaaaggtaccgagccatcacgagcgcttattaccgaggagccgttggtgcgttgctagtttacgacgtgacgcgtcacgtgacgttcgagaacgttgagagatggctaaaggagctaagggaccacaccgacgcgaacattgtgatcatgctcgttggtaacaaagctgatcttcgtcatcttcgagccatctcaaccgaagatgccaaggggtttgcggagagagagaacacgtttttcatggagacatctgcgcttgaagctctgaacgttgagaatgctttcaccgaagttctcactgagatttacagagtggttagcaagaaagcacttgaagctggagacgatccaaccactgctttgcctaaaggacagacgattaacgtcggaggcagagatgatatctcggctgttaaaaaacctggttgctgctctgcttagatacaaccattgtattttatttattca

SEQ ID NO: 3455 - DNA, 882 bp, Capsicum annuum
gttattgtttagtacgaaaaaatatcaagatattcgagtaactataagtaatggcaggtggatatagagctgaagatgattatgattatctattcaaattagtgttaattggggattctggtgttggcaaatctaatctcctttctcgattctcgaggaacgagttcaatcttgaatctaagtctactattggtgttgaatttgctactcgaagtattcgtgttgatgataagatcgttaaggctcagatttgggatactgctggccaagaaaggtaccgtgcaattacaagtgcatactacagaggggctgtcggtgcattgcttgtgtacgatatcactcgacatgtcacatttgaaaatgttgagagatggttaaaagagcttcgagaccataccgaccaaaatattgtcataatgctcgttgggaacaaggccgacttacgtcacttgcgtgctgttacaatagaggatgccaaggcctttgctgaaagagagagtaccttctttatggagacttcagcacttgagtccttgaatgttgagaatgcatttactgaagtattgaccgagatatacagggtggtctgtcggaaagcacttgaagttggagacaatcctgctgcgttgtctaaggggcaaacgataaatgttggcaaggatgatgtttcagctgttaaaaaagttggttgttgcaatgtctaagcaaaaaatcaagaaatccaaatgcttactacaaccagcaaatgctcctactattgttgcattgtgtattctcagttttgaatcttttaggaaatgatgtatctacttatatattattccacctctgtattgtttcatcaacctactttgagtttgtactaccctatttgttaccttc

SEQ ID NO: 3456 - DNA, 821 bp, Brassica rapa
ttgaataaaactgtctcaagaacaaactcataaagacaaaagagtttagctttggacgtaacatgggagcatatagagcagaagacgattacgattacctcttcaaggtggtcttaaccggagactctggtgtcggaaaatctaatctgttatctcgtttcacaagaaatgacttcagcaacgactcacgtgccaccatcggtgtcgaattcgctacacgtagcatccaatgcgatgacaagatcgtcaaagctcaaatctgggatacagccggtcaagaaaggtaccgtgccatcacgagcgcatattacagaggagccgttggtgcgttgctagtttacgacgtgacacgtcacgtgacgttcgagaacgttgagaggtggctcaaggagctaagggaccacacggacgcaaacattgtgataatgctcgttggtaacaaagctgatcttcgtcaccttagagctatctctaccgaagaagctaaggcctttgcggagagagagaacacctttttcatggagacatcagcacttgaagctctgaatgttgagaatgctttcaccgaagttctcacagagatttacagagtggttagcaagaaagctcttgaagctggagatgatccaaccacagctttgcctaaaggacagacgattaatgtcggaggccgagatgatatctcagccgttaaaaaacctggttgctgctctgcttagatacactcgtttctctttctttcttgtattttatttattaagcattaacattttcactaatttcttgcaaatttgtatacaaaacaaagtttatattcaagt

SEQ ID NO: 3457 - DNA, 960 bp, Cichorium intybus
atcttgtcgacacgattttgatcttcagataaaccccaagaggaattgagaatcgtagaagtggagtaatttcatttcaagctgtccattagatactgaatttcgaagttaatttcaccttactgtatctaatcatggcggcttacagagccgacgatgactacgattatctgttcaagttagttctgatcggagactctggtgtcggcaaatcgaatttgttgtctagatttgctaaaaacgagttcaatctcgaatcgaagtcaactatcggcgtcgaattcgcgaccagaagtattcgtgtcgatgacaaaattgtcaaggctcagatttgggatactgctggccaagaaaggtaccgagcaatcacgagcgcgtattaccgcggcgcggtgggagcgctattagtctacgacacctcacgccacgtcaccttcgagaacgtcgaacgttggttaaaggagcttcgcgaccacacggactcaaacatcgtgataatgttggtaggaaacaagtccgatttgcgacacttgcgcgcggtccccaccgaggaagcaagggcatttgcggaaaaggaaaatacgtattttatggaaacgtcagctctcgaagctttgaatgtcgaaaccgcttttaccgaagtgttgacgcaaattcatcaagtggtgagtagaaaagcgctcgatgcgggagatgatccctcggctttgcctaaaggacagacgattagtgtcggaggtaaggatgacgtgtccgcggttaagaaagttggatgttgttcggcttgaggggtattatgggaaatttgttttttatttattttgagttgtttgtgtttttaggatttgagacggttttgttgaattgaacttggaaatgagtttgatcttgcaaattcattattgatggttttgtattatgtcttgatacttgacttggtatattcttgtgtttggtata

SEQ ID NO: 3458 - DNA, 657 bp, Petunia hybrida
acagtgagagtgagagtgagagtgagagtgagagtgggagagagcaagtagtaatgggggcatacagagcggacgatgattacgattatttgttcaaggtggtgttgatcggggattcaggtgtgggtaaatcaaaccttctttcaagattcactcgtaatgagttcagtctggagtctaagtcaaccatcggtgtcgaatttgccacacgtagtattcgtgtcgacgataaagtcgtcaaagctcagatttgggatactgctggccaagaacgatatcgtgcaatcacaagtgcctactatcgaggagctgttggtgcattgcttgtctatgatgtaactcgtcatgtaacttttgagaatgtggagagatggttgaaagagctccgagatcacactgactctagcatcgtcataatgctggtgggtaataaggcagatttgcgtcatctgcgcgctgtttctactgaggatgccaaggcatttgctgagaaagaaagcacgttcttcatggaaacgtctgctttagagtccatgaatgtggacaatgccttcacagaagtgctcactcaaatacaccgtgttgttagcagaaaagctcttgaagtaggagatgatccggctgcattgcccaagggtcagactattaatgttggag

SEQ ID NO: 3459 - DNA, 844 bp, Arnica chamissonis
ataaactctaaaaggaatctataatcatagattagagtaatttaatctcgatttcccattagatactgaattttcgaagctaatttcaccttatcgtatccaatcatggcggcttacagagctgacgatgactacgattatctgttcaagttagttctgatcggcgactctggtgtcggaaaatcaaatttgctgtctagatttgctaagaacgagtttaatctcgaatcgaagtcaaccatcggcgtcgaattcgccaccagaagtattcgcgttgatgacaaaatcgtcaaggctcagatttgggatactgctggccaggaaaggtaccgggcaattacaagtgcatactacagaggagctgttggagctttactcgtgtatgacacatcacgccacgtcacctttgagaacgttgaacggtggttaaaagagcttcgtgatcatacggactcaaacattgtgataatgttagttggaaacaaggccgacttgcgacacttgcgtgcagtccagaccgaggaagcaaaaacatttgcagaaaaggaaaacacttatttcatggagacatcagctttggaggctttgaatgttgaaaccgcgtttacagaagtccttacacaaattcataatgtggttagccgaaaagcacttgatgcaggtaatgatccttcagctttgccgaaaggtcaaaccattaacgtggggtcaaaggatgatgtttctgctgttaagaaagtcggttgctgctctgcttaagaatgtttttttaggatttgagacagttttgagcctgcaagttcactgttatggtataaagttataaactttagtcttggattct

SEQ ID NO: 3460 - DNA, 1028 bp, Arnica chamissonis
ctgaatctggtcgaccagattttgatgatcttcagataaaccccaaaggaatctaaaatcacaaacttgccgcaattaattctgaaattctccattagatactgaattttcgaagctaatagcgcctcatcgtatcctattatggcggcatacagagccgacgacgactacgattacctgttcaaattagttctgattggagactccggtgtcggcaaatcgaatttgctgtcgagatttgctaagaacgagtttaatctcgaatcgaagtcaaccatcggcgtcgaattcgccaccagaagtattcgtgttgatgacaaaatcgtcaaggctcagatttgggatactgccggccaggaaaggtaccgcgcgattacaagcgcgtactacagaggagctgttggagcactgatcgtgtatgacacgtcacgccacgtcacgtttgagaacgttgagagatggttaaaagagcttcgtgatcacactgactcgaacattgtgataatgttggtaggaaacaaggccgacttacgtcacttgcgtgcggtccccactgacgaggcaaaaatgttcgctgaaaaggaaaacacttactttatggagacatcggcgcttgaggctttaaatgttgaaaccgctttcacagaagttcttacacaaatatatcatgtcgtaagccgaaaagcgcttgaagcgggtgatgatccttcagctctgcctaaagggcaaaccattaatgtagggtcaaaggatgatgcatctgctgtcaagaaagttggttgctgctctacttaagaatgtcctaaggtttatctgggtaagtatcatctacttcaagttatttggtccatttgtgtgtgttctttgattattagtttgcatgtaggatttgagacagttttcttaaagttggttctggaaatgagtttgagcctgcagattcagttaaggcaagactaggattgatcatgttgggtctaagacttttaagtaccatatgtgatttcaatgattctttttgaatactt

SEQ ID NO: 3461 - DNA, 1097 bp, Centaurea maculosa
ctctccatctctctctcctgaatcttgaatcttaacgcgattttcggatttttgatcatcatcttcttcacataaaagaaccaaatctacaatcacagtagaacaatttcaatttcaatttcaattcttccaactagattcacaactttttgaaacctaatttcacctttaattctatacatctaaatcatggcggcttacagagccgatgacgactacgattatctcttcaagttagttctgattggcgactccggcgtcggaaaatcgaatttgctctctagatttgctaagaacgagttcaatctcgaatcgaagtcaactataggcgtcgaattcgctactagaagtattcgtgttgatgataaaatcgttaaggctcagatttgggatactgctggccaggaaaggtaccgtgcaatcacaagtgcatactacagaggtgccgttggtgctttgctcgtctacgacacatcacgccatgtgaccttcgagaacgttgaaagatggttgaaggagcttcgagaccacaccgatgcaaacatagtaatcatgctagtggggaacaagtcagatttgcgtcacttgcgtgcggtccccacagaggaggcaaagacgtttgccgagaaggaaaacacgtatttcatggagacatcggctctggaggctttgaacgttgaaacggccttcaccgaggtcctgacacagatataccacgtggtcagccgaaaagcactcgatgcagccaacgatgcttcggctctgccgaaagggcaaaccatcaatgtgggatccaaagatgatgtttctgctgtgaagaaagttggttgctgttctgcttaacaaaagatttgggaatggtggttcttgaaatgagtttgagcatgcaagttcattggtagggtataaagtataaagtgcggtcttgattgttgatggcaagatgtggaggatacaagtgagaatgatccagttgggtttaaagactctttagtaaaatatgtgatttctatgaatttttgtaatatttatgagaccctttgtttgacatttaccaccgcgctgcccatgttcggaaaacataaacacaaaaaaag

SEQ ID NO: 3462 - DNA, 949 bp, Cichorium intybus
cgcctctctctctctctctctctctctctctctctctctctcgtgaatcttgtcgacacgattttgatcttcagataaaccccaagaggaattgataatcgtagaagtggagtaatttcatctcaagctgtcgattagatactgaatttcgaagttaatttcaccttattgtatctaatcatggcggcttacagagccgacgatgactacgattatctgttcaagttagttctgatcggagactctggtgtcggcaaatcgaatttgttgtctagatttgctaaaaacgagttcaatctcgaatcgaagtcaactatcggcgtcgaattcgcgaccagaagtattcgtgtcgatgacaaaattgtcaaggctcagatttgggatactgctggccaagaaaggtaccgagcaatcacaagcgcgtattaccgcggcgcggtgggagcgctattagtctacgacacctcacgccacgtcaccttcgagaacgtcgaacgttggttaaaggagcttcgcgaccacacggactcaaacatcgtgataatgttggtaggaaacaagtccgatttgcgacacttgcgcgcggtccccaccgaggaagcaagggcatttgcggaaaaggaaaatacgtattttatggaaacgtcagctctcgaagctttgaatgttgaaacggcttttaccgaagtgttgactcaaattcatcaagtggtgagtagaaaagcgctcgatgcgggagacgatccctcggctttgcctaaaggacagacgattagtgtgggaggtaaggatgacgtgtccgcggttaagaaagttggttgttgttcggcttgaggggtattatgggaaatttgtgagttgttgtgtttttaggatttgagacggttttgttgaattggacttggaaatgagtttgatcttgcaaattcattattgatggttttgtatt

SEQ ID NO: 3463 - DNA, 778 bp, Cirsium arvense
tttttgaaaaaacctaatttcacctttaattctatacatctaaatcatggcggcctacagagccgatgacgactacgattatctcttcaagttagttctgatcggcgactccggtgtcggaaaatcgaatttgctctctagatttgctaagaacgagttcaatctcgaatcgaagtcaactataggcgtcgaattcgctactagaagtattcgtgttgatgataaaatcgttaaggctcagatttgggatactgctggccaggaaaggtaccgtgcaatcacaagtgcatactacagaggtgccgttggtgctttgctcgtctacgacacatcacgccatgtgacctttgagaacgttgaaagatggttgaaagagcttagagaccacaccgatgcaaacatagtaatcatgctggtggggaacaagtcagatttgcgtcacttgcgtgcggtccccacagaggaggcaaagacgtttgccgagaaggaaaacacatatttcatggagacatcagctctggaggctttgaacgttgaaacggccttcaccgaagtcctgacacagatataccacgtggtcagccgaaaagcactagatgcagccaacgatgcttcggctctgcctaaagggcaaaccatcaatgtgggatccaaagatgatgtttctgctgtgaagaaagttggttgctgttctgcttaacaaaagatttgggaatggtggttcttgaaatgagtttgagcatgcaagttcattggtagggtataaagtataaggtgc

SEQ ID NO: 3464 - DNA, 893 bp, Fagopyrum esculentum
tcgtaatatatcgtaacaatcaatcaaggttgaaagatccttcgattagatgggtgcattcagagcggatgatgattatgattacttgttcaaggtggttctgattggagattccggtgtcggaaaatccaatctcctctctcgtttcacccgcaatgagttcagcctcgaatccaaatccaccattggtgttgagttcgccactcgtagcattcgtgtcgatgacaagatcgtcaaggctcagatttgggatactgctggccaagaaaggtaccgcgccatcacgagtgcatactaccgaggagcggtgggtgcattagtagtgtacgatgtgactcgccatgtgacattcgaaaacgtggagagatggctcaaggagctccgggatcacaccgacgccaacatcgtcataatgcttgttgggaacaaatccgatttacgacacttgagggcggtgacattggaggattctaagggatttgcagagagggagaacactttcttcatggaaacttcagctctggaggctttgaatgtcgagagtgcttttacagaggttctttctgagatctaccatgttgttagcaggaaggcactcgacattggagatgatccttctgctgtccccaaaggacagactattaatatcaataaagatcatgatgttaatgctgcggaacaaggtggatgttgttccagctagggaagatgaataaacaagagaggacttataattgttcatactagtgtcctatagaggaattcaagaaatgaaaacagaatcttatatgcatagtgaatgatgtatgtagaagctgatcattctgattaacactctcttgcagttgattccaatttcgtttccctctgaatctgatgatgatacatattca

SEQ ID NO: 3465 - DNA, 823 bp, Flaveria ramosissima
tcacatactccattaattcaatctcaaatctccatcaaattacttcactttcgaacccaatttcaccttgttgcatcaatcatggccgcttacagagctgacgatgactacgattacctcttcaagttagttctcatcggagactccggtgtcggaaaatccaacttgctctcaaggttcgcgaagaacgagtttaacctcgaatcgaagtcaaccatcggggtcgaattcgccaccagaagtattcgtgttgatgacaagattgttaaggctcagatttgggatactgctggtcaggagaggtaccgtgcgatcacaagtgcatactacagaggagctgttggagctttacttgtgtatgacacatcacgccacatcacctttgagaacgttgagcggtggttaaaagagctacgtgaccacacagactcgagcattgtgataatgttggttggaaacaaggcggacttacgccacttgcgtgcagtcccaactgaggaagcaaaaacctttgctgaaaaagaaaacacttatttcatggagacatcagctctggaagctttgaatgttgaaaccgcttttacagaagtccttacacaaatttatcatgtggttagccggaaagcacttgatgcaggtaatgatccttcagctttgccgaaaggtcaaaccattaacgtggggtcaaaggacgacgtttctgctgttaagaaagtcggttgctgctctgcgtaagaatgtttttgtttaggatttgagacagttttgagcctgcaagttcactgatattgtctaaagttgtgaattttagtcttggattgtt

SEQ ID NO: 3466 - DNA, 847 bp, Flaveria ramosissima
tttcgaaaagcgtccccgcttctctctctctccggtgaatctcgttgatcaagatttcaataatcttcagataaacaaaccccaatcgaatcaacaatcactaaattcgccataattcactctcaatctctccatcaatcactcaattctcgaagctcacaccacctaccatggcggcttacagagccgacgacgactacgattacctcttcaagttagtcctcatcggcgactccggcgtcggaaaatcgaacttactatcgagattcgcgaagaacgagttcaatctcgaatcgaagtcaacaatcggagtcgaattcgccaccagaagcattcgtgttgatgataaaattgttaaggctcagatttgggataccgctggccaggaaaggtatcgtgcgattacaagtgcgtactacagaggagccgttggggcgctggttgtgtacgatacgtcacgccacgtgacctttgagaacgtggcgaggtggttgaaagagcttcgtgatcacacggactccaacattgtgataatgttggtaggaaacaaggctgacttacgacacttgcgcgctgtgcccactgaggaggcaaaagcgttcgctgaaaaggagaacatttactttatggagacatcagctctcgaggctttgaatgttgaaactgcgttcacagaagttcttacacatatataccatgttgtaagccgaaaagcgcttgaagctggtgatgatccttcggctttgcctaaagggcaaacgattaatgtggggtctaaggatgatgcatctgctgtcaagaaagttggttgctgttctgcttaaggatgccctaaggcttatctgag

SEQ ID NO: 3467 - DNA, 1071 bp, Lactuca sativa
ctagaaaccaacaatcaccacaatttgaggtagatcaggttgagttgggttgtgtcacatccgacatttaatttaaatacatatcaccttttaacctctattttcctttacatctttctctctctctctctcctatatacaacggcaaccgttacaacgatcatctaaaattatgtgatcggatcagacaaaagaaaacttctatcatcatccaatcttggatctcttttctcacatttctctgcatcacctaatcttcctcatcttctccatgaacacagttgcgatctccctttagagaaatgggggcgtttcatgcagatgatgattacgattacttgttcaaggttgttttgatcggggattcaggtgtcgggaaaaccaatcttttatcacgattctccaagaacgaattcagccttgaatccaaatcaaccatcggggttgaattcgccacccgtagcatcaacgttgatgacaagatcatcaaagcccaaatatgggacaccgcgggtcaagaaaggtatcgggccataactagcgcgtattatcgaggagcggtaggtgcattgatcgtctacgacatcacacgtagtataacatttgaaaatgttcaaagatggttgaaggagcttcgagatcacacggatcaaaacattgtgatcatgctcgtggggaacaaagcggatctacgtcatttacgtgtggttcaaatggatgatgcaaaggcatttgcagaaagagagaataactttttcatggaaacatcggctcttgaatcgttaaatgtcgagaatgctttcaccgaagtgttgactcagatttatcatgtggtgagcaagaaagcacttgatattggtaatgatcccatggttgtacccaagggacaaacgattaatgttggaggtaaagatgatgtatctgctgttaagaaagcggggtgttgctctaattgatgttttaggttgaataatatatatgtgttttgtgtagtgttaaggatttcttggtgaagaatatgtaaaatatttcaaggtttaatttaatttgtttatgctatattttcatata

SEQ ID NO: 3468 - DNA, 1099 bp, Sesamum indicum
ggagcatcaacagtccccctaaataaacggggggaaagggacgcaaacaaccagactttctaaatcctcccagaaaataaacaaagaatttctctggaaattaactctaatgaaaacacaatcacaataaccacagctgtttgtcaaagaagaaaaataagacaatgggggcgtacagagcggatgaagattacgattacctgttcaaggtggtgctgattggtgattccggcgtcggaaaatccaacctattgtcccgcttcaccaagaatgagtttagccaggagtcgaaatccaccatcggcgttgagttcgccacgcgttccattcaagttgatgacaaggttgtcaaggcccagatttgggacaccgccggccaagaaaggtatcgtgcaattactagcgcctattacagaggagcagtcggggccttactcgtctatgatgtcactcgcaacgtgacattccagaatgtggaaagatggttgaaggagcttcgaggccacacagacaccaacattgtgatcatgctggtaggaaacaaggcagatcttcgtcacctgcgagccgttcccacacaggaagccaaagattttgctgaaagggaaaaaacctttttcatggaaacttcagctctcgaagctttgaacgttgatcaagcattcacagaagttttgacacaaatctatcatgtggtgagtaggaaggctcttgacattggggatgaccctactgcactgcccaagggacaaacaattaatattggatcaaaagatgatgtatcagctgtgaagaatactggatgctgctcttaatgtagagctgctcaagtaaccagtccacaagggtgtataatagaaaccaaattgatttgtttcttttagagttaatattcacagaaacaagtagtaaatcttatacttaattggaaaggggggatgtaaacactggacacacagctagggatgaaaaacatgtaatatgagtcaaccaatatgtttctctgttggtttcaactaaggtacttcacagttctctctgcccctttattggctttcgtgcgctggtcttgcgctaaaatctgttatatttgcagccc

SEQ ID NO: 3469 - DNA, 981 bp, Helianthus annuus
ggcgggggatatttttgatcttcttattttcgaacgcgtacgcgcctctcgtgaatcttgtcgatcagattctgaaaatctccgaacgaactcttttaaacgaatctacaatcctaaacctgcataatccattctccattagataccaaattctctgttaatggcggcatacagagctgacgatgactacgattacctcttcaaactagtcctgatcggagactctggtgtcggtaaatctaatttactttctagatttgctaaaaacgagttcaatctcgaatcaaagtccacgattggcgttgaattcgccactagaagtattcgtgttgacgataagattgttaaggctcagatttgggatactgctggtcaagaaaggtaccgcgcaattacaagtgcatactacagaggagctgttggagcattacttgtgtatgacacgtcacgccacgtcacctttgagaacgttgagcgatggctaaaagagcttcgtgaccacacggactcaaacattgtgatcatgttagttggaaacaaagctgacttacgccacttgcgtgcagtccccaccgaggaagcaaaaacatttgctgaaaaagagaacacttatttcatggagacatcggctttggaggctttgaatgttgaaaccgcgtttacagaagtccttacacagatttatcatgtggttagccgaaaagcacttgatgcagctaatgatccttcggatttgccgaaaggccagaccattaacgtggggtcaaaggacgatgtttctgctgtcaagaaagtcggttgctgctctgcttaaggatgttttttaaggattgagacagttttgaactctagtcttttggattattgaagacaagacagtgattgaactgagaatcatcttgttgggtctcagactttgttaagtaacatatgtgatttctataatattcaagagacatgttttgatttctataatatttt

SEQ ID NO: 3470 - DNA, 837 bp, Flaveria ramosissima
tttcgaaaagcgtccccgcttctctctctctctccggtgaatctcgttgatcaagatttcaataatcttcagataaacaaccccaatcgaatcaccaatcactaaattcgccataattcactctcatcaaacactcaattctcgaagctcacaccacctaccatggcggcttacagagccgacgacgactatgattacctcttcaagttagtcctcatcggcgactccggcgtcggcaatcgaacttactttcgagattcgcgaagaacgagttcaatctcgaatcgaagtcaacaatcggcgtcgaattcgccaccagaagcattcgtgttgatgataaattgttaaggctcagatttgggataccgctggccaggaaaggtatcgtgcgattacaagtgcgtactacagaggagctgttggggcgctggttgtgtacgacacgtcacgccacgtgacctttgagaacgcggcgaggtggttgaaagagcttcgtgatcacaccgacgccaacattgtgataatgttggtaggaaacaaggctgacttacgccacttgcgtgctgtgcccactgaagaggcaaaagcgtttgctgaaaaggagaacatttactttatggagacatcagctctcgaggctttgaatgttgaaatcgcgttcacagaagttcttacgaatatataccatgttgtaagccgaaaggcgcttgaagctggcgatgatccctctgctttgcctaaagggcaaacgattaatgtggggtctaaggatgatgcatctgctgtcaagaaagttggttgctgttctgcttaaggatgccctaaggcttatctgag

SEQ ID NO: 3471 - DNA, 1107 bp, Musa acuminata
cgcctcctccgaagcgtttcctccgcaagacgagccgttcccgcttacttcgagacgaagcaacagcggactcggattcctccggtcagtaagcgacacagagctcggatccggtcagcgagagaagcggcgacgtttgcgttgtcggcggcgccggtggcggtggcagaggaatggcctacaggtcggatgacgactacgactacctcgtcaaggttgtgctcatcggcgactccggcgtcgggaaatccaacctcctctcccggttcacccgcaacgagttcaacctcgagtccaagtccaccatcggcgtggagttcgccacccggagcatacgcgtcgaggataaggtcgtcagggcgcagatttgggacacagccggtcaagaaaggtaccgagcaatcactagtgcatactaccgtggagcagtcggcgcacttcttgtctatgatgttactcggcatacaacgtttgaggctgtggagagatggttgaaggaactaagggatcacactgactctaacattgtaattatgcttgtgggcaacaaagcagacttacgccatctgagggctgttactgttgatgacgcaaaggcttttgccgaaagggaaaataccttctttatggagacatctgctttggaatcgatgaacgtagataatgccttcaccgaagtgctcactcagatctatcgtgtgacgagaaggaaggcacttgatgctggtgatgacccagagacgttgcctaagggtcaaacgatcgacattggcaccaatgacgatgtatctgctgttaagaaagccggttgctgctcagcttagctcactcggggggaacagatacataaatgttaggaggtttggcaggtttgtacactttgatatttggtttttggatctgctggtacgacacagttggcaacagtgatcgttttctacaccaaaaaagcatttgattcgttttgtactgttgtatcgtggttaccttcatccgagtatataattcggtaatgattgtgttttagtaaatattgtaacaagtaactttgttgattcttctgacatttctctttttcatgtatgttgccattatgcaccctccccc

SEQ ID NO: 3472 - DNA, 897 bp, Echinochloa colona
cagcaccgttcggcgaggcgaaggcatggcgggggcgggggagaaggtggactacgtcttcaaggtggtgctgatcggcgactcggcggtgggcaagtcgcagatcctggcccgcttcgcccgcaacgagttcagcctcgactccaaggccaccatcggggtcgagttccagacccgcaccctcgtcatcgacaagcgcagcgtcaaggcccagatctgggacaccgccggccaggagaggtatcgagcaattacaagtgcgtactatcgaggggctgttggcgcacttgttgtgtacgacgtaacacgccatgtgacctttgagaatgtggagaggtggttgaaggagctccgggatcacacagatgcaaacattgttatcatgcttgtcggcaacaaggcagatctgcgacatcttagggctgtatctgtggaggatgccaaaggctttgctgagagggaaagtactttcttcatggaaacttctgcactggagtccatgaacgttgagagcgcattcaccgaggtcctaactcagatctatcgtgtggtcagcaagaaggccctcgacattggcgatgaccctgctgctccaccaagaggacaaaccatcaatgttggaggcaaggatgatgtctctgctgtgaagaagtcagggtgttgttcatcctaagtcccttatgaccatgaaaaggaaccatatgctcatcagaccatatgattggttactgaaaatacgactcccttgtgctgcctaacctggttggttatgagattatgttggtacagcagaaaaatgatttagaggttaagaatttaattccaggttgggacaaaaactagctttttgcagtgtcattgatattcatggtttccttgtatggtttatatgcaccg

SEQ ID NO: 3473 - DNA, 1247 bp, Musa acuminata
atttattgtaaagtgcgaagggaaagagacgcccgtcgcgcctcctccgaagcgtttcctccgcaagacgagccgttcccgcttacttcgagacgaagcaacagcggactcggattcctccggtcagtaagcgacacagagctcggatccggtcagcgagagaagcggcgacgtttgcgttgtcggcggcgccggtggcggtggcagaggaatggcctacaggtcggatgacgactacgactacctcgtcaaggttgtgctcatcggcgactccggcgtcgggaaatccaacctcctctcccggttcacccgcaacgagttcaacctcgagtccaagtccaccatcggcgtggagttcgccacccggagcatacgcgtcgaggataaggtcgtcagggcgcagatttgggacacagccggccaagaaaggtaccgagcaatcactagtgcatactaccgtggagcagtcggcgcacttcttgtctatgatgttactcggcatacaacgtttgaggctgtggagagatggttgaaggaactaagggatcacactgactctaacattgtaattatgcttgtgggcaacaaagcagacttacgccatctgagggctgttactgttgatgatgcaaaggcttttgccgaaagggaaaataccttctttatggagacatctgctttggaatcgatgaacgtagataatgccttcaccgaagtgctcactcagatctatcgtgtgacgagaaggaaggcacttgatgctggtgatgacccagagacgttgcctaagggtcaaacgatcgacattggcaccaatgacgatgtatctgctgttaagaaagccggttgctgctcagcttagctcactcggggggaacagctacataaatgttaggaggtttggcaggtttgtacactttgatatttggtttttggatctgctggtacgacacagttggcaacaacagtgatcgttttctacaccaaaaaagcatttgattcgttttgtactgttgtatcgtggttaccttcatccgagtatataattcggtaatgattgtgttttagtaaatattgtaacaaagtaactttgttgattcttctgacatttctctttttcatgtatgttgccattatgcaccctccccctcactagtcaaaatattcaagagatacgtttgagtcaataagcagccccctgttactgaatgtggccatctatggcacaaagatcacgtttgcatttt

SEQ ID NO: 3474 - DNA, 839 bp, Brassica oleracea
ttacccaagaatcttcctatggcgacgtatacagctgacgacgattacgatttcctctacaaggtggtactaatcggagactccggcgtcggcaaatccaacctcctctctcgattcacccgcaacgagttcagcctcgagtccaaatccaccatcggcgtcgagttcgccaccagaaccattcacgtcgacgacaaaatcgtcaaagctcagatttgggacaccgccggtcaagaaagataccgagcgatcactagtgcatactatcgaggagctgtaggagctctacttgtgtacgatgttacacggcatgtgacgtttgagaacgttgagaggtggctcaaggagcttagggaccacactgacgccaacattgttattatgctcgttgggaacaaggctgatctgcgtcatctcagagctgtttctaccgaggatgctacagcctttgcggagagggagaagactttctttatggagacgtctgcgcttgaagctttgaatgtggaggatgctttcacgcagctgctttctcagatataccgtgtggctagcaagaaggctttggatgttggtgatgatgatcggtctggtgtccctaaaggacagagtgttaatgtcgggtctaagggggatgtgtctgaggtcaagaagatcggttgctgctcaagttgatctcaaattttagaggaactatgttagtttgagtatctatggaacagatgattcctcccttgtgtagttacttttggtgtaagtttctcaagatctttataatggtctgtctatgtttacatgatcatattagataatctatgaacataaaagggtgctttaga

SEQ ID NO: 3475 - DNA, 821 bp, Arabidopsis thaliana
tagaaccaaaaaaaataaaaataaaacgcatttgggatttctcattgtcatcccaagttcttggaacagccaaatactttttcattattagtttataatcgtctcataaaggcaaaaaggtttatttcggaaataagatgggagcatatagagcagaagacgattatgattacctcttcaaggtggtcttaaccggagattccggcgtcgggaaatctaatttgttatctcgtttcaccagaaatgatttcagccacgactcacgtgcaaccatcggtgtcgaattcgccacacgaagcatccaatgcgatgataagatcgtcaaggctcaaatatgggataccgccggccaagaaaggtaccgagccatcacgagcgcttattaccgaggagctgttggtgcattgcttgtttatgacgtgacgcgccacgtgacattcgagaatgttgagagatggctaaaggagcttagggaccacacggacgcaaacattgtgatcatgctcgttggcaacaaagctgatcttcgtcaccttcgagccatctcaaccgaagaagctaaagcttttgcagagagggagaatacctttttcatggagacttctgcacttgaagctgtgaatgttgataatgctttcactgaagttctcactcagatttacagagttgttagcaagaaggctcttgaagctggagatgatccaaccactgctttgcctaaaggacagatgattaatgttggaggccgagatgatatctcagccgttaaaaaacctggttgctgctctgcatagacacacttctcacttttttcttgtact

SEQ ID NO: 3476 - DNA, 1014 bp, Capsicum annuum
ttgaatttagcaacactttactttccaacttttactttcctgaaaactctcatcttctcattccttctgctttgttattgtttagtacgaaaaaatatcaagatattcgagtaactataagtaatggcaggtggatatagagctgaagatgattatgattatctattcaaattagtgttaattggggattctggtgttggcaaatctaatctcctttctcgattctcgaggaacgagttcaatcttgaatctaagtctactattggtgttgaatttgctactcgaagtattcgtgttgatgataagatcgttaaggctcagatttgggatactgctgcccaagaaaggtaccgtgcaattacaagtgcatactacagaggggctgtcggtgcattgcttgtgtacgatatcactcgacatgtcacatttgaaaatgttgagagatggttaaaagagcttcgagaccataccgaccaaaatattgtcataatgctcgttgggaacaaggccgacttacgtcacttgcgtgctgttacaatagaggatgccaaggcctttgctgaaagagagagtaccttctttatggagacttcagcacttgagtccttgaatgttgagaatgcatttaccgaagtattgaccgagatatacagggtggtctgtcggaaagcacttgaagttggagacaatcctgctgcgttgtctaaggggcaaacgataaatgttggcaaggatgatgtttcagctgttaaaaaagttggttgttgcaatgtctaagcaaaaaatcaagaaatccaaatgcttactacaaccagcaaatgctcctactattgttgcattgtgtattctcagttttgaatcttttaggaaatgatgtatctacttatatattattccacctctgtattgtttcatcaacctactttgagtttgtactaccctatttgttaccttctttgactcttgcatcttgcctcttatttcacaaaattcaaggcagtcttgccctcgtgc

SEQ ID NO: 3477 - DNA, 876 bp, Raphanus sativus
ggtgagaaaacgtcaaaacaaaaaaaacagaacagaactaatgttttagaagtattgtcatcccaagttcttggaacattcaaataaaaaacattatttcattgttgaatataactggtctcaagaacaaactcattaagacaaaacatgggagcatatagagcagaagatgattacgattacctcttcaaggtggtattaaccggagactctggcgtgggaaaatccaatctgttgtctcgtttcaccaggaatgacttcagcaacgactcacgtgccaccattggtgttgagttcgccacgcgtagcatccaatgcgacgacaagatcgtcaaggctcagatatgggataccgctggccaagaacggtaccgagccatcacgagcgcatattaccgaggagccgtcggtgcgttgctagtttacgacgtgacgcgtcacgtgacgttcgagaacgtcgagagatggctaaaggagctgaggtaccacaccgacgcaaacattgtgataatgctcgttggtaacaaagctgatctccgtcatcttcgagccatctctaccgaagatgccaaggggtttgcggagagagagaatacttttttcatggagacttctgcgcttgaggcactgaacgttgagaatgcgttcacagaagttctcacggagatttacagagtggttagcaagaaagcgctcgaagctggagatgatccaaccactgctttgcctaaggggcagacgattaacgtcggaggcagagatgatatctcggctgttaaaaaacctggttgctgctctgcttaatacactttgtcttctatttctttcttgtatttttatttattccaacatcaacattttcactaatttcttgca

SEQ ID NO: 3478 - DNA, 731 bp, Taraxacum officinale
tatattatctcaattgtccattaggtaccgaatttcgaagttaagtttacattattgtatctaatcatggcggcttatagagccgacgatgactacgattatctgttcaagttagttctgatcggagactctggagtcggtaaatcgaatttgctttctagatttgctaagaacgagttcaatcttgaatcaaagtcaactatcggcgtcgaattcgctaccagaagtattcgtgttgatgacaaaattgtcaaagctcagatttgggatactgctggtcaagaaaggtaccgagcaatcacaagcgcgtactaccgtggcgcagtgggggccctactagtctacgacacatcccgccacgtcacctttgagaacgtggaacggtggctaaaagagcttcgggaccacacagactccaacatcgtgataatgttggttggaaacaaatccgacctccgccacctccgcgcggtccccacagaggaagcaagggcgtttgcggaaaaggaaaacacgtattttatggaaacgtctgctctcgaagccttaaacgtcgaaacggcttttactgaggtgttgactcagatacatcatgtggtgagtaggaaggcgattgatgcgggggatgatcccgcagggttgcccaagggacagacgattagtgtcgggagtaaggatgatgtgtccgcggttaagaaagtcggttgttgttccgcgtaatatggttttac

SEQ ID NO: 3479 - DNA, 930 bp, Fagopyrum esculentum
agcaaaatatacagatggcatatttggcggatgacgattatgattacttgttcgaggtggtgctcataggcgattccggggtcggaaaatccaaccttctctcccgtttcacccgcaatgagttcagcctcgagtccaaatccaccatcggcgtcgagttcgccactcgtagcattactgttgatgacaaggtcgtcaaagctcagatctgggacaccgccggccaagaaaggtatcgagcaatcaccagcgcgtattacagaggagcagttggggcattggttgtatacgacatcacccgccacatcacatttgacaacatcgagaggtggttgaaggagctccgggatcatacagacaccaacattgtcgtaatgctggtggggaacaaggcagatttacgacacctgaaagccgtctccacaagcgaagctaatagtttcgcggagagggagaacaccttcttcatggaaacctcggcgttagaatcgttgaatgtcgaaaacgcgtttaaggaggtgttggcacagatataccatgttgtgagcaggaaggcgcttgatattggggatgatcctgctgcaatgcctaagggaaagaccattgatattagtggtaaagatgaaataacggcggtagaaggtggttgctgttcaagttaagtttagttgacaaacactttaaagatcaatactggtgacctgagtttttgttcattcaaattcactagttgcaactttgtattcttcttcttcaagtgttgtccttttcaacaagtcttaattgtgacttgttgcaatgcaagtttgtattcttcttcttaaagtgttgtccaatccagcaagtctttagggtgtagttgttttgtcatttaaatcctcttttttctagtttaatttaaaattgtaaataaattgcatttggttggtc

SEQ ID NO: 3480 - DNA, 893 bp, Flaveria ramosissima
tcacatactccattaattcaatctcaatctccatcaaattacttcactttcgaacctaatttcaccttgttctatccaatcatggccgcttacagagctgacgatgactacgattacctcttcaagttagttctcatcggagactccggtgtcggaaaatccaacttgctctcgaggttcgcgaagaacgagtttaacctcgaatcgaagtcaaccatcggcgtcgaattcgccaccagaagtatacgtgttgatgacaagattgtcaaggctcagatttgggatactgctggtcaggagaggtaccgggcaattacaagtgcatactatagaggagctgttggggctttacttgtgtatgacacatcacgccacatcacctttgagaacgttgagcggtggttaaaagagctacgcgaccacacagactcgagcattgtgataatgttggttggaaacaaggcggacttacgccacttgcgtgcagtcccaactgaggaagcaaaaacatttgctgaaaaagaaaacacttatttcatggagacatcagctctggaagctttgaatgttgaaaccgcttttacagaagtccttacgcaaatttatcatgtggttagccggaaagcacttgatgcaggtaatgatccttcagctttgccgaaaggtcaaaccattaacatggggtcaaaggacgatgtttctgctgttaagaaagtcggttgctgctctgcgtaagaatgtttttatttaggatttgagacagttttgagcctgcaagttcactgatattgtctaaaattgtgaactttagtcttgaattgttatatacatgacaagaattgaactgagaatgatcttgttgggtttaagactctattaagtaacatatgtga

SEQ ID NO: 3481 - DNA, 1008 bp, Helianthus annuus
aatcttgtcgatcagattctgaaaatctccgaacgaactcttttaaacgaatctacaatcctaaacctgcataatccattctccattagataccaaattctctgttaatggcggcatacagagctgacgatgactacgattacctcttcaaactagtcctgatcggagactctggtgtcggtaaatctaatttactttctagatttgctaaaaacgagtttaatctcgaatcgaagtcaacgattggcgttgaattcgccactagaagtattcgtgttgatgataagattgttaaggctcagatttgggatactgctggtcaagaaaggtaccgcgcaattacaagtgcatactacagaggagctgtcggagcattactagtgtatgacacgtcacgccacgtcacctttgagaacgttgagcgatggctaaaagagcttcgtgaccacacggactcaaacattgtgatcatgttagttggaaacaaagccgacttacgccacttgcgtgcagtccccaccgaggaagcaaaaacatttgctgaaaaagagaacacatatttcatggagacatcggctttggaggctttgaatgttgaaaccgcgtttacagaagtccttacacagatttatcatgtggttagccgaaaagcacttgatgcagctaatgatccttcggatttgccgaaagggcagaccattaaggtggggtcaaaggacgatgtttctgctgttaagaaagtcggttgctgctctgcttaaggatgttttttaaggattgagacagttttgaactctagtcttggattattgaagacaagacagtgattgaactgagaatcatcttgttgggtctcagactttgttaagtaacatatgtgatttctataatattcaagagacatgttttgatttctataatattttctttccaaatctctcttgatttctctttcaagtgctctacatacttgtttattgtcttgacagttccacttagcagtgcaca

SEQ ID NO: 3482 - DNA, 777 bp, Valeriana officinalis
gtggttctcataggcgactccggtgtcggcaaatccaatctcttatccaggttcaccaaaaatgagtttagcctcgaatctaaatccactattggcgtcgaattcgctactcgcagtattcgcgtcgatgacaagatcgtcaaggcccagatttgggataccgctggccaagaaaggtaccgagcaatcacaagcgcatactacagaggtgcagtgggagcgctgctagtgtatgatgtcacacgccacgttacctttgagaacgtggagagatggttaaaagagcttcgtgatcacacggattccaacattgtgatcatgctagtaggaaataaagctgatctgcgacatttgcgtgccgtgtcagttgaggatgcaaagtcatttgcagagaaagaaaacaccttcttcatggaaacatctgctctagagtccatgaatgtcgagaattccttcactgaagtgctcacacaaatctaccacgttgttagtcggaaagccctagatattggggatgatcataccactttgcctaaaggacaaaccatcaatgttggatctaaggacgatgtttctgctgttaaaaaggctggttgttgttccacttaattcgaatttcatttcatttttccctctcctttgccgttctcttttattgtttttatttgttttatactggattagttctttgtattttattggattatgtctagtgattcagatagctcttcattttgtaacttaacgattagtagtttatgtgattttcgatttagg

SEQ ID NO: 3483 - DNA, 800 bp, Euphorbia peplus
ctcatatcttttttcgtctacgcattgaaatttcaaaatcgcctgatctccattttcgataatccagagaaaaagagagggaaatttcaatccaggttaaatgggagcttacagagcagacgatgattacgattacttattcaaagtagtcttaataggcgattctggtgtcgggaaatcaaatctcttgtcgagattcacgagaaatgaattcagccttgaatccaaatccacaatcggcgtagaattcgccactcgcagcatccatgttgatgacaaggttgttaaggctcagatttgggatactgctggccaagaaaggtaccgtgcaatcacgagtgcgtactaccgaggagctgtgggtgccttagttgtctatgacgttactcgaagggtcaccttcgagaacgtggagagatggttgaaggaactccgggaccacacggattccaacatagtgataatgctagttggaaacaaggcggatttgcgccatttacgagcagttacaacagaagattccactgcttttgctgagaaagagaacacctttttcatggaaacctctgctctcgagtccctaaacgtggaaaatgctttcacggaagtactcactcagatatatcgtgttgttagccggaaagctcttgatattggggatgacccgacttctttgcccaagggacagactattcatgttgggaaagacgatgtttctgctgtcaagaaagtcgggtgctgctcggcgtccagtttttctttcttaaaagatttgcattttggtgatttggagctgcctt

SEQ ID NO: 3484 - DNA, 714 bp, Arabidopsis lyrata
aaagacaaagaggtttctatcggatagaaaatgggagcatatagagcagaagacgattacgattacctcttcaaggtggtcttaaccggagattccggcgtcggaaaatctaatttgttatctcgtttcaccagaaatgatttcagccacgactcacgtgcgaccatcggtgtcgaattcgccacccgtagcatccaatgcgatgataagattgttaaggctcaaatctgggataccgccggccaagaaaggtaccgagccatcacgagcgcttattaccgaggagccgttggtgcattgcttgtttatgacgtgacgcgtcacgtaactttcgagaacgtcgagagatggctaaaggagctaagggaccacacggacgcaaacattgtgattatgctcgttggtaacaaagctgatcttcgtcaccttcgagccatctcaactgaagaagctaaggcttttgcagagagagagaatacctttttcatggagacatctgcacttgaagcagtgaatgttgataatgctttcaccgaagttctcactcagatttacagagttgttagcaagaaggctcttgaagctggagatgatccaaccaccgctttgcctaaaggacaaatgattaatgttggaagccgagatgatatctcagccgttaagaaacccggttgctgctctgcatagacacacttctcacttttttcttgtatt

SEQ ID NO: 3485 - DNA, 1000 bp, Brassica rapa
gattcttccttaatcctcataatggcgacgtatacagctgacgacgattacgatttcctctacaaggtggtactaatcggagactccggcgtcggcaaatccaacctcctctctcgattcacccgcaacgagttcagcctcgagtccaaatccaccatcggcgtcgagttcgccaccagaaccattcacgtcgacgacaaaatcgtcaaagctcagatttgggacaccgccggtcaagaaagataccgagcgatcactagtgcatactatcgaggagctgtaggagcattacttgtgtacgatgttacgaggcatgtgacgtttgagaacgttgagaggtggctcaaggagcttagagaccacactgacgccaacattgttattatgctcgttgggaacaaggctgatctgcgtcatctcagagctgtttctaccgaggatgctacggtctttgcggagagggagaagactttctttatggagacgtctgcgcttgaagctttgaacgtggaggatgctttcactcagctgctttctcagatataccgtgtggctagcaagaaggctttggatgttggtgatgatgatcggtctggtgtccctaaaggacagagtgttaatgtcgggtctaagggggatgtgtctgaggttaagaagattggttgctgctcgagttgatctcagattgtttagaggaactatgttagtttgagtatctatggaacagatgattcctcccttgtgtagttacttttggtgtcttcttgttccttcttttggtgtaagtttctcagatctttataatgttctgtttatgtttacatgatcatattagataatctatgaacataaaagtgtgctttagatgaatgcaaaactatacttcagagtagcaaaccagcctgtacagttttcttagtcactgagccactatttttacaggtttactctgtttctcttatgaaaccattttacaaaagcatgtccaaaacaccatgtg

SEQ ID NO: 3486 - DNA, 1584 bp, Brassica rapa
caaaacaaaaacaacagaacaaaaccaatgtcttggaacatccaaataacattttttcattgttgaatataacttgtctcaataacaaactcataaagaccaaaaaaaaagagaggttaagttttggacagaagatgggagcatatagagcagaagatgattatgattacctcttcaaggtggtcttaaccggagactccggcgtggggaaatctaatctgttatctcgtttcaccagaaatgacttcagcaacgactcacgtgccaccatcggtgttgagttcgccacacgtagcatccaatgcgatgacaagatcgtcaaggctcaaatctgggataccgccggtcaagaaaggtaccgagccatcacgagcgcatattaccgaggagccgttggcgcgttgctagtctacgacgtgacgcgtcacgtgacgttcgagaacgttgagagatggctaaaggagctaagggaccacaccgacgcgaacattgtgataatgctcgttggtaacaaagctgatcttcgtcaccttcgagccatctctaccgaagatgccaaggggtttgcggagagagagaacacgttcttcatggagacatctgcgcttgaagctctgaacgttgagaatgccttcaccgaagttctcactgagatttacagagtggttagcaagaaagcgcttgaagctggagatgatccaaccactgctttgcctaaaggacagacgattaacgtcggagatatctcggctgttaaaaaacctggttgctgctctgcttagatacacaaccattgtattttatttattaaacatttaacattttcactaatttcttgcacatttgtatacatacatacattcttggaaaatcatcagacaaacaaagtttttttcttgttaagtttatactctacaatggcttgctttgtgatctcatctcccaccctccctctttctctctacttcgaaaagatcgatgattcttgtagatgtgccattgttaatgcaacatctctcatctcacgactgcatttccccatctgcaacaaaaacaacctgatcagtttataagagttgagcgtggaagcccaactaaacatgcttttgatatgtttattccaattgcaagatatgtcttgtaatgactaatgacaaagctaaatacagttccaaatcaatcctaatctcataatcaataagatatataacatgaaactcacctggagaatcatttctcttcatcgggtttaggagacttagaactcgattggagtgaaggaagaggattagagcctttgatgatccaaccgagtccgaagaagacgcctccggcgagaatcgcagtgccccaagcgtgtgagtaccacttgctgtactgccttatcgcgaacttccactgctccctcagcgtcgcctgatccggattcaccgactctggccggttaggatacgtcatcctctgtcccgagaagctcgaattcgatccgatctccgccgccggtttcttcgccgacgaagaagaagcggcgttgttgttgttgttatcggggatttggctcttctcagacattgtcgtcgtcgt

SEQ ID NO: 3487 - DNA, 933 bp, Eutrema halophilum
aaaacaaaactaattgtttttagaacccaaaaaaaaaacatttgggaattgaagatcgtcatcggaagttcttggaacagccaaataactttttgtcattgtttgtctaaagagaacaacctcataaagcaaaaagaggttaaagtttggagagaagatgggagcatatagagcagaagacgactatgattacctcttcaaggtagtcttaaccggagattccggtgtcggaaaatctaatctcttgtctcgtttcaccagaaacgacttcagccacgactcacgtgccaccatcggtgtcgaattcgccacacgtagcatccaatgcgacgataagatcgtcaaggctcaaatctgggatactgccggccaagaaaggtatcgagccatcacgagcgcatattaccgaggagccgttggtgcgttgctagtctacgacgtgacgcgtcacgtgacgttcgagaacgtagagagatggctaaaggagctacgggatcacacggacgcaaacatcgtgataatgctggttggtaacaaagctgatcttcgtcatcttcgagctatctcaacagaggaagctaaggcgtttgcagagagagagaatacctttttcatggagacctctgctcttgaagctgtgaatgttgataatgctttcaccgaagttctcactcagatttacagagtcgttagcaagaaggctcttgaagctggagatgatcctaccactgctttgcctaaaggacagatgattaatgtcggaagccgagatgatatctcagccgttaaaaaacctggttgctgctctgcttagacacactctttctttctttctttcttgtattttaatcactcaacatcaacattttcactaatttcctgcaaatttgtatacattcttggaattatcagataaaacaaagtttacacaca

SEQ ID NO: 3488 - DNA, 1114 bp, Arnica chamissonis
agtgtgttgattcagatctgtatggtattattccctattttgagcatacaaatctgcgaaatcacccctttctcaatcaagaccacattgctgctgaaaaatacaaattatttattctctgcatagcaaatgggttcttacagagcagacgatgattacgattacttgttcaaactagttctaatcggtgattccggtgttggaaaatccaatctgctgtcgaggttcacaagaaacgagttcagtctcgattcaaaatcaaccatcggcgtcgaattcgccactcgtagcattcgactcgatgataaagttataaaggcccagatttgggacaccgctggccaggaacgataccgtgcaattacaagtgcatactaccgaggtgcagttggtgcattgctcgtctatgatgtaacacgacatgtcacctttgagaatgtggaaaggtggttaaaggagcttcgtgaccatacggattccaatactgtcatgatgcttgtaggaaataaatctgatttacgccatctgcgcgctgtaaactctgaagatgccaaaacgtttgctgaaaaagaaaacatgtatttcatggaaacatctgcacttgaatcattaaatgttgaaactgctttcacagaagtgcttactcaaatccatcaagttgttagcagaaaagctctggatgttgtagatgatacggctgctttgccaaaaggacagacgattaatgttggtaacaaggatgatgtgtcagcattgaagaaagtaggctgttgttctacttagatggaaaaccaggttcattctttgtaagttttaactaagtattatgtgaacttattgaatttcttttttagtataaatcatactttaagcccgtttagctcaaactaaacatgggtgtaagggcatatcaggaactacaaattgagttgacccgaaactgtgatggaaggattgatcatattgctaatgttacagttgtgatcgagcaacctcgtaatctcgtagtttaggtgaatatttgagtgatgaattgaatgcggttttggcattccaaatgtatcaaagattctattgctattcatgtaccattatttgtcagctggcatttgcg

SEQ ID NO: 3489 - DNA, 1262 bp, Flaveria ramosissima
atctcgttgatcagatttcaataatcttcagataaaccccaatcgaatcaacaatcacaaaattcgccataattcactctcaatctctccattaaacactcaattctcgaagctaataccacctaccatggcggcctacagagccgacgacgactacgattacctcttcaagttagtcttgatcggagactccggcgtcggaaaatccaacttactttcgagattcgctaagaacgagttcaatatcgaatcgaagtcaacaatcggcgtcgaattcgccaccagaagcattcgtgttgatgataaaattgttaaggctcagatttgggataccgccggtcaggaaaggtatcgcgcgattacaagtgcatactacagaggagccgttggggcgctggttgtgtacgacacgtcacgccatgtgacctttgagaacgtggcgaggtggttaaaagagcttcgtgatcacactgactccaacattgtgataatgttggtaggaaacaaggctgacttacgacacttgcgtgctgtgcccactgaagaggcaaaagcgttcgctgaaaaggagaatatttactttatggagacatcagctctcgaggctttgaatgttgaaaccgctttcacagaagttcttacgcatatataccatgttgtaagccgaaaggcacttgaagcaggcgatgatccttcgactctgcctaaagggcaaactattaatgtggggtctaaggatgatgcatctgctgtcaagaaagttggttgctgttctgcttaaggatgccctaagatttatctgagatttgcgacactattcttgaagttggttctggaaatgggtttgagcctgcaaattaagtgacagggtacaagttatagacactagtaagtaacataagtgatttctatgattcttttgtaatattaaagaatatcttttatttggcatttatcaagtcgaaccgtttcagcatttgtttgtttcccgtctatatgattagtggtaaatcgtcttaaattttgtctaaaaaacgcaaaatgagatcgatgaaacacgcaaagcaaagaaaacgaaagctcgaacagcccacaagatggaagattacaacactgccatgaagagaatgatgagaaacccttatgagtatcgaccatcgatcttggcatgaattataacctagataacagaaaatctagattgttagctcctgaacctacaaaaccgaacgatactacgaccaatcttaaagaggtaaaac

SEQ ID NO: 3490 - DNA, 795 bp, Actinidia deliciosa
ctttaaactctgaaacccgcccctttctctctctctcttccagagcttctctctctaaaatcatccggtatgtatgatttcattatataaaacaaacaaagtgtatgcatctatatacccatacatatttcggatttgatcggtgagagagaaacaacaatttctagagagaaagggtttgaaatcgattgatggcggcgtacagagccgacgacgactacgactacctgttcaaggtggttctgatcggcgattcgggtgtgggaaaatcgaatctgctctctaggtttacgaggaatgagtttagcctcgaatcgaagtccacgatcggcgttgaattcgcgactcggagtattcgcgtcgatgacaaggtcgtcaacgcccagatttgggacaccgctggccaggagagataccgagcaatcaccagtgcatactaccgaggagctgtcggtgcattacttgtctacgatgtcacccgtcatgtcacattcgagaatgtggagcgatggttaaaagagctccatgatcacacagactccaacattgtgataatgctcgtagggaacaaggcagacttgcgtcacctgcgtgccgtttcgaccgaggatgcaacggccttcgctgagagagagaacattttctttatggagacatcagccctcgagtctatgaacgttgagaatgcattcaccgaagcgctcacccaaatataccacgtgatcagcatgaaagctctcgaggtacgggatgacccagcggccttgcctaaagggcaaaccattaatgtgggaa

SEQ ID NO: 3491 - DNA, 949 bp, Selaginella moellendorffii
caagcttctagggtttatagggaggaagtgtttatttcttttagcgccttgccgcctttgctgatcgatctccccagctccgggggcattttcctcgcctcgatctcggtcgcgcagcgagagatccagcgccatggcgtacagatcggacgaggactacgattatctcttcaaggtagtgctgattggggactccggcgtcggcaaatccaacctcctctccagattcacgcgcaacgagttcagcctcgagtccaaatccaccatcggcgtcgagttcgccacgcgcagcatcaacgtcgacggcaagctcgtcaaggcacagatttgggacacggccggccaggagaggtatcgggccatcaccagcgcctactaccgcggcgccgtgggagccctactcgtctacgacatcacccggcctgtcacgtatgaaaatgtggagcgctggctcaaggagctcaaagaccacaccgattccaacatcgtggtgatgctggtggggaataagtccgatttgcgccacctccgggccgtgtccaccgaggacggccaggccttttcggagcgcgaggggctctacttcatggagacgtccgccctcgagtccaccaatgtggagaacgcgttcaagcagatactgacacagatttaccgggtggtgagcaagaaggcgctcgacgttggcgaggatccatccgcggcccctgccaagggccagaccatcaacgttggcggcaaggacgatgtgaccgcgaccaagaaggttgggtgctgctcggcgtgaaggatctctagctggtttcgatcgatccatctgggtagcaatgtttagatcacgcgtcaaggcttgggtggttctctgatagctacgaattcttttgctccttctaggtagcagattctttaaatacttttttctctcttcaactactttcgtgtgtgcttt

SEQ ID NO: 3492 - DNA, 976 bp, Helianthus annuus
cgtgaatcttgtgctaccaaatcttgatcatcatcatcttcacataaaccctagaaaaacttaatacataatctaaccccaaatcatcaatcggacacacaatcatcaaccctaacagcagcaaatcaacatggcggcttacagagccgacgacgactacgattacctcttcaaattagtcctgattggcgactccggtgtcggcaaatccaatttgttgtccagatttgctaagaacgagttcaatctcgaatctaagtcgactatcggcgtcgaatttgctactagaagtatccgtgttgatgataagattgttaaggctcagatttgggatactgctggtcaggaaaggtaccgtgcaatcacaagtgcatactacagaggcgctgttggggcactggtagtgtatgacacatcacgccacgtcacctttgagaacgttgagagatggttaaaagagcttcgcgatcacacggacccaaacattgtgataatgttagtaggaaacaaggccgacttgcgccatttgcgcgcagtccccactgaggaggcaaaaacgtttgcggagaaggagaacacatactttatggaaacgtcagctcttgaggcattgaatgttgaaaccgcattcacagaggttcttacacaaatacatcaggttgtgagccggaaagcacttgaagcaggtgatgatccttcagctctgcctaaaggtcaaaccattaatgttgggtcaaaggatgatgttaagaaagttggttgctgctctgcttaagaatatgttaagttatctgagtaagtatcctctgtttcaaattatttggtccatttgtgtttttatatgtgtaggatttgagacagttttcttgaagtacatttgatcattttgggttcaagactattaagtaacatatgcgatttctatgattctttttgtaatatcaaagagtttctttatatgacattaatcgattcg

SEQ ID NO: 3493 - DNA, 944 bp, Helianthus annuus
gtgaatcttgtgctaccaaatcttgatcatcatcatcttcacataaaccctagaaaagcttcatacatcaatcggacacacagtcatcaaccctaacagcagcaaatcaacatggcggcttacagagccgacgacgactacgattacctcttcaaattagtcctgattggcgactccggtgtcggcaaatccaatttgttgtccagatttgctaagaacgagttcaatctcgaatctaagtcgactataggcgtcgaatttgctactagaagtatccgtgttgatgataagattgttaaggctcagatttgggatactgctggtcaggaaaggtaccgtgcaatcacaagtgcatactacagaggagctgttggggcactggtagtgtatgacacatcacgccacgtcacctttgagaacgtcgagagatggttaaaagagcttcgcgatcacaccgacccaaacatcgtgataatgttagtaggaaacaaggccgacttgcgccatttgcgcgcagtccccactgaggaggcaaaaacgtttgcggaaaaggagaacacatactttatggaaacgtcagctcttgaggcattgaatgttgaaaccgcattcacagaggttcttacacaaatacatcaggtcgtgagccgaaaagcacttgaagcaggtgatgatccttcagctctgcctaaaggtcaaaccattaatgttgggtcaaaggatgatgttaagaaagtcggttgctgctctgcttaagaatatgttaagttatctgagtaagtatcctctgtttcaaattatttggtccatttgtgtttttatatgtgtaggatctgagacaattttcttgaagtacatttgatcattttgggttcaagactattaagtaacatatgcgatttctatgattctttttgtaatatcaaagagtttctttatatgac

SEQ ID NO: 3494 - DNA, 1219 bp, Musa acuminata
ccacgtaagcggccaattccaaagagtagaattcgtctcgttccccacctccaacgattcatcccccttcgtcgagctcggcgtctccccagcctccccctcttcccctcgatccggtttcctcctcccctctttctccttccctctctcctgacgacgtctttcttcttcggttccgtcggatcaaactcgaggagggggggagagtgcgtaaaagagaggaggcggggtgattatggcgtacagggcggacgaggactacgactatttattcaaggtggtgttgatcggggactccggggtggggaagaccaacctgctctcccgcttcgcccgcaatgagttcagctccgaatccaagtccaccatcggcgttgagttcgctacccgcaccatccgcgtcgatgaaaagctcgtcaaggcccagatctgggacaccgccggccaagaaagataccgagcaattactagcgcatactacagaggggctgctggtgcccttgttgtgtatgatgtgactcgccatatcacctttgagaatgtcgagaggtggctgaaggaactacggaatcacacagatggaaacatcgtcatcatgcttctgggcaacaaagctgatctacgtcacataagggctgtctcggtagaggatgcacaggcgtttgctcaacaggagaaggctttcttcatggagacctctgctctcgagtcgatgaacgtggagaatgccttcactgaagtgctgacacagatctaccatgtggtcagcaagaagatgcttgacgttggtgatgacccctctgccgtgcccaagggacagaccattaatataggcgctgaggacgatgtgcaagcttctaagaaaactggttgttgctcagattagttcaccattcatctccctcaagtttaggcgcatgctgcttggcatttcttttgtaaagctcgaggaggaggcactaaatgcttcaagaacatcgagcaccatacacaggttttgtagctggtaagaaaatatgaacctttcccttgtttcagaaatgcaaacttagtgggtcttcttctctttattctttttatgacttgtatttctcattacagacatgtttctcttgcttactgtttgttgcctttcaccatttgtgtatcatcagaaaaagagtggtatatacataaactttggttggttcttcaagttttttctgatggaatcattgag

SEQ ID NO: 3495 - DNA, 748 bp, Arabidopsis lyrata
gaacgtcataaagacaaaaagggtactgatcagatatgggaacatataaagctgaagacgattacgattacctcttcaaggttgtcttaacgggagattccggtgtcgggaaatcaaatctgctatcccgattcaccagaaacgattttagccacgactcacgctcgaccatcggtgttgagtttgccacacgtagcatccaagtggacgacaagattgtcaaagctcagatatgggacactgccggccaagaaaggtatcgagccatcacgagcgcttattaccgaggagccgttggtgcgttactagtctacgacgtgacacggcacgtgacattcgagaacgttgagagatggctaaaggagctaagagaccacacggacgcaaacactgtgataatgctcgtaggtaacaaagctgatttgaatcaccttcgagccatctctacggaagaagtgaaagattttgcagagagagagaacactttcttcatggagacttcagcactcgaagctataaatgtagaaaacgctttcacagaggttcttactcagatttacagagtcgttagcaagaaggctcttgatgctggagatgatcctaccactgctttgcctaaaggacagatgattaatgtaggaagcagagatgatgtttcagccgtcaagaaatcgggttgctgcgcgacatagcagaaatgagcttttcctatttttttttttctttctctcttttggtgtcatggaaa

SEQ ID NO: 3496 - DNA, 816 bp, Arabidopsis thaliana
ccaaacttcttggaacgtcataactaaagacaaaagagtaccgaccagatatgggaacatataaagctgaagacgattacgattacctcttcaaggttgtcttaacgggagattccggtgtaggaaaatcaaatctgctatcccgattcaccagaaacgactttagccacgactcacgctcgaccatcggtgttgaatttgccacacgtagcatccaggtcgacgacaagattgtcaaagctcagatatgggacactgccggccaagaaaggtatcgagccatcacgagcgcttattaccgaggagccgttggtgcattactagtctacgacgtgacacggcacgtgacattcgagaacgttgaaagatggctaaaggagctaagagaccacacggacgcaaacactgtgattatgctcgtaggtaacaaagctgatttgaatcaccttcgagccatctctacggaagaagtgaaagattttgcagagagagagaacactttctttatggagacttcggcactcgaagctataaatgtagaaaacgctttcacagaggttcttacacagatttacagagttgtaagcaagaaggctcttgatgctggagatgatccaaccactgccttgcctaaaggacaaatgattaacgtcggaagtagagatgatgtttcagccgtcaagaaatctggttgctgcgcgacatagcagaaatgagcttttcccttcttctttttttcttttatctctttcggtgtaatggaaatgctacaggattgaatcaaatgtaacaaaactgaaaaatgatgcaatcatg

SEQ ID NO: 3497 - DNA, 864 bp, Brassica napus
acccaagaatcttccttaatcctcataatggcgacgtatacagctgacgacgattacgatttcctctacaaggtggtactaatcggagactccggcgtcggaaaatccaacctcctctctcgattcacgcgcaacgagttcagcctcgagtccaaatccaccatcggcgtcgagttcgccaccagaaccattcacgtcgacgacaaaatcgtcaaagctcagatttgggacaccgccggtcaagaaagataccgagcgatcactagtgcatactatcgaggagctctaggagctctacttgtgtacgatgttacacggcatgtgacgtttgagaacgttgagaggtggctcaaggagcttagagaccacactgacgccaacattgttattatgctcgttgggaacaaggctgatctgcgtcatctcagagctgtttctaccgaggatgctacggtctttgcggagagggagaagactttctttatggagacgtctgcgcttgaagctttgaacgtggaggatgctttcactcagctgctttctcagatataccgtgtggctagcaagaaggctttggatgttggtgatgatgatcggtctggtgtccctaaaggacagagtgttaatgtcgggtctaagggggatgtgtctgaggttaagaagattggttgctgctcgagttgatctcagattgtttagaggaactatgttagtttgagtatctatggaacagatgattcctcccttgtgtagttacttttggtgtcttcttgttccttcttttggtgtaagtttctcagatctttataatgttctgtttatgtttacatgatcatattagataatctatgaacataaaagtgt

SEQ ID NO: 3498 - DNA, 1261 bp, Olea europaea
acgactcctccaagatttgctgctaacccctcacccctaccgcggccaatacgtggagttttgagctccatctctgcaaatacaactacagaaaaatgcatatctgcatacttttgaattgaaatggcggggggatacagggcggaagacgactacgattacttgttcaaggtggtgctgatcggcgattcgggagtcggaaaatccaatttgctatcgagatttgctcgcaatgagttcaacttggagtctaagtcaacaatcggcgtggaattcgctacgcggagtatccacgtcgaggataagatcgtcaaggctcagatttgggacaccgccggccaagaacgataccgggctatcacaagtgcttactaccgaggggctgtgggagcattgcttgtttatgatgttacacggcatgtcacgttcgagaatgtcgaaagatggttaaaagaactccgagatcatacggaccaaaatatcgttatcatgcttgttggcaataaggtagatttacgtcacctacgtgctgtatccaccgaggatggcacgagttttgctgagagggagaaaacatattttatagagacgtctgcactcgagtctatgaacgttgagaatgctttcacagaactactcacccaaatatatcatgtagttcgccgtaaagcaattgaaatcggagatgatcctgcaactttgccgaagggacaaacggtaaaggttgatactaaagatgatgtttcaaaggttgcttgctgctctatctagtccgaagttttggtcattgcgtgttggtccatctatgaattccaactcgttggtgtccttatttattcgattaatgcatgtcttatagacaatgtatttttactttttcttctttaatattgtttggtactatctaatctttcctactgaatataccattggcatttgggaattgagggcttagttttggagcttgatcaatggcatatcgtagtgtctttggacaacatttgaattgtgcacttgaaacatttgttttttcaaaataataaatgtattagccaaaagcccataactattttatcggtacattttcgtattgaatcatagagtagcataaattttacaagaatgtgcattcctattctatttgctgtggattctgaattggtgtccaaagcggtgaaccgcattggatctagtactataatttgttgtcgtcgttgaaagatcttattgctttgatgtgtagttttgatgcaacttccgt

SEQ ID NO: 3499 - DNA, 1861 bp, Capsicum annuum
aaaaaaattaactcaaaaagagaaagtgaatttcctttttatttttttcaattcatatgtagaaaaaaaaatcatcattagcaaataaaacatatttaaattaaaaggagaaaaatgggggcatatagggctgatgaagattatgattacttatttaaagttgttcttattggtgattctggtgttggtaaatcaaatttactttcacgttttacaaaaaatgaatttagccaagaatctaaatctacaattggtgttgaatttgctacaagaacaattcatgttgatgacaaaattatcaaagctcaaatttgggacactgctggtcaagaaaggtatcgcgccatcactagtgcatattatcgcggagcagtgggtgccttactggtttacgacataacacgccatgtaacatttgaaaatgtagcaagatggctcaaagaattgagagaccacacagaccaaaacatcgtagtaatgctcgtagggaataaggcggatctccgccacctcagagctgtccccacgggcgaatcaagtggttttgcagaaagagagaacactttcttcatggaaacatctgcacttgaggcactcaatgtagagaactcatttacagaagtactcactcagatttatcgagtggttagtcgaaaagcacttgatataggagatgatccagcatctgtaccaagaggacaaacaattaacattgggaaagatgatgtatctgctgttaagaaaggtggatgttgttccggttaagcaaaatgatcgatccagaggtgaatccagaatctagcgtcaacatgttcagaatggtatacacaaagttggagaagaaaataatgaattcagttgaattctccgcctctggatgcaagtatgtatgtatatatatatatatatatatacatacacacacacaacaaatcacattttcaacaaatgtaagttagacaaaagaactaatagcacagtatattgtggaggatggaagtacaattagcctaaatactttgatgtgtaatttgtaaatcaagggaatttcagctaagaaaactttctagttgccacaaaatacttgcaatagactgaatgcctatgttgctcggactcttcaaaaatgtcgatggatgcgtgtttgatcctccaaaagtagtgcattttttaaggattaggcacaagtgcagcatcattttttgagagtccaagcaactcaagctcaacgttacaagaggttgcattttgcattgttctcttatcttcatctatgccaagcgggtggagaactatgagttcagcagaattcaatagctttgaccccaaaaccttgtatttgattaagaattccacttaataagtaaaaacaatttatttaacttagtaaagttgcatcttttgtaattatcgatttttcagcattaaacaggatgctgcgtgagaaacaaatccctcaagagttcctttttgagagagtaggaacttatgttgctcaaaattgttacagagtgtatgtgggatccttaaaaaaaaaaaaaacattttgcaagtgtgcggcgacatttttgaaaagtcaaatagtggagtagcaataaatgcaagaatagagtaacataggcaggaatttgaaacaggtaataagaggtcttgggtacaaacacagattagttcaactaagtttactacaacatacccagtaaaatctcacaagtgatgtctggggaggtagcttgtatgcaaaccttaccactacctcgtgaggtagaaaggctaccgcaaagggggtggcgtttggggatacagggcaggattaaacaaagggcagaaacactgagctaactagcaatctcattcagat

SEQ ID NO: 3500 - DNA, 978 bp, Gossypium hirsutum
gagaaagagaaagagcaatgggagcttacagagctgatgatgactatgattacttgtttaaggttgtcctgatcggcgactctggtgttgggaaatccaaccttttgtctagatttaccaaaaacgagtttagccttgaatccaagtctactattggggttgagtttgccactcgtagcattactatcgaggataaggttgtcaaagctcagatttgggacaccgctggccaagaaagatatcgtgcagtcaccagtgcatactaccgtggggctgttggtgctttactagtctacgatgccacccgtcatgttacctttgagaacatagaaaggtggctcaaggaacttagagatcacaccgatggcagcatcgtgattatgctgctcgggaacaagtcggacttgcgtcacttgcgagcagttttgaccgaagatgccaaagctttcgccgaaaaagagaaaacttatttcatggaaacatccgcactggagtctctcaatgttgagagtgcattcactgaagtgctgacccagatttatcatgttgtaagcaagaaagctcttgaaggtggaaacatccaagcaactctgccaaaaggccaaatgatcaatgtcggatcgaaagatgatgtatcagccataaagaaaggtggatgttgctagacttaagtgggggctttgaaattgaatgccctttgttcatacaagcgtgaacaatatataaaccagttgacattgtgatttggatcatgtcaaatacaaactagtctatgttagcttgagctctaggacttaaatggtttttgttaatttcatgcattgctaagacctaaacccatcttaattttatataaagttacagcttgtttaggattttgatggaaacccaaattaatacacgatctgagcgcctgtaatgcaagagttatatcataatttatatatgtaatgaaaattgaaataatgaaaattgaaa

SEQ ID NO: 3501 - DNA, 886 bp, Fagopyrum esculentum
aaggttgaaagattcttcgattagatgggtgcattcagagcggatgatgattatgattacttgttcaaggtggttctgattggagattccggtgtcggaaaatccaatctcctctctcgtttcacccgcaatgagttcagcctcgaatccaaatccaccattggcgttgagtttgccactcgtagcattcgtgtcgatgacaagatcgtcaaggctcagattgggaatactgctggccaagaaaggtaccgcgccatcacgagtgcctactaccgaggagcggtgggtgcattagtagtgtacgacgtgactcgccatgtgacattcgaaaacgtggagagatggctcaaggagctccgggatcacaccgacgccaacatcgtcataatgcttgtagggaacaaatccgatttgcgacacttgagggcagtcacgttggaggattctaagggatttgcagagagggagaacactttcttcatggaaacttcagctttggaggctttgaatgtcgagagtgctttcacagaggttctttctgagatctaccatgtggttagcaggaaggcactcgacattggagatgatccttctgctgtgcccaaaggacagactatcaatatcaataaagatcatgatgctaatgctggggagcaaggtggatgttgttccagttagggaagacgaataaacaagagaggacttataattgttcatactagtgtcctatagaggaattttaagaaatgaaaacagaatcttatatgcatagtgaatgatgtaagtagaaaataaggtttttttcctgcttatcattctgattaacaaacactctcttgcagttgattccactttcgtttcccttcctgaatctgatgatacatat

SEQ ID NO: 3502 - DNA, 1433 bp, Gossypium raimondii
cggaaaagtcgcaagggacagctattttgaatgtgtaaattgttagtaacgctgttacaaaactaaccttttaccctcgaaaatgacgtgaagaaaaaaaaaaggttaaaattgggtaaacccagccagcagcagccgttgtaatattagccatttgcctcaagcgtttagctgtttcattctttgttcttcagttcccaaacccagacagattctaaaacagaaaatgccaaccgtaacatgcaagtaatttacccaaataacaagcaaaacaccaaaactaaagcgtgtttctcctttttcttttgtttttatcttcatttttaaatactttgttttcaattgaagacaacatccaaggacaaaagaaaacacgagaaagagaaagagaaagagcaatgggagcttacagagctgatgatgactatgattacttgtttaaggttgtcctgatcggcgactctggtgttgggaaatccaaccttttgtctagatttaccaaaaacgagtttagccttgaatccaagtctactattggggttgagtttgccactcgtagcattactatcgaggataaggttgtcaaagctcagatttgggacaccgctggccaagaaagatatcgtgcagtcaccagtgcatactaccgtggggctgttggtgctttactagtctacgatgccacccgtcatgttacctttgagaacatagaaaggtggctcaaggaacttagagatcacaccgatggcagcatcgtgattatgctgctcgggaacaagtcggacttgcgtcacttgcgagcagttttgaccgaagatgccaaagctttcgccgaaaaagagaaaacttatttcatggaaacatccgcactggagtctctcaatgttgagagtgcattcactgaagtgctgacccagatttatcatgttgtaagcaagaaagctcttgaaggtggaaacatccaagcaactctgccaaaaggccaaatgatcaatgtcggatcgaaagatgatgtatcagccataaagaaaggtggatgttgctagacttaagtgggggctttgaaattgaatgccctttgttcatacaagcgtgaacaatatataaaccagttgacattgtggtttggatcatgtcaaatacaaactagtctatgttagcttgagctctaggacttaaatggtttttgttaatgtcatgcattgctaagacctaaacccatcttaattttatataaagttacagcttgcttaggattttgatggaaacccaaaattaatacacgatctgagctcctgtaatgcaagagttatatcgtaatttatatatgtaatgaaaattgaaaactccatatggtaccttgcttggcctctagatgtctgattgctaaaactgtcaacttatacatgaacaaaagggttaaaaaggagggg

SEQ ID NO: 3503 - DNA, 881 bp, Nicotiana benthamiana
ctctctctgtctctctcccattttctctctttctccctctctcttttcatccataccaaaagaaaaaaaaacaattaacaaattggaacaaataaaatcttgttattagaagggagggtgaaaggtagaaaaataactcaaaaagagaaagtgaattctcatattcatatgtagaagaatttaaccacaaaaataaagattaaagaaaagggaaaatgggggcatatagagcagatgaagattatgattatttattcaaggttgtgctaataggggattctggtgttggaaaatctaacttgctttctcgttttactaaaaatgaatttagccaagaatctaagtctaccattggcgttgaatttgccactcgtaccattcatgtcgatgacaagattatcaaagctcaaatttgggataccgctggtcaggagaggtaccgtgcaatcacaagtgcttattatcgaggtgcagtgggtgcattactggtttatgatattactcgccatgtaacatttgaaaatgtcgcaagatggctcaaggagcttagagatcacacagaccaaaacatcgttgtcatgctcgtcggaaacaaggcggatcttcgccatcttcgtgctgttcccacgggtgaatcaagtggttttgcagaaagagagaatacctttttcatggaaacatctgcacttgaggcactgaatgtagaaaatgccttcacagaagtgcttacacagatttatcgcgtggttagtcgaaaagctcttgatataggagatgatccaacagctgtgcccagaggacaaactattaacattggtaaagatgatgtatcttctgttaagaagggtggatgttgttctggttaaacaaggatcgaccca

SEQ ID NO: 3504 - DNA, 1119 bp, Nicotiana benthamiana
cttgttattagaagggagggtgaaaggtaaaaaaaataactcaaaaagagaaagtgtaatttctcatattcatatatagaagaatctaaccacaaaaataaagataagagaaaagtgaaaatgggggcatataggacagatgaagattatgattatttatttaaggttgtgctaataggggattctggtgttggaaaatctaacttgctttctcgttttactaaaaatgaattcagccaagaatcaaagtctaccattggcgttgaatttgctactcgtaccattcatgtcgatgacaagattgttaaagctcaaatttgggataccgctggccaggaaaggtaccgtgccattacaagtgcatattatcgaggagcagtgggtgcattactggtttatgatattactcgccatgtaacatttgaaaatgtagcaagatggctcaaggagctcagagatcacacagaccaaaacattgttgtcatgctcgtcggaaacaaggcggatcttcgccatcttcgtgctgttcccacgggcgaatcaagtggttttgcagaaagagagaacacctttttcatggaaacttcagctcttgaagcactgaatgtagaaaatgctttcacagaagtgcttacacagatttatcgagttgtcagtcgaaaagctcttgatataggagatgatccaacatttgtgcccagaggacaaactattaacattggtaaagatgatgtatctgctgttaagaaaggtggatgttgttctggttaaacaaggatcgatcctgaggcgaattcagattctagagtctatgcgttcagaatgagtatgagaaactttctttttcgtatatgtatacatagattgagctaaaaacaatagattcagttgaacctgctcgcctctggatgcaagtatatgcaaagcaaatcccattttcagcaaatgtaagttagcaaaaggaactagtacattatttgtgagggaaagggggattgaagttacattagctaaaaatttactttgtttcatattttcatgtgtatttgtaaatcaagggaatttcagctaaggaaactttcttgtgccacaaatagttgcaatagagtgaatgttaca

SEQ ID NO: 3505 - DNA, 1142 bp, Solanum phureja
cttatcattaaaagagagggtgaaaggtaaaaaaaaaattactcaaaaagagaaagtggtttgtttgtttttcaattcatatgtagaaaaagaaaacatcattagcaaataaataatatttaattaaaagaggaaaaatgggggcatatagagctgatgaagattatgattatttgtttaaagttgttcttataggtgattctggtgttggcaaatcaaatttgctttctcgttttacaaaaaatgaatttagccaagaatctaaatctacaattggtgttgaatttgctacaagaacaattcatgttgatgataagattatcaaagctcagatttgggacactgctggtcaagaaaggtatcgagccatcactagtgcatattatcgaggagcagtgggtgccttacttgtttatgacattactcgtcatgtaacatttgaaaatgtagcaagatggctcaaagaactcagagaccacacagaccaaaacatcgtcgtcatgctcgtcggaaacaaggcggatctccgccacctccgagccgtccccacaggagaatcgagcggttttgcagaaagagagaacacattcttcatggaaacatctgcactcgaggcactcaatgttgaaaacgccttcacagaagtactcactcagatatatcgagttgttagtcgaaaagctcttgatataggagatgatccaacttctgtgccaagaggacaaacaattaacattgggaaagatgatgtatctgctgttaagaagggtggatgttgttccggttaagcaaaaagatcaatccagaggtgaatccagaatctagagtcaatgggttcagaatggtcaatacgatctttgtttttggtatacacacaatttgagaagaaaccaccctagatccgcctttggatgcaagtatatatacatacacacatcaaatcccattttcaacaaatgtaagttaggcaaaagaactaatagcatattattttgtggaggaaattaaagggggatggaagtacatttagcttaaaagtttacttgttttaaatttttcatgtgtaatttgtaaatcaagggaatttcagctaaggaaactttcttgttacaaaaaatgtttgcaatagactgaatgttaca

SEQ ID NO: 3506 - DNA, 1035 bp, Petunia hybrida
actttctctgtttctccccctctctctctctctctttccattcatattccaaaggaagaaagtcaacaccattgaaagttgaacaacaagagagaacaacaagggagggtgaaaggaacaaataaaaacaaggagaaagtgtatttctcattcatatgtagaagaagatcactagcaataacttaaagaaagggaaatatgggtgcatatagggctgatgaagattatgattacttgttcaaggtggttcttataggagactctggcgttgggaaatccaacttgctttctcgttttactaagaatgaattcagccaagaatcaaagtctaccattggtgtcgaatttgctacacgtaccatccatgttgatgacaagattgtcaaagctcagatttgggataccgctggacaagaaaggtaccgtgctatcacaagtgcttattatcgtggagctgtgggtgccttactagtttatgatattactcgtcatgtaacttttgagaatgtagcaagatggctaaaggaactcagagatcacacggaccaaaacattgttgtcatgcttgttggaaacaaggcagatcttcgccaccttcgagctgttcctacaggtgaatccagtggttttgcagaaagagagaataccttcttcatggaaacatcagctcttgaggcactgaatgtaaaaaatgccttcacagaagtgcttacgcaaatatatcgagtggttagtcgaaaggctcttgaatataggagatgatccaacgtctgtgccaagaggacaaacaattaacattggaaaagatgatgtatctgctgttaagaagggtggatgttgttctggttaaacaagctggatcaactaactagctcatgaatttaaccacccttgaatttcttggtccggggatgccgtggtggtataattaattgaaagaacacaccctcccgcccttttctcctggttccggaaaaattaatagcaaggccaatttccccaattttttcaattgacatgtaagggttagcctat

SEQ ID NO: 3507 - DNA, 870 bp, Musa acuminata
ccattatcttcttctttttcttcctctgcggatccacaacacaaaccctcgtacttgattcccttctctgagccttcctctcgctctcgcacgcttcctcgttctctctcgcaatgcccacgactctccccgtgacggcgttccgaagcaagtggaggtcacggatctgattgcggggcggtcgaaggaggagacggagcaggaagaatgacgtatagggcagacgacgactacgattacctcttcaaagtggtgctcgtcggcgactccggcgtcgggaagtcgaacctcctctcgcggttcacgcggaacgagttcagcaacgagtccaaggccaccatcggcgtcgagttcgccacgcggagcatccgcattgatggcaaggtcgtcaaggcccagatttgggacaccgccggccaagagagatatcgggcaattacgagtgcttattatcggggagcagtaggcgcacttgtggtctatgacataactcgcaatgtgacatttgagaatgtggagagatggttgaaggagctcagagatcatactgatacaagcattgtcatcatgcttgtaggaaataaggcagatgtacgccatctcagggctgctaccaccgaggacgcgacggcttttgctgaaagggagaacacatttttcatggagacgtctgctctggaatcaacaaacgtggaggcggccttcaatgaagtgctcacccaaatatatcaggtggtcagcaggaaggcactcgaggcaggcaatgattcaacaagtttgccaaaggggcagacgatcaacgtgggcaaggacgacgtttctgctattaagaaggttcgttgctgctcaacttagatctacaaaattgga

SEQ ID NO: 3508 - DNA, 958 bp, Euphorbia esula
ctctttcaatatcacaagccgcgcccgctttctctctctagataaaagtaaacaatgtcgacaattttgaattcaaataaaaccaacaacaattctttgtagatagatagatagatacatacataacagatacgcatagatcgagtccatttccatatctcatatcttttttcgtctacgcattgaaatttcaaaatcgcctgatctccattttcgataatcccgagaaaacgagagggaactttcaatccaggttaaatgggagcttacagagcagacgatgattacgattacttattcaaagtagtcttaataggcgattctggtgtcgggaaatcaaatctcttgtccagattcacgagaaatgaattcagccttgaatccaaatccacaatcggcgtagaattcgccactcgcagcatccatgttgatgacaaggttgttaaggctcagatttgcgatactgctggccaagaaaggtaccgtgcaatcacgagtgcgtactaccgaggagctgtcggtgccttagttgtctatgacgttactcgacgggtcaccttcgagaacgtggagagatggttgaaggaactccgggaccacacggattccaacatagtgataatgctagttggaaacaaggcggatttgcgccatttacgagcagttacaacagaagattccactgcttttgctgagaaagagaacacctttttcatggcaacctctgctctcgagtccctaaacgtggaaaatgctttcacggaagtactcactcagatatatcgtgttgttagccggaaagctcttgatattggggatgacccgacttctttgcccaagggacagactattcatgttgggaaagacgatgtttctgctgtcaagaaagtcgggtgctgctcggcgtccagtttttctttcttaaaagatttgcattttggtgatttggagctgcctt

SEQ ID NO: 3509 - DNA, 811 bp, Antirrhinum majus
aaatctggctgtaaataaattagaatacgaaaatgcacaagggaaagaataaaatactattataaaacccttggagttagatctctagcttccttctttggtttatgtatctgttttctcactatcactccttttttctctctaatcttcacacacatacatttacactaaaccgtctctcgtttatacactaaaaaaactcaacagtgtaaatgggtgcttacagagcagatgatgactacgattacttgttcaagttagttctcatcggcgattcgggtgtcggaaaatcaaacttgctctccagatttgctcgcaacgaattcagcttggagtcaaagtcaacgattggggtcgaattcgccacgagaagcatccgcgttgacgagaaagtcgtcaaggctcagatttgggacaccgccggtcaggaacgatatcgtgcaatcacaagtgcctactatcggggagctgttggtgcattgcttgtctacgatgttacacgccatgtaacatttgaaaatgtcgagagatggctgaaggaactcagggctcatactgattcaaacattgttatcatgcttgttggaaataaagccgatttgcgtcacttgcgggctgtttccacagaagatgcaaaggcttttgctgaaagggagaacacttttttcatggaaacttccgcccttgaatcaatgaatgtggaaaatgcatttacagaagtgcttactcagatacatcgtgttgttagccggaaagcccttgaggccggtgatgatccagctgctctaccaaagggacagaccatcaatgt

SEQ ID NO: 3510 - DNA, 1607 bp, Marchantia polymorpha
cggatacagtactcttacgggaggccaatgaaggaggagccctaaaatgtcctgcttgcggcatgactctgctgaagatgccttgttcttcaaccaagcgaatatcatttgccgtgtgccctatttctttctcgaaactctactcaggccagccaaggaacggccagtaacgtcatacaccggcaaaccttcaccactggagcctttcctcgtctgacgctttctgagttgcatccttcctcgcatctcattagcacgtccaaactgtcagcagcagtacaatctttggcggggtagcgattttctgcattacaattagtttgataaagcatggcttatagatccgacgatgactatgattatttgttcaaagttgttctcatcggagactccggggtaggcaaatcaaaccttttgtctagatttacgcgcaacgagttcagtttggaatccaaatcaaccattggcgtggagtttgcaacccgtagcatcaatgtggacagcaagctcatcaaagctcagatatgggacactgctggtcaagagaggtaccgggccattactagcgcctattatcgtggtgctgttggagccctcttggtttatgacatcactcgtcacgttacgtttgagaacgtggagaggtggcttaaggagttgaaggatcacactgattccaatatagtggttatgctcgttgggaacaaatcagatctgcggcatttaagagctgtttccactgacgatggtcagtccttctccgagaaggaaagtctttttttcatggagacctccgccctcgagtccacaaatgttgaaaacgctttcaagcagattctcactcaaatctacagggtggtaagcaaaaaggctctggacgttggggaggatccatctgctggacctgggaaaggtcaaacaatccaagtcggcaacaaagacgaggtgacagcgaccaagaaagtaggatgttgctcagcgtaaatttgtggtggaaacctcgtcgcctggcttgttttagaacgcgcaacaatctggtagggtaatcgtgctttttcaatttgtggagattgtgaaccttgaggagttgatagcctcgttgcaccaaccgggtttcacagaggaaatcatggaaatcgtgagctatattttaaggagttggctatcaaaagagaggtgtaccacgtggcagcaaatgtttaagttatttctgtcgaagtatccttatcttgagagccgtaccttctgctattgcaagtatgttttgaagcggattgttagcaggtctcgtaataaccagaaagtggttattttcactgttaatatgtcagaacagttgtgctttggttctgcgatgtagtttacttatgaccagccctgcattatctgttataagagtattacgctcgagccgaattgaggatggaaacgtgttgatgctgtggcgccatcacatgctagaaatgcaatgtagtgctatatgatctgaacctcttgaacgtcgtctgtagctgtaagtattagcgctggcttttgcagaggggctttttttcctcatggagcaagtcaatctcctactcgtgcttttttacatttatcacctcgta

SEQ ID NO: 3511 - DNA, 785 bp, Lippia dulcis
tttatatacgtacgtactttacagtattgagcggagaatggcgggtggatacagagccgaagacgactacgattacctcttcaaactggtgctgatcggcgattccggcgtcggaaaatcgaatcttctttcgagatttactcggaacgagttcagcttggagtccaaatctactattggcgtggaatttgccacccggagtattcgcgtcgatgataagatcatcaaggctcagatttgggatacagctggtcaagaacgataccgtgcaatcacgagcgcttactatcgaggggctgttggggcattactcgtatatgatgttactagacatgtgactttggaaaacattgaaagatggttaaaagagcttcgagaccacaccgacgaaaatgttgtgataatgcttgttggaaacaaagctgatttacgccaccttcgtgctgtttccactgaggaagccacatcttttgctgagaaggaaaaaacttactttatggagacatctgccctcgagtccatgaatgtcgacagtgcttttacagaagtactctcacaaatataccatgttgtgagccgtaaagcacttgatgttggtgatgatcatgcaaccttgcccaaaggagaaactatagatattggatcgaaggatgatgtttcggttttgaaaaaggtcggttgctgctctgtgtgatcgcacagttcagtcttttgtgttgggtgtgattgatgaggttcctatcagttttggagttagaaattgccaccagcccatatatcttttg

SEQ ID NO: 3512 - DNA, 743 bp, Platanus occidentalis
acttgttaacaggaaagctcgtattttgatccgccaaagttcgcatttttatctctcagaggaagaatccagtagaaatggcggcgtacagagccgacgatgattacgattatctgttcaaggtcgttttgattggcgattcaggtgtcggcaaatctaatctcctttccaggttcaccaggaacgagtttagtctcgaatccaaatcaacgattggtgtcgaattcgctacgcggagcattcgcgtcgacgataaggtcatcaaggcacagagttgggataccgccggtcaggaaaggtaccgtgcaatcacgagtgcatactatcgaggagctgttggtgcactgcttgtttatgatgtcacccgtcacgtaacatttgagaatgttgagagatggttgaaggagcttcgggatcacactgactccaacattgtgatcatgctagtagggaacaaggcagacctacgtcacctgcgggctgtttccactgaagatgcgaaggcctttgctgagcgagagagcaacttcttcatggagacatctgccctggaatctatgaatgtggagaatgcattcactgaggtgctcacccaaatctatcatgttgtcagcaggaaggctcttgaggtcgggatgaccctgcggccttgcccaaggggcagacgatcaatgtgggctacaaaggctgatgtatcagccattaagaagtcgatgctgctccactaactgaacaatagacga

SEQ ID NO: 3513 - DNA, 1133 bp, Pteridium aquilinum
agtgtgggctgggcattcctcgtatgcaagaaagccacactcgtcgtctcgcttgcagcagagagagagggggaggtctgccatagccagatctggcaaatcttgctgctggtggcgatggcgtacagatctgatgacgactacgactatctgttcaaggtggttctgatcggcgattctggcgttgggaaatctaacctcctctcgcgcttcactcgcaacgagtttagcttggagtccaagtctaccattggcgttgagtttgctacccggagcatcagtgtcgacggcaaaaccatcaaagctcagatctgggacacggccggccaagaaagatatagagcaatcaccagtgcatactaccgaggtgctgttggtgcattgcttgtttatgatattaccagacatgtgacttttgaaaatgtggaaaggtggttaaaggagctcaaggatcacacggattcaaacattgtagtcatgcttgtgggcaataagtctgatcttcggcacttgagagctgtatcgacagaggatagccaggcttttgcagagagagagggtttatattttatggagacctctgccttggaatcaacaaatgtggaaaatgcatttaagcaaattcttacgcagatctatagagtggttagcaagaaggcgcttgatataggggaggatcctgcagctgtgccaagccaagggcaaacaatttcttacggcagtaatgatgtgaccgcaactaagaaaattgggtgttgttcggcatagataagactaggactcctctccaccccacctcattaggattggtgtagaaggtttgggacctttcaaggcatgaggagatggtgtttttctgttggttcctcgccacccagcaaaggctttcttggttgtgatttctttgtattcgagtaaaacaaatttcacaggtagttcaatgagaagcccagtagttttgagggatttaattttcaagctacttgctgctcaatctcccttatgtaagatgcaacaacaggaagataaggttttaaatgttcccgcattgtactgcagatgtgaaatctttcctctgctattgttttgagaattaacatcgtaaaaactttctgttttgtgttaaaaaagaa

SEQ ID NO: 3514 - DNA, 776 bp, Eutrema halophilum
tatgttggataaaattgtccaagaagaacgtcataaaggcaaacgggtatcgactagacatgggaacatataaagcagaagacgattacgactacctcttcaaggttgtcttaacaggagattctggcgttggaaaatcgaatctactatcccgattcaccaaaaatgacttcagccacgactcacgctcgaccattggcgtcgagttcgccacacgaagtatccaagtcgacgacaagattgtcaaagctcaaatatgggatactgccggccaagaaaggtatcgagccataacgagcgcttattaccggggagccgttggtgcgttattggtgtacgacgtgacacggcacgtgacattcgagaacgttgagagatggctaaaggagctaagggaccacacggacgcaaacactgtgattatgctcgtaggtaacaaagctgacctatgccaccttcgagccatctcaatggaagaagtgaaagcttttgcagagagagagcacactttcttcatggagacttcggcactcgaagctttaaacgtcgaaaacgctttcacagaggttctcacacagatttacagagtcgttagcaagaaggctcttgatgctggagacgatccagccactgctttgcctaaagggcagctgattagcgttggaagtagagatgatgtttcagccgttaagaaatcaggttgctgctccacttagcataaatgagcttttccttttcacatttttttggaagaatgtctttggatgtagtggaaa

SEQ ID NO: 3515 - DNA, 936 bp, Eutrema parvulum
aaaactaatatttttagaacaaaagaaaaaacacgtttgggaattgagttttctcatcccaacttcttggaacagccaaataagattttttcattcttgaatgtaactgtctcaataacaaactcataaagacgaagagcatagttttggacagaagatgggagcatatagagcagaagacgattacgattaccttttcaaggtggtcttaaccggagactcaggcgtcggaaaatctaatcttttatctcgtttcacccgaaatgacttcagccacgactcacgtgcaaccattggtgtcgaattcgctacacgtagcatccaatgcgatgacaagattgtcaaggctcaaatctgggattccgccggccaagaaaggtaccgagccatcacgagcgcatattaccgaggagccgttggtgcgttgctagtttacgacgtgacacggcacgtgacgttcgagaacgttgagagatggctaaaggagctaagggatcacacggacgcaaacattgtgattatgctcgttggtaacaaggctgaccttcgtcatcttcgagccatctctaccgaagaagccaaggcctttgcggagagggagaatacctttttcatggagacttctgcacttgaagctgtgaatgttgataatgctttcaccgaagttctcactcagatatacagagtcgttagcaagaaagctcttgaagctggaaatgatccaaccactgctttgcctaaaggacagatgatcaatgtcggaagccgagatgatatctcagccgttaaaaaacctggttgctgctctgcttagatatacactcgtctctcttttttcttacttgtattttatttattcaacatcagcattttcactaatttcctgcaaatatgtatacattcttggaattatcagagaaacaaagttaacactca

SEQ ID NO: 3516 - DNA, 806 bp, Eutrema parvulum
atcatccaaagttcttggaacagccaaaccatctatgttggataaaattctccaagaaaaacgtcatatagacaaacgggtatcgaccaaacatgggaacatataaatctgaagacgattatgattacctcttcaaggttgtcttaacaggagactccggtgtcggaaaatctaatctgctttctcgattcaccaaaaacgacttcagccatgactcgcgttcgaccataggcgtcgagttcgccacacgaagcatccaagtcgacgacaagattgtcaaagctcaaatatgggatactgccggccaagaaaggtatcgagccatcacgagcgcctattaccgaggagccgttggtgcgttgttagtctacgacgtgacacggcacgtaacattcgagaacgttgagagatggctaaaggagctaagggaccacacagacgcaaacactgtgattatgctcgtaggtaacaaagctgatctgcgtcaccttcgagccatctcaacggaagaagtgaaggcttttgcagagagagagaacactttcttcatggagacttcggcacttgaagctttaaatgtcgaaaacgctttcacagaggttctcactcagatttacagagtcgttagcaagaaggctcttgaagctggagatgatccaaccactgctttgcctaaaggacagatgattaatgttggaagcagagatgatgtttcagctatcaagaaatcgggttgctgctcgacatagcataaatggccttttcctctccttttatttcttttaagaatctctttctatgtattg

SEQ ID NO: 3517 - DNA, 1221 bp, Solanum lycopersicum
ctctctccccctactttctccccctctccaaaagaaaaaaaaaactaatcttgtcattaaaagagaggtgaaagattaaaaaaaaaatactcaaaaagagaaagtggtacatttgtttttcaatttatatgtagaaaaaaaaaagcatcattagcaaataaataacattaattaaaagaggaaaaaatgggggcatatagggctgatgaagattatgattatttgttcaaagttgttcttataggtgattctggtgttggcaaatcaaatttgctttctcgttttacaaaaaatgaatttagccaagaatctaaatctacaattggtgttgaatttgctacaagaacaattcatgttgatgataagattatcaaagctcagatttgggatactgctggtcaagaaaggtatcgagccatcactagtgcatattatcgaggagcagtgggtgccttacttgtttatgacattactcgtcatgtaacgtttgaaaatgtagcaagatggctcaaagaactcagagaccacacagaccaaaacatcgtcgtcatgctcgtcggaaacaaggcggatctccgccacctccgagccgtccccacaggcgaatcgagcggttttgcagaaagagagaacacattcttcatggaaacatctgcacttgaggcactcaatgttgaaaatgccttcacagaagtactcactcagatatatcgagttgttagtcgaaaagctcttgatattggagatgatccaacttctgtgccaagaggacaaacaattaacattgggaaagatgatgtatctgctgttaagaacggtggatgctgttccggttaagcaaaaagatcgatccagaggtaaatccagaatctagagttaatcagttcagaatgatcagtacgatctttgtttttggtatacacacaattcgagaagaacccaccctagatccgcctctggatgcaagtatatatataaacacatcaaatcccattttcaacaaatgtaagttaggcaaaaagaactaatagcgtattattttgtggaggaaatgaaagggggatggaagtacatttagcttaaaagtttacttgtttcatatttttcatgtgtaatttgtaaatcaagggaatttcagctaagaaaacttccttgttaaaaaaaaatgtttgcagtagactgaatgttacaagaagttgcattttgcttcaccaaccaaaa

SEQ ID NO: 3518 - DNA, 832 bp, Pennisetum glaucum
tctcaaatccaacctgctctcgcggttcacgcgcaacgagttcagcctcgagtccaagtccaccatcggggtcgagttcgccaccaggagcatcagggtcgatgacaaggtcgtcaaggcccagatctgggacaccgccgggcaggagaggtatcgggcaattacaagtgcttactatcgaggggctgttggcgcacttgtcgtgtacgacgtgacacgccatgtgacctttgagaatgtggagaggtggttgaaggagctccgggatcacacagatgcaaacattgtcatcatgcttgtcggcaacaaggctgatctgcgacaccttagggctgtatctgttgaggatgccaagggctttgctgagagggaaagtaccttcttcatggaaacttcagcactggaggccatgaatgtcgagagtgccttcaccgaggtcctaactcagatctatcgtgtggtcagcaagaaggccctcgacattggcgatgaccccgcagctccaccaagagggcaaaccatcaatgttggaggcaaggatgatgtctctgctgtgaagaagtcagggtgttgttcatcttaaatcacatgaccatgaaaaggaaccatatgctcacctaatcacatgattggcaattgaaaatatgactcccttgtgctgcctagcctggttggttatgagattatgttggtacaccagaaaaaacgatttagaggttaaagagttttaactccaggttgggacagaaactaactttttgcagtgtcattgatatgcatggtctccttgtatggtttatatgcactactgttccacactaattgatattag

SEQ ID NO: 3519 - DNA, 914 bp, Petroselinum crispum
aataaaacacaagctgcttcatttcaaagttaaagatattttagttacaaacactgtgtgtatctaaacatggctgcatacagggcagatgatgactatgattatctattcaagctagttctaattggagattctggggtgggcaaatcaaatcttttgtctcgatttactaaaaatgagtttagcttagaatcaaaatcaaccattggtgttgaatttgctacaagaactattaaggttgatgacaagattgtcaaggctcagatttgggacactgctggtcaagaaaggtaccgtgcaatcacaagtgcttactaccgtggggcagttggtgcactgcttgtgtatgacgttactcgaaatatcacctttgagaatgttgagagatggttgaaagagcttagagaccacacagatgccaatattgtgataatgctggtaggaaacaaagctgacttgcgtcacttgcgtgctgttaccactgagactgcaaaggcctatgctgagaaagaggagacgttctttatggagacatcagcccttgaatctatgaatgttgaaagtgcattcactgaagttcttagccaaatttatcatgtggtcagccgaaaagcacttgaggttggggatgatcctgcagcactgcctaaaggacaaacaatcaatgttggctccaaggatgatgtttcagcagtcaaaaaattggttgctgctctgcctaattacacaagcatggcatcagtgagtgattgatattttggattttcagaaccaaacccatttagcagcataagttccttgacaagcccccttagtttatcttttcaatagttggaatggtttgagattgtaggaggcacagttctgagattgaagtctacacagaaatggagcattattatttttacaaatac

SEQ ID NO: 3520 - DNA, 980 bp, Arachis hypogaea
tttagtattcactcactcttcatccccaccgaaaacacctctctctctctctcacacacacatggcgtcatacaatagaggggacgatgactatgactacctattcaagctggttctcatcggtgactctggcgtcggaaaatccaacctcctctcccgcttcacccgcaacgagttcaacctcgaatccaagtccactatcggcgttgaattcgccaccagaaccatcaccgtcgatgataataaggtcctcaaggctcagatttgggacactgctggccaagaaagatatcgcgcaatcacaagtgcctactaccgaggagctgttggtgccttactagtttatgatgtcacgcgacatattacatttgagaatgttgagagatggttgaaggagttgagagatcacacggatgccaacatcatagtaatgctggttggcaataaagcagacctgcgtcaccttcgatccgtgtctaccgaagatgcaacagcattcgccgaaagggagaacatctttttcatggagacttcagcccttgagtctatgaatgttgacaatgcattcacccaagtcttgacacaaatatatcgtttgatgactcggaaagcgctcgaagctgggaacgatcctgcaggattgcctcaagggcaaacgataagtgtgggaaacaaggatgatgtttcggctgttaagaaagttggttgctgctctgagtgaatttgtatgaaaaatcaggcattttcatctcattctcaccatccttgttcctgaaacatgtaagtatcttgaatcccacacggctttttgtggaacctgttgctgataggattgaggtttgaattgaagataattgcacacttcatagggctttgattagtttatattatttctcatatttttcttatccacacttgttaatttcctttagtttacttttggcttgactggatctggttgtattagtttatgtaatttt

SEQ ID NO: 3521 - DNA, 1035 bp, Musa acuminata
ccatccccttccatcgtcaagctcggcgtcccccggcctccctctcgctctctcctctccctcgatccattcttctcgtcctcccattctctctcccgacgacgtctttcttcttctattctgtgggattaatacaaggagagagggaggaggaggagagtgataatggcgtacaaggcggacgaggattacgactacctgttcaaggtggtgctgatcggagactccggggtggggaagacgaacttgctctcccgcttctcccgtaacgagttcagctccgagtccaagtccaccatcggcgttgagttcgccacccgcaccatccgtgtcgacgagaagctcgtcaaggcccagatctgggacaccgccggccaagaaagatatcgagcaatcactagtgcatactacagaggagctgccggtgccctcgtcgtctatgacgtaactcgacatataacctttgagaatgtggagaggtggatgaaggaactcaagaaccacacggatgcaaacaccgtcatgatgctcttgggcaacaaggctgacttgcgtcacataagggccgtctcagtggaggacgcacaggcctttgctcaacgggagagggctttcttcatggagacatctgccctcgagtccatgaacgtggagactgccttcaccgaagtgctgacccagatctaccatgtggtcagcaagaaggtgcttgatctcggtgatgatccgtcggctgtgcccaagggacagaccatcaacatcggcgccgacgacgacgtgcaagctgctgctaagaaaaccggctgttgcgcagaatagttggtcatccgtccatctttggtgatcgttagctgcgtgctgcgtcgcatcttcatgtgacatttcttctgtaaagctcaagggggagagtaccttctcggacacattcatgcttcaggaacattgagcaccacacagggttttgtggctacctttttgcagaaacgcaaacttagtggatcttctcttgttcttcatttgatttgtactcccgac

SEQ ID NO: 3522 - DNA, 887 bp, Ambrosia trifida
gcgtccccgcctctctctctccaaccagatttcgatcacaataatcttgagataaaccctagaaatctctccacaatcacaaaccccttacaatccaacccacaaatcatcaaccataaaccacatcttacttcataatatcatggcggcttacagagccgacgacgactacgactacctcttcaaactcgtcctaatcggcgactcaggtgtcggcaaatccaacttattatcccgatttgctaaaaacgagttcaatctcgaatccaagtccaccatcggcgtcgaattcgccactagaagtatccgcgttgatgataagattgttaaggcccagatttgggatactgctggccaggaaaggtaccgcgcgatcacaagtgcatactacagaggagctgttggggcgctggtagtgtacgacacatcacgccacgtcacgtttgagaacgtcgagagatggttaaaagagcttcgtgatcacaccgacccaaacattgtgataatgttggtagggaacaaagctgacttgcgccatttgcgtgcagttcccactgaggaggcgaaaacgtttgctgaaaaggagaacatatactttatggaaacgtcagctcttgaggcgttgaatgttgaaaccgccttcacagaggttcttacacatatacatcaggttgtaagccgaaaagcactcgaagcaggtgaggatccttcagcgttgcctaaagggcaaaccattaatgtcgggtcaaaggatgatgctaacaagaaagttggttgctgctctgcttaaaaatgtgctaaggtttatctgagtaagtatcctctgcttcaaattatttggtccaattgtgtttttcatacaagttattagtttgcatgtaggattt

SEQ ID NO: 3523 - DNA, 817 bp, Ambrosia trifida
ctctctctctctactccaaccagatttcgatcacaataatcttgagataaaaccctagaaacctccacaaatcacaaacctcctacatacaaatcatcaaccagacacgcaatcataaaccttaatccacatcttatcataatatcatggcggcttacagagccgacgacgactacgactacctcttcaaactcgtcctaatcggcgactccggtgtcggcaaatccaacttattatcccgatttgctaaaaacgagtttaatctcgagtccaagtccaccatcggcgtcgaattcgccactagaagtatccgcgttgatgataagattgttaaggcccagatttgggatactgctggccaggaaaggtaccgcgcgatcacaagtgcatactacagaggtgctgttggggcgctggtagtgtacgacacatcacgccacgtcacctttgagaacgtcgagagatggttaaaggagcttcgcgatcacacagacccaaacattgtaataatgttggtaggaaacaaggccgacttacgccatttgcgtgcagttcccactgaggaggcaaaaaggtttgcggaaaaggagaacatttactttatggaaacgtcagctctcgaggcgttgaatgttgaaaccgccttcacagaggttcttacacatatacatcaggttgtaagccgaaaagcacttgaagcaggtgaggatccttcagctttgcctaaagggcaaaccattaatgtcgggtcaaaggatgatgctaacaagaaagttggttgctgctctgcttaagaatgtgctaaggtttatctgag

SEQ ID NO: 3524 - DNA, 1187 bp, Musa acuminata
aaaagaactccctctctcgttccaactcccagccaacgaaccatccccttccatcgtcaagctcggcgtcccccggcctccctctcgctctctcctctccctcgatccattcttctcgtcctcccattctctctcccgacgacgtctttcttcttctattctgtgggattaatacaaggagagagggaggaggaggagagtgataatggcgtacaaggcggacgaggattacgactacctgttcaaggtggtgctgatcggagactccggggtggggaagacaaacttgctctcccgcttctcccgtaacgagttcagctccgagtccaagtccaccatcggcgttgagttcgccacccgcaccatccgtgtcgacgagaagctcgtcaaggcccagatctgggacaccgccggccaagaaagatatcgagcaatcactagtgcatactacagaggagctgccggtgccctcgtcgtctatgacgtaactcgacatataacctttgagaatgtggagaggtggatgaaggaactcaagaaccacacggatgcaaacaccgtcatgatgctcttgggcaacaaggctgacttgcgtcacataagggccgtctcagtggaggacgcacaggcctttgctcaacgggagagggctttcttcatggagacatctgccctcgagtccatgaacgtggagactgccttcaccgaagtgctgacccagatctaccatgtggtcagcaagaaggtgcttgatctcggtgatgatccgtcggctgtgcccaagggacagaccatcaacatcggcgccgacgacgacgtgcaagctgctgctaagaaaaccggctgttgcgcagaatagttggtcatccgtccatctttggtgatcgttagctgcgtgcttcgtcgcatcttcatgtgacatttcttctgtaaagctcaagggggagagtaccttctcggacacattcatgcttcaggaacattgagcaccacacagggttttgtggctacctttttgcagaaacgcaaacttagtggatcttctcttgttcttcatttgatttgtactcccgactacaaacatctttctctaacatttgtttgctatctttgatccactgtgtatcatcaaaaacaaagtggtatatgtaaaactggttggttttaacttgatgtctaagttcttc

SEQ ID NO: 3525 - DNA, 1144 bp, Nicotiana benthamiana
cagaaaaaatgggggcatacagagcagacgacgattatgattacttgttcaaggtggttctaatcggtgattccggtgttggaaaatcgaaccttctgtccagattcagtcgtaatgagttcagcctggagtccaagtccaccatcggcgttgagttcgccactcgcagcattcgcgtcgaagataaggtcgttaaagctcagatttgggacaccgccggccaggaacgatatcgtgcaatcacaagtgcctactatcgaggagctgttggtgcattgctggtttatgacgttactcgccatgtgactttcgagaatgtggagaggtggttaaaggagctcagagatcatactgactcaaacattgtcgtaatgcttgtggggaataaggcagatttgcgtcacttacgggctgtttccaccgaggatgccaaagcatttgctgagaaggagagtacttttttcatggaaacatctgctctggagtccatgaatgtggaaaatgccttcacagaagtgctcactcaaatttaccgtgtcgtgagcaggaaagctcttgaagcaggagatgaccctgcagcattgcccaaggggcagggcagactattaatgtcggaaataaggatgatgtttcagcagtaaagaaagctgggtgctgttctgcttaaaacaagaaccaatcttatgttggacgatgttcgttcttctttttgagttcaaattatcatgtggcagtggtaatttctccttttctgtacaaggaattaaccacatgaattgcttagccgtcagagctctagtttactggtgctcacgttgggatttgagctgcagcccccctccttgagtgattcctcagcattctttatcgttgttcctatatttatcttagcttagtgtatgattgtagtatagcttgttatgaatatgtaggatagtgtgtattcgattgcaaagatagaactgaggcatgtttgaacagattattttgcctgtgactctattgtttcgctagtcattgtagactacggaatatttgatcaatttctcagggtatctgacatgaattcattgtttatcttttccttaatgagtcgaattgacacctcaaatcagggaaggtttgatgatgtattcggtgcaaa

SEQ ID NO: 3526 - DNA, 906 bp, Eutrema halophilum
tttttttatgacatcagtgtttcccctggaaatttgaatctctctttttttttgcgtctcttcttccccttgctcgatacgcgctttattttcaagaaatctccgatccaatagtttccaaagagagattctacaatcgaaaaatcctcacaatggcggcgtacagagccgacgacgactacgattacctcttcaaggtggtgttgataggagactccggtgtcggaaaatccaacctcctttctcgattcacgcgcaatgagttcagcctcgaatccaaatccacgatcggcgtcgaattcgccacccgtagcatccatgtcgatgataagatcgtcaaagcccagatttgggataccgctggccaagagaggagcgttgcttgctatgatgtcacaaggcatgtgacctttgagaatgtcgaaagatggttaaaggagcttagagatcacacagattccaatatcgtcatcatgttcgttgggaacaaagcagatctccgtcacctacgagctgtttcaaccgaagatgccaaggctttcgcggagagagagaacactttcttcatggagacatcagctcttgaatcgttgaatgtcgagaatgctttcaccgaagtgctttctcagatttaccgtgtggttagccgtaaagcgcttgatcttggagatgatccgacagctcttcccaaaggacagaccatcaatgttgggtctaaagacgacgtctctgcggttaagaaggtaggttgttgctcaacttgatggctccacgtccaagaatcagatttactccggttcagaaaactgttgtgtcaatcttgtttgttcatttttctttctttgtcatatgtgaagatcttgttcgtttatatgtatatcatacccatagaagcatactcaaaac

SEQ ID NO: 3527 - DNA, 661 bp, Nicotiana benthamiana
tctggagtccatgaacgtggaaaatgccttcacagaagtgctcactcaaatttaccgtgtcgtgagcaggaaagctcttgaagcaggagatgaccctgcagcattgcccaaggggcagactattaatgtcggaaataaggatgatgtttcagcagtaaagaaagctgggtgctgttctgcttaaaacaagaaccaatcttatgttggacgatgttcgttcttctttttgagttcaaattatcatgtggcagtggtaatttctccttttctgtacaaggaattaaccacatgaattgcttagccgtcagagctctagtttactggtgctcacgttgggatttgagctgcagcccccctccttgagtgattcctcagcattctttatcgttgttcctatatttatcttagcttagtgtatgattgtagtatagcttgttatgaatatgtaggatagtgtgtattcgattgcaaagatagaactgaggcatgtttgaacagattattttgcctgtgactctattgtttcgctagtcattgtagactacggaatatttgatcaatttctcagggtatctgacatgaattcattgtttatcttttccttaatgagtcgaattgacacctcaaatcagggaaggtttgatgatgtattcggtgcaaa

SEQ ID NO: 3528 - DNA, 1029 bp, Raphanus sativus
ttttttcttcccctttcttagcgattacattagaatctccgatccgatccttccgtgatcctcgtaatggctacgtatacagctgacgacgattacgacttcctctacaaagtggtactaatcggagactccggcgtcggcaaatccaacctcctctctcgattcacacgcaacgagttcagcctcgagtccaaatccaccatcggcgtcgaattcgccaccagaaccattcacgtcgacgacaaaatcgtcaaagctcagatttgggacaccgccggtcaagaaagataccgagcgatcactagcgcatactatcgaggagctttaggagcattacttgtctacgacgttacacggcacgtgactttcgagaacgtcgagagatggctcaaggagcttagagaccacaccgacgccaacattgttattatgctcgttgggaacaaggctgatctgcgtcaccttagagctgtttcaacggaagatgctacggcgtttgctgagagggagaagactttctttatggagacgtccgcattggaagctttgaacgttgaggatgctttcactcagctgctttctcagatataccgtgtggctagcaaaagagctttggatgttggtgatggtgatgatggtgatcggtctgctctccctaaaggacagagtgttgatgtcgggtctaagggagatgtgtctgaggttaagaagatcggttgctgctcgagttgatctcagttgttagaggaactatgtggttttgagtaaatctatggaacggatgatgattctcccttgtcttgttacttttggtgtaagctagtttctcggatccttataaatgttttatctatgtgttacatgatcatattagacaatctataaaccatttatccctctggtttacatattgggcagatcaagaacctgaagtttctgtatagactttccaaaagggttctttttttgtttggacattgtctttgttgtaattaagccgagtaatgaaaatggtttagatgtgtaata

SEQ ID NO: 3529 - DNA, 770 bp, Cyclamen graecum
tcgcctttcacggatcatattcagtcgccggagagatatgacggcggcggcgtacggtgccgacgaagactacgactacctcttcaagctggttctcatcggcgactccggcgtcggaaaatccaacctcctctctaggttcaccaagaacgagttcaacctcgagtccaagtccacaatcggtgtcgagttcgccactcggagcatccgagtcaacgataagatcgtcaaggcacagatttgggacaccgctggccaagaacggtaccgagcaatcacaagtgcatactaccgtggagctgtaggcgctttgctcgtttatgatgtcactcgaaacatcacatttgagaatgtggagagatggttgagagagctccgcaatcacacagactccaacattgtgataatgctcgtgggaaacaaggcggacttgcgccacctgcgcgccgtcccgatggaagatgcaaaggcctttgccgagagggagaatactttcttcatggagacttccgcccttgagtctctcaacgtcgagaatgcattttcggaagttcttacgcagatatataatgtcgttagcaggaaagcgctcgaagcagggaatgatgctacttctttacccaagggagaaaccatcaatgtgggacgcaaagacgatgtctcagccatgaaaaaagtcggttgctgctccgaatagttgccgcagtgaaggaaaatgagacgaagaaaacccctttggtcaaggacgattgtatgttacttatttcttg

SEQ ID NO: 3530 - DNA, 1007 bp, Gossypium hirsutum
gggattcataattaaaatcccaattttattttcaatatccggtaaaagaatccgacccggtaacccgacatggcagcgtatagagcggatgacgactacgattatttgtttaaggtggtgttggtcggagattccggcgtcgggaaatcgaatttgttgtcgagatttactagaaacgagtttagccttcaatctaaatccacaatcggtgtcgaatttgccacccgaagtattcgggtcaatgataaaatcgttaaggcccagatttgggacactgctggacaagaaagataccgggcaattacaagtgcatactaccgaggagctgttggtgccttgcttgtctatgatgtcactcgacgggtcacgtttgagaatgttcagagatggctgaaggaactacgagatcatacagattctagcatcgtgattatgctcattggtaacaaggccgacctgcgacacttgtttgccgttaccactgacgatgctaaggcctatgccgagagtgaaaacaccttctttatggaaacatctgccctcgaatcaacaaatgttgagcatgcattcactgaagtactaactaaaatacatcatgtgatcagtcgaaaagcgctcgaaggagggaatgatcaaacaacattgcccaagggacaaaccatcaatgtcggatctcgggatgatgtttcagctgtgaagaaagacggctgctgttctgcataattgttagatgattccgagtgtccaaatttacttcctcatttagcataagctttcctcaccgtgatctttttcgagatctttcgttgaagatgaagaaatcacagcattccagggattttcttcattcgatttcagttcctttttcatggttctttagggtatttttcttctcatgtaatgttccattccatagtttttgttgtatttgattgctttagaatacatagtttggtcagacagatctagttttagtattttaaatgtactttcatttagttgtggag

SEQ ID NO: 3531 - DNA, 878 bp, Ambrosia trifida
tctccaaaaacagaaaaaaaaaaactttatctattaaatctccatttcgaaaagcgtccccgcctctctctctccaaccagatttcgatcacaataatcttgagataaaccctagaaatctctccacaatcaatcacaaaccccatacaatccaacccacaaatcatcaaccataaaccttaaaccacatcttacttatcatggcggcttacagagccgacgacgactacgactacctcttcaaactagtcctaatcggcgactcaggtgtcggcaaatccaacttattatcccgatttgctaaaaacgagttcaatctcgagtccaagtccacaatcggcgtcgaattcgctactagaagtatccgcgttgatgataagattgttaaggcccagatttgggatactgctggtcaggaaaggtaccgcgcgatcacgagtgcatactacagaggagctgttggggcgcttgtagtgtacgacacatcacgccacgtcacctttgagaacgtcgagagatggttaaaagagcttcgtgatcacaccgacccaaacattgtgataatgttggtagggaacaaggccgacttgcgccatttgcgtgcagttcctactgaggaggcgaaaacgtttgctgaaaaggagaacatatactttatggaaacgtcagctctcgaggcgttgaatgttgaaaccgccttcacagaggttcttacacatatacatcaggttgtaagccgaaaagcactcgaagcaggtgaggatccttcagcgttgcctaaagggcaaaccattaatctcgggtcaaaggatgatgctaacaagaaagttggttgctgctctgcttaagaatgtgctaaggtttatctgagtaagtat

SEQ ID NO: 3532 - DNA, 801 bp, Cedrus atlantica
ttaaggtggtactgattggggactctggtgtgggcaagtctaatctgctgtcgagatttactagaaacgagttcagcttggagtccaagtctaccattggagtggagttcgccactcggagtataacggttgatgataaggtcataaaggcgcagatttgggatacagctggtcaagagagataccgggctataacaagtgcatattatcgaggagcagttggtgcactgttagtttatgatgtaaccagacatgtaacctttgagaacgtggagagatggcttaaggagcttagggaccacactgatgccaatattgtgataatgcttgttggtaacaaggctgatttgcgtcatcttagagctgtttctgtcgaggatggcaaagcatttgcagaacgagaaaatacatatttcatggaaacatcggctctggaatcaacaaatgttgagaatgcattcacagaagtacttagtcagatttaccggattgtgagtaagaaatctcttgatgttggggaggacccagcagcagtgcccagtaaaggacagacaatacacgttggtaataaggatgatgtgacagcaatgaagaaagttgggtgttgttctgtataggcccaaagtgcaatgctttagtgttgtcttctaaagcttttggttttaaagcaactcttttcaagaattgatttaaatatgtcaagggaagtatcgatggttgcctgtcagttttaagagacaagcaccctgctatacctatttctctgtatgacttatcagtgaacatttgatgctcttggat

SEQ ID NO: 3533 - DNA, 856 bp, Nicotiana benthamiana
aaatgggagcatacagatcagaggaggattacgattacctgttcaaggtggtactcataggggattctggtgttggcaaatctaacttgctttctcgctttactaaaaacgaattcagccaacaatctaagtccactattggtgtcgagtttgccacccgaaccattcatgtcgatgacaagattatcaaagcccagatttgggacactgccggccaagaaaggtaccgagcgatcacaagtgcttattatagaggagcagttggtgctttacttgtttatgatattactcgcaatgtaacgtttgagaacgtagcaagatggctcaaggaactcagagatcatacagaccagaacatcgtcgtcatgctagtcgggaacaaggcggatttacgccacctgcgtgctgttccgactgaggactcaaagggttttgccgaaagggaacgtaccttcttcatggaaacatctgctctagaggcactgaacgttgaaaacgccttcacagaagtgctgactcagatttaccgggtggtcagcaagaaggctcttgatgcaggagacgacccagcgtctctgcctgctggacaaacaatcaatatcggaaacgatgtatctgctgttaagaaggggggatgttgttcaggttgagcaaggatcaaccactcactactacatttctcagaatgcagctataatttgaaactgcagaatatgcaaagctgctgacagtttcagcttcctgtacaaaattgtatagcaattcccagtctacgactgtatactatccaaaagaagaattccagaaccttagtggggggaaatgggtgatgcaagtaaattttgctaaagaacca

SEQ ID NO: 3534 - DNA, 1305 bp, Podocarpus macrophillus
ccacatccctggatccaatacccacatgcttgatcagtccttttccaaccgcgagtgtataccatacaatacccatatggtagatcggcctattttaatagcatatacttacagtctatccatccaacaaggctagggtttctgatccttcttcctcgtctatctatctcagctccggggtgtctggcatagattgatatttagtgcttgtctatctattgaatcggatattgggtgtgcctgcaacaattggattaaggactgaggcctgatatagatacatttgtgtatattccaggtcttgggtccttgacacccaagatttttgtttggagggaagatggcttacaaggcagatgatgactatgactatcttttcaaggtggttctgattggggattctggtgtgggaaagtccaatcttctgtccagatttaccagaaatgaattcagtttggagtccaagtctaccattggtgtagagtttgcaacgaggagcatcaatgttgatgggaagatgattaaggcccaaatatgggacactgctggtcaagagagatacagggcaattacaagtgcatattatcgtggagctgttggtgcattgttggtttatgacatcactcgacatgtcacttttgaaaatgtggagaggtggctcaaggaacttcgtgatcatacagaacataatattgtggtgatgcttgtaggcaacaagtctgatttacgccatttgagggctctttccactgaagatgcccagacatttgccgaaagagaaggcctttatttcatagagacttctgctctagaatctacaaatgtggaaaatgctttcaagcaggtactaactcaaatctacagggttgtgagtaagaaggccttggatgcttcggaagacaattcagctgctcctccacaaggccaaacaataaatgtcaaggatgatgtcacagctactaagaaagctggctgctgtagcacataagcaagatcatcataattctaattactgcccagagcaggaaatattccataacctttgttatgtagagaatatctggtcaatttctcgaagtacttatctttttccctttttggatttgagcatctcatcatttggttagttcaacaggcttcaattcaatataaatagaggggttgtaggatgaagagaacatagattatgattattgagttgagtttttcttattgtttattttctgagacccttctcaatgccattgcttagtgttatgcctttggcttctatttcaacatgccatcatttgtatctgttgattc

SEQ ID NO: 3535 - DNA, 1260 bp, Pteridium aquilinum
cgttacaagttgggaagccctaatcttggctaaccctaacgcccgccatcaaagctgtacctgtaaaaccctaatctttgtccctgtaagcctgacatattaccttgtgcctgcgctgtgcgagaccgtaatttgggcttctctgagtctgtgcttacttgtctgtcgtttgcaaaaccctaatcttagctaaatcctcagtggcttgccgtacattttgctcttcagagtcctagtttcgacttgtacagttctccggaaacgcttgattgtggctctccactgtgtgcgcttgtctaattcctaactgtgacatttgtacgctctgtggaaccctaaccctaatctgctgggaggcttgagctattctgtcaaagagatggcatacagatctgatgatgactatgattatctgttcaaggtagtcttgattggagattcgggtgttggaaagtcgaatctgctctcgcgattcacgcggaatgagttcagcttggagaccaagtccaccattggagttgagttcgccacacgcaccatcaacgtagatggcaagatggtcaaggcgcagatttgggacaccgctggccaagaaagatatagggcaattacaagcgcgtactaccgaggtgcagtgggtgcgctcttagtgtacgatttgacgagacatgtgacctttgaaaatgtggagaggtggttgaaagagctcaaggatcacacagatacgaacattgttgtgatgttggtaggaaacaagtccgacctgcgccacttgagggcagtgtcgacagaggatggccaagcttttgcagaacaagagagtctgtacttcatcgaggcatctgctttggaatccaccaatgtggagaatgccttcaagcaagtactgactcaaatatatagggtggtcagcaagaaagctctcgatgttggcgaggatccttcagcggttcctagccaaggccaaactgtcaacgttggcagcaatgatgttagtgcgactaagaaggttgggtgttgctcagcttagaagaggttggttggcgggctgtaatttatccatcgtcgcgagtagagatttttattaatttttgggttctgtagtctttgtgggttgacaatgaaatcaacccccttgtgtgattttgagccctagtttttgtgggtattgaaggaggccggccaacttcaagagggctgtgacgacgtcttgtttatattgacaattcatgttctcacaaggaattctttaggccttta

SEQ ID NO: 3536 - DNA, 858 bp, Solanum phureja
gaaattatgggaacatatagatcagaggaagattatgattacttgttcaaggtggtgttaataggggattctggtgttggtaaatcgaatttgctatcgcgatttaccaaaaacgaattcagccaacaatctaagtcgactattggcgttgaattcgccactcgaaccattcatgttgatgacaagattgtcaaagcccagatttgggacactgctggccaagaaaggtaccgggctatcacaagtgcttattatagaggagcagttggtgccttacttgtttacgatattactcgccatgtaacatttgagaacgttgcgagatggctcaaggaactcagagatcatacagaccagaacattgtcgtcatgctggtcgggaacaaggcagatctccgccacctgcgtgctgttcccactgacgactctaaaggttttgcagaaagagagaataccttcttcatggaaacctctgctcttgaggcgctgaatgttgaaaacgccttcacagaagtgttgactcagatttaccgggtggttagcaagaaggctcttgatgcaggagacgatccagcatctttgcctgcaggacaaacgatccatattggaaatgacgtatctgctgttaagaaggggggatgttgttccggttgagcaaggatcaaccgctcactactacatttctcacaatgcagatatatgaactgcagaaaaatgcaggaatgctgagaatttcaggtttcctgtacaaaaactgtatagcactcccactctacgactgtaatttagtggaaagaaaaatttgaggaaccgaggtggggaaatgggggatggaagtaaaattttgcttaagaacca

SEQ ID NO: 3537 - DNA, 889 bp, Fagopyrum esculentum
gtgctgatcggagactctggtgttgggaagtccaatcttctctctagattcactcgtaacgagtttagtcttgaatctaagtccacgattggagttgagttcgctactcgtagtgttcgtgttgatgagaagatcgttaaggctcagatttgggatactgctggccaagaaaggtatcgtgccatcactagtgcatactacagaggcgctgttggtgctctactagtctatgatgtaaccagacacgtcacgtttgagaatgtggagagatggttgaaggagctgagggatcacacagagaccaacattgtgataatgcttgttggaaacaaggctgatttgaggcacttacgtgctgtaagcaccgaagatggcaaaacctttgctgagaaggagaacacattcttcatggaaacatctgccctcgagtccataaacgttgagaatgctttcactgaagtacttacccaaatatacaatgtagtaagcaggaaagcacttgaaatcgggggagaccctgcagccttgcccaaaggacaaactatcgacatcagcggcaaagatgacgtttcagctttgaagaaggatggttgctgttcttcataaactaaaaggcaaatcacttaactttgtgatatacttgaatttgtgtcattccttcactttcaggaatcaccgtgatcaagccagtgctaattcttgcaaggctatttatcgaggtatacattttggagtgcttctgttgaggaaatatgtgcggtccttttaatcaatccatttataggatatagactgtggaattgaaattccagtttctcacatttgctatatgattttgttatctttccatcagggtactgataatttggcttgtattttattctttgat

SEQ ID NO: 3538 - DNA, 940 bp, Selaginella moellendorffii
agggaggaagtgtttatttcttttagcgccttgccgcctttgctgatcgatctccccagctccgggggcattttcctcgcctcgatctcggccgcgtagcgagagatccagcgccatggcgtacagatcggacgaggactacgattatctcttcaaggtagtgctgattggggactccggcgtcggcaaatccaacctcctctccagattcacgcgcaacgagttcagcctcgagtccaaatccaccatcggcgtcgagttcgccacgcgcagcatcaacgtcgacggcaagctcgtcaaggcacagatttgggacacggcaggccaggagagttcttgcgcaggtatcgggccatcaccagcgcctactaccgcggcgccgtgggagccctactcgtctacgacatcacccggcccgtcacgtatgaaaatgtggagcgctggctcaaggagctcaaagaccacaccgattccaacatcgtggtgatgctggtggggaataagtccgatttgcgccacctccgggccgtgtccaccgaggacggccaggccttttcggagcgcgagggactctacttcatggagacgtccgccctcgagtccaccaatgtggagaacgcgttcaagcagatactgacacagatttaccgggtggtgagcaagaaggcgctcgacgttggcgaggatccatccgcggcccctgccaagggccagaccatcaacgttggcggcaaggacgatgtgaccgcaaccaagaaggttgggtgctgctcggcgtgaaggatctctagctggtttcgatcgatccatctgggtagcaatgtttagatcacgcgtcaaggctttgggtggttctctgatagctacgaattcttttgctccttctaggtagcagattctttaaatacttttttctctcttcaactactttcatgtgtgc

SEQ ID NO: 3539 - DNA, 1577 bp, Abies balsamea
ccggtaacagtgtttcacatctccaaggctgccaaagctgaaaattgatctcacacacacaacctctcttttgggtgtttatttggggcacccaatacgcagagatctggatccaatacccatttcccatatcagggtaaatctctgcatcgactggatatttattgtgtatccgttcattcaacggttgattgggtttctgcaataacttgatatattcatgttgtgtatccatccaaccagttattgggcgtctgcaataggctgatattaggtatctatccattgaaccagctattgggcttatgcaataggctgatattcattgtgtatccattgaacaggctattgggttcttgcgatagcttgatattcatcgtttatccatccagcccaatactgggtgtctgcgatagcttgatattcatcgtgtatgcatccagccaatactgggtgtctttaataggttgatattcattatctatccattaaaccggaaactgggtttctgtaataaggtgaaattaactgcgcagctatccatttaggtcttgggttctcgaggatccccaagagttatttttggtgccgtgtggagatggcttacaaggtagatgatgattatgactatctgtttaaggtggttctgattggggattctggtgtcggtaagtccaatctgctctccagattcactagaaatgaattcagcctggagtccaaatctaccattggcgtggagtttgcaacaaggagcattaatgttgacgggaaaatgatcaaggcccagatatgggacactgctggtcaggaaaggtacagagccatcacaagtgcatattatcgtggagctgttggtgcattgttggtctacgacatcactcgacatgtcacctttgaaaatgttgagaggtggctcaaggagcttcgtgatcatactgagcacaacatagtggtgatgcttgttggtaacaagtcggatttgcgacatttaagggctgtttccacagaagatgcccagacgtttgcagaaagagaaggtctctatttcatagagacatctgctctagagtctaccaatgtggaaaatgctttcaagcaggtgctgactcaaatatacagaattgttagtaagaaggccctggatgtttccgaagataatgcagcagctcccccacaaggtcaaacaatcaatgtgaaggatgatgtcacggcaactaagaaagttggttgctgtagcacgtcataagcaggtgaagttactcaggattcagatttcagttcagatgcataactattatgttcattagaaaacttcgactgatttctggaatcacatacatttgaattcgagcagcttctcatttggtttgattttaagaggcttcaaggtaggactcatttagtaacagttttagacggagatgagagtgttgtagcctatggtgagtaatctaaattgtatatcttatttttgctgtattttcttatacttttagtgtcccagtgctcactttgttctactcagtggctttagttttacatgccattatttgtatccattatttcattttatt

SEQ ID NO: 3540 - DNA, 768 bp, Brassica napus
atttcctctacaaggtggtcctgatcggagactccggcgtcggaaaatccaacctcctctctcgcttcacccgcaacgagttcagcctcgagtccaaatccacgatcggcgtcgagttcgccaccagaagcatccgcgtcgacgaaaatgtcgtcaaggctcagatttgggacacagccggccaagaaaggtaccgagcgatcacgagcgcgtactatcgaggagccgtaggagcgttccttgtctacgacgttacgcggcgcgtgacgttcgagaacgtcgagaggtggctcaaggagctcagagaccacacggacgccaacatcgtctgtatgctcgtcggtaacaaggctgacttgcgtcacctacgagccgtttccaccgaagacgcaacggcctttgcggagagagagagcacgttcttcatggagacgtctgcgctcgaagctttgaacgtggaggacgctttcactcaagtgctttctcagatataccgcgtggcgagcaagaaggcgttggatgttggtggagacgatcacgctgcgttgccaaaagggcagagtattaacgttgggggtaaggatgatgtctctgaggtcaagaaggttggttgctgctcaagttgatgttttcttgtaatgttgtatctatttttttttgttcacgttatcatattcaacaatctatgaacaaagaaggtaaaaaaaaacttcaggggccaaccaaagaaagcatgtactttagttttttttttagtctaagattggc

SEQ ID NO: 3541 - DNA, 1463 bp, Cedrus atlantica
gtcgtcgtccgtcgtcctccaccactacacactacaatactgagcacacacactctcttgttggtgttgttcggtaccatgcccagagatctggatccaatccccatttcctatatcagtggtaaatctctgcatcagcttgatattcattgcgtatccgtccattcaatagatggttgggtttctgcaataagctgatatattcattgtgtatccatccaatcaattattgggcgtatgcaataagctgatatattccttatctgtcgattgaaccagcatattgggtttatgcaataagctgatattcattgtgtatccattgaacaggttattagggttctgcaataacctgatatttattgtgtatccttcacaggccagatagtcggtgtctgcaatagtctgatattcattacctatccattgaaccggctattgggtttctgcaataaggtgaaattaactgtgcagctatccattcaggtcttgggttcttgaggatacccaagagttcgtttggtgctgcgtgtagatggcttacaaggtagatgatgattatgactatctgtttaaggtggttctgattggagattctggtgttgggaagtccaatctgctctccagatttactagaaatgaattcagcctggagtccaaatctaccattggtgtggagtttgcaacaaggagcattaatgttgatggcaaaatgatcaaggcccagatatgggatactgctggtcaggaaaggtacagagccatcacaagtgcatattatcgtggagctgttggtgcattgttggtctatgatatcactcgacatgtcacctttgaaaatgttgagaggtggctcaaggagctacgtgatcatactgagcacaacattgtggtgatgctcgtcggtaacaaatctgacttgcgtcatttgagggctgtttcgacagaagatgcccagacctttgcagaaagagaagggctctatttcatagagacatctgctctggagtctaccaatgtggaaaatgctttcaagcaggtgctgactcaaatatacaggattgttagtaagaaggctctggatgtttcggaagataatgcagcagctcccccacaaggtcaaacaatcaatgtgaaggatgatgtcacggcaactaagaaagttggttgctgtagcacatcataagcaggtgaagttactcaggcatcagatttcagttcagatgcacaactactgtgttcattagtaaacttcaacagatttctggaatcatttatatttgacttcgagcaggctctcatttggtttgattttaagaggcttcaaagttggacttagtaactagttttagacggagagaagagtgttgtagcctatggtgagtaatctgatttgtatatcttcttcttgctgtattctctgaaacttttagcgtcccagtgctcactttgttctagtcaat

SEQ ID NO: 3542 - DNA, 800 bp, Centaurea maculosa
cacccaaatcttttccaataaaaatctcaaatccttcttcacattcacaccccatctccctccctaaaccctacttcacatttgcattcattgccttcccaattctctcaacaacacacagatctgcaaaaccctaaatcaaatcaaacttacaaaaacaaacaaattcttgcttaatttcatcctgttaaacatcaatgggtgcttacagagcagaggatgattacgattacttgttcaaagtggttctcatcggtgattctggagtcggaaagtcgaaccttctgtccagattcactcgaaacgagttcagtctcgagtctaaatccaccatcggagttgaattcgctactcgaagcattcgtgtggatgataaagttgttaaggctcagatttgggatactgctggtcaggaaaggtaccgtgcaattacaagtgcatactaccgaggtgcagttggcgcattgcttgtttacgatgtcacacggcacgttacttttgagaacgtagaaaggtggttaaaagagctccgggatcatacagattccaacattgtcattatgctcgtgggaaataaagccgatttgcgtcatttacgggccgtacaaactgaagatgccacatcatttgccgaaaaggagcacacttacttcatggaaacctctgcgcttgaatcactgaatgtagaaagtgctttcacggaagttcttacgcaaatctatcaaattgtcagcagaaaagcacttgaatctggtgatgatgcggctgcggtacctaaagggcagacgattaatgtcgat

SEQ ID NO: 3543 - DNA, 784 bp, Centaurea maculosa
aaaatctcaaatccttcttcacattcacaccccatctccctccctaaaccctacttcacatttgcattcattgcttccccaattctctcaacaacacacagatctgcaaaaccctaaatcaaatcaaacttcaaaaacaaacaaattcttgcttaatttcatcctgttaaacatcatcaatgggtgcttacagagcagaggatgattatgattacttgttcaaagtggttctcatcggcgattctggagtcggaaagtcgaaccttctgtccagattcactcgaaacgagttcagtctcgagtctaaatccaccatcggagttgaattcgctactagaagcattcgtgttgatgataaagttgttaaggctcagatttgggatactgctggtcaggaaaggtaccgtgcaattacaagtgcatactaccgaggtgcagtcggcgcattgcttgtttacgatgtcacacgacacgtcacttttgagaacgtagaaaggtggctaaaagagctccgggatcatacagattccaacattgtcataatgctcgtgggaaataaagccgatttgcgtcatttacgggccgtacaaactgaagatgcgacatcatttgccgaaaaggagcacacttacttcatggaaacctctgcgcttgaatcactgaatgtagaaagtgctttcacggaagttcttacgcaaatctatcagattgtcagcagaaaagcacttgaatccggtgatgatgcggctgcggtacctaaagggcagacgattaatgtcgatga

SEQ ID NO: 3544 - DNA, 1160 bp, Cephalotaxus harringtonia
gataaaaacttaccatgttctttctggttttttaggtacccaatacctcctgagcatttcccatgtcattggattcgatacccatctcttagttcagcttatttcaacaagttgatatattcactgcgtatccatccaaccaggcctagggtctctgatatttgttcattgtgcatctattcattgaaccagggtcacctgcaatagcttgatattcactgtatatctatctattcattgaaaccatcttttgggtgtgtttgacataattttattgtaattttttccattggacaagtgatatatctgttccttacgaacataggtcttgggtttttgatacccaagaattttttttgtgtcctgggaagatggcctataaggcggatgatgattatgactatctgtttaaggtggttttgatcggagattctggtgtggggaagtccaatctgttgtctagatttactagaaatgaatttagcctggagtccaagtctaccattggtgtagagtttgcaacaaggagcatcagtgtagatgggaagatgatcaaggctcagatttgggacactgctggtcaagagaggtacagggcaattacaagtgcatattaccgtggagctgttggtgcattattagtttatgatatcacccgacatgttacctttgaaaatgtagagaggtggctcaaagaacttcgtgatcacacagagcataatattgtggtgatgctggtgggcaacaagtctgacttacgccatttgagggctctttccactgaagatgcccagacatttgctgaacgagaagggctttatttcatagaaacatctgctctggagtctacaaatgtggaaaatgctttcaagcaggttcttactcaaatctacagagttgtgagtaagaaggccctggatgcttcggaagatactgcagccgctcctccacaagggcaatctataaatgtcaaggatgatgtaacagccactaagaaaatgggttgttgtagcatgtaagcaagcagatctcgaattcagatctctgtccagtgcagaaaatattattccataactgttgttttcagtggaaaatgcctggacagtttctggaattattttcctaagtttttttttcaatttgagcaggttggttagaat

SEQ ID NO: 3545 - DNA, 1093 bp, Gossypium raimondii
ctctgctattttataaaatttcttcataattaaaatcccaaattttaattttaaaaaatccggtaaaagaatccgacccggtaacccgacatggcagcctatagagtggatgacgactacgattatttgtttaaggtggtgttggtcggagattccggcgtcgggaaatcgaatttgttgtcgagatttactagaaacgagtttagccttcaatctaaatccacaatcggtgtcgaatttgccacccgaagtattcgggtcaatgataaaatcgttaaggcccagatttgggacactgctggacaagaaagataccgggcaattacaagtgcatactaccgaggagctgttggtgccttgcttgtctatgatgtcactcgacgggtcacgtttgagaatgttcagagatggctgaaggaactacgagatcatacagattctagcatcgtgattatgctcattggtaacaaggccgacctgcgacacttgtttgccgttaccactgacgatgctaaggcctatgccgagagtgaaaacaccttctttatggaaacatctgccctcgaatcaacaaatgttgagcatgcattcactgaagtactaactaaaatacatcatgtgatcagtcgaaaagcgctcgaaggagggaatgatcaaacaacattgcccaagggacaaaccatcaatgtcggatctcgggatgatgtttcagctgtgaagaaagacggctgctgttctgcataattgttagatgattccgagtgtccaaatttacttcctcatttagcataagctttcctcaccgtgatctttttcgagatctttcgttgaagacgaagaaatcacagcattccaggtattttcttcattcggtttcggttcctttttcatggttctttagggtatttttcttctcatgtaatgttccattccatagtttttgttgtatttgattgctttaggatacatagtttggtcagacagatctagttttagtattttacatgactttcattagttgtggagaataaattttaaattagctatcataatgtttttgtattttcaaaggagtattttaagtaatataaca

SEQ ID NO: 3546 - DNA, 1629 bp, Picea glauca
agccaagtggatccggtaacagtttttttgatctccaaggctgccagaactcaaatctgatcacacacaactctctctttggggtgtttatcggggctttgggtgtttattgggggcacccaatgcccagagatctagatccaataccatttcctagatcagtgtaaatctccgcgtcagcttgatattcagtgtgtatccatccattcaacaggtgattgggtttctgcaataacttgatatattcattgtgaatccatccagccagttattgggcatctgcaataggctgatattcattatctatccattgaaccagctattgggtttatgtaatagaccgatattcgttgtgtatccattgaacaggctattaggtttctgcaataacttgatattcattgtgtatccatccggccagatattgggtgcctgtaataggccgatattcattatctacccattcaaccggctattgggtttctgcaataaggtgaaattaactgtgcagctatccattcaggtcttgggttcttaaggatacccaagagttcgtttggtgctgtgtggagatggcttacaaggtagatgatgattatgactatttgtttaaggtggttctgattggggattctggtgtgggtaagtccaatctgctctccagatttactagaaatgaattcagcctggagtccaaatctaccattggtgtggagtttgcaacacggagcattaatgttgatgggaaaatgatcaaggcccagatatgggacactgctggtcaggaaaggtacagagccatcacaagtgcatattatcgcggagctgttggtgcattgttggtctacgacatcactcgacatgtcacctttgaaaatgttgagaggtggctcaaggagcttcgtgatcataccgagcacaacattgtggtgatgcttgttggtaacaagtccgacttgcgccatttgagggctgtttccacagaagatgcccagacctttgcagaaagagaagggctctatttcattgagacatctgctctagagtctaccaatgtggaaaatgctttcaagcaggtactgactcaaatatacaggatcgttagtaagaaggccctggatgtttcggaagataatgcagcagctcccccacaaggtcaaacaatcaatgttaaagatgatgtcacggcaactaagaaagttggttgctgtagcacatcataagcaggtgaagttacccaggattcggatttcagttcagatgcataactattatgttcattagaaatcttcgaccgatttctggaatcacttatatttgaattcgagcaggttctcagttggtttgattttaagaggggcttcaaagttggactcacttagtaactagttttagacggagagaagagtgttgtagcctatggtgagtgatcagaattgtatatcttattcttgctgtattctcttaaacttttagtatccaagttctcactttgttctagtcagtggcttcagttttacatgccatcatttgtatcgattatttcattttattcttacagtggaagacagatttttttgatcttagttaatattatatgaaaatatcctttggtttgatcttttacta

SEQ ID NO: 3547 - DNA, 1047 bp, Solanum lycopersicum
atttcttctctttctcccctcaaccatccgatataaacggaggttaaatatacaccatttgttaatagtaaaatgaatcgaatcgatgaatattcgtgttattcttcttctttcatccctaattcaaaggaagatagagaaaacactccataattaactgatcttatgtacaagttaagagaaaaaggaaattatgggaacatatagatcagaggaagattatgattacttgttcaaggtggtgttaataggggattctggtgttggtaaatcgaatttgctatcgcgatttaccaaaaacgaattcagccaacaatctaagtcgactattggcgttgaattcgccacccgaaccattcatgttgatgacaagattgtcaaagcccagatatgggacactgctggccaagaaaggtacagggctatcacaagtgcttattatagaggagcagttggtgccttacttgtttacgatattactcgccatgtaacatttgagaatgttgcgagatggctcaaggagctcagagatcatacagaccagagcattgttgtcatgctggtcgggaacaaggcagatctccgtcacctgcgtgctgttcccacagacgaatcaaagggatttgcagaaagagagaataccttcttcatggaaacatcagctcttgaggcgctgaatgttgaaaacgccttcacagaagtgttgactcagatttacagggtggttagcaagaaggctcttgatgcaggagacgatccagcatctttgcctgcaggacaaacgatccacattggaaatgacgtatctgctgttaagaaaggcggatgttgttccagttgagcaaggatcaaccactcactactacatttctcagaaatgcagatagatgaactgcagaaaaatgcaggaatgcgagaatttcaggtttcctgtacaaaattgtatagcactccccactctaagaagttgtaacttggcggaaagaaaaatttgaagaactgaggtggggaaatgggggatggaagtaaaattttgcttaagaacca

SEQ ID NO: 3548 - DNA, 954 bp, Cucumis sativus
ggtctttcccatttccatttcacaatctcgaaacaacaagatcaaaaatccaccccccaaaaagcgcccattctgagatctacctatttccccatttctttttctcttactccaaccaaagttcttcttcagaaggggaactccgatggctggttacagagctgaagatgactacgattacctctttaaggtggttttgattggagattccggtgtgggcaagtccaatttgctctcaaggttcaccaaaaacgagtttagcctcgagtccaagtccaccattggggttgagtttgctactcggagtttgaatgttgatggcaaggttgtcaaggctcagatttgggatactgctggccaggaaaggtatcgtgcgataactagtgcttactatcgaggtgctgttggtgcactccttgtctacgatgtcacacgacattccacttttgaaaatgtcgagaggtggttaagggagttgcgagaccataccgatcctaacattgtggtcatgcttgttggtaacaaatcagatcttcgacacctggtggcagtctcaacagaggatgggaaatcttttgctgagaaggagtctctctattttatggagacttctgcactggaagcaaccaatgtcgagaactcattcgctgaagtccttactcaaatttatcacattgtaagcaagaaggcaatggaggctggtgatggcactgctgctgcttccgttcctccgaaaggagagaaaatcgatgtcagtaaggatgtttctgctgtaaagaaagctggctgctgttcgagttaggctttaatttgcactttttttgatgtagctgatttgatactgctgcatccttatgtgcaacatagttgagtagaaattctaaagagatgtgttcaataggatatggatattccctggattgaattttatttactttccaatatattttagtt

SEQ ID NO: 3549 - DNA, 1034 bp, Cucurbita pepo
ggacatggacgtcaattcaacaatttgtagagctcaaaataccaaagacgatttcttcataggaattccaaaatttagaaaaggaagacgcatcgtcgtccagcccagcgcagcggcaaacacagcggtctctcccatttccaacccccactgtctcgaaacaagaggaacaaagaaaagaacccccaaaaagcgaacactcgcagagatctgatccaaccaaagttcttcttcttgttcttcagaagggggactgcgatggccggctaccgagctgaagatgactatgattatctctttaaggtcgttttaattggagattctggtgtgggtaagtctaatttgctctccaggttcaccaaaaacgagtttagcctcgaatctaagtccactattggggttgagtttgctactcggagcttgaatgttgatagcaaggtcgtcaaggcccagatttgggatactgctggccaggaaaggtatcgtgcaataaccagtgcatactaccgaggcgctgtaggtgcactgctcgtctatgatgtcacacgacattccactttcgaaaacgtcgagagatggttaagagagttacgagaccatacagatcccaacatcgtcgtcatgcttgttggtaacaaatcagatcttcgacacctggtagcagtctcaacagaggatggaaaatcttttgctgagaaggagtctctgtattacatggaaacttctgcacttgaagcaaccaacgtcgagaacgcgtttgccgaagtccttactcaaatctatcacattgtaagcaagaaggccatggaggctggcgaggacgcagctgctgcttcggttccttcgaaaggagagaaaatcgacgtcggtaaggacgtttctgctgtaaagaaaggcggctgctgttcgagttaggcttttgatttgcatctttttcttatgagctccatagtttagtagaaattcttcagagatgtgttttataggatattgatattgcctggattggatttgatctactttccaatattttt

SEQ ID NO: 3550 - DNA, 1151 bp, Arabidopsis thaliana
ccagctagaaagacaccagtcttaccctaacttttttcaaagtctgtgtctttctgtagaaatctgaggaataaatatttgaatctaaagagaataaagaagaaagtaaaaaagcaaaatcgaagttttgttcaattttctgggatcatagagcaattttcgtttctttattcgttgaaagtgtgaagcttttttgattcagtgagaagtgttaatggcgggttacagagcagatgatgattacgattacctattcaaggtggttctgatcggtgattcaggtgttggaaagtccaatttgctttctcgattcaccaggaacgagtttagtctcgagtctaaatcaacgatcggggtcgagttcgcgactcgtagcttgaatgttaatgaaaaagtcatcaaagcccagatttgggacactgctggtcaagaaagataccgagcaatcactagtgcttactatcgaggagctgttggggcgcttcttgtttacgacgtaacccgacactcaacattcgaaaacgttgagagatggctaagggaactccgtgaccacactgacccaaacatagttgtgatgcttgtgggaaacaaatccgatcttcgccatcttgtagcagtccaaaccgaagatgcaaaatcttttgcagagaatgaatcactctacttcatggaaacctcagctcttgaatctaccaatgttgagaacgcgttttctgaagtactcactcagatttaccatgttgtgagcaagaaagcaatggaggctggtgaagattccggtaatgttccttcgaaaggagagaagatcgatgttgatgtttccgcagtgaagaaaactggttgctgctccaactaaatggtcttatgtcctaaagctgaaatcggtttttaaattttacattcaaattttgtttttgaagatgtttgcttttttttaggaaaacaaactatgttatgccttttgatttgcttgtttgaaaattgcttagctttggtctgattctgtaccggttaagggattttgtaatttaaccggttctggtctatggtttgtttttaattcaatccgcaaatatctctaaaccaatatttattgtgctaatccttgaacacaactaatttttgttataccaatttagaaaattttc

SEQ ID NO: 3551 - DNA, 1117 bp, Arabidopsis lyrata
agctagaaagacaccagtcttaccctaactttattcaaagtctctgtctttctgtagaaatctgggaaaataatttgaatctaaagagaaaaaagaagaaaagcaaaatcgaagtgaaggtgtgggatcaaagagcaattttcttttctttattggtagaaagtgtgaagctttttgatttagtgagaagtgttaatggcgggttacagagctgatgatgattatgattacctattcaaggtggttctgatcggtgattcaggtgttggaaagtccaatttgctttctcgattcaccaggaatgagtttagtctcgagtctaaatcaacgatcggggttgagttcgcgactcgtagcttgaatgttaatgaaaaagttatcaaagcccagatttgggatactgctggtcaagaaagataccgagcaatcactagtgcttactaccgaggagctgttggggcgcttcttgtctacgatgtaacccgacactcaacatttgaaaacgttgagagatggctaagggaactccgtgaccatactgacccaaacatagttgtgatgcttgtgggaaacaaatccgatcttcgccatcttgtggcggtccaaaccgaagatgcaaaatcttttgcagaaaatgaatcactctacttcatggaaacctcagctcttgaatctactaatgttgagaacgcgttttctgaagtactcactcagatttaccatgttgtgagcaagaaagcaatggaggctggtcaagattcgggtaatgttccttcgaaaggagaaaagatcgatgttgatgtctccgctgtgaagaaaaccggttgctgctccaactaaaagactacagattgaggaatttggtctgtgtcctcaaagctgcaatcggtttttaaattttacattcaattttttttttgaagatgtttgcctttttttttttaggaaacaatctatgttatgctttgttttgcttgcttgaaaattgcttaggtttggtctgattctgtaccggtcaagggattttgtaattcaatccgcaaatatctctaaaccaatatttattgtgctaatccttgaacacaaaaactaatttttgttataccaatttagaaaa

SEQ ID NO: 3552 - DNA, 732 bp, Brassica rapa
ctatgttggatacgtttctccgagaaaaacgctatattaacaaaagggtatcgaccaaacatgggagcatacaaatctgaggacgattatgattacctgttcaaagttgtgttaacaggagattccggtgtcggaaaatcaaatctgctctcccgattcaccaaaaacgacttcagccacgattcgcgctcgaccattggcgtcgaattcgccacacggagcattcaagtcgacgacaagattgtcaaagctcaaatatgggatactgcgggccaagaaaggtatcgagccatcacgagcgcttattaccgaggagccgttggtgcgttattggtctacgacgtaacacggcacgtgacattcgagaacgttgagagatggctaaaggagttaaggaaccacacagacgcaaacattgtgattatgctagtaggtaacaaatctgatctgcgtcaccttcgagccatcccgactgaagaagtgaaagcttttgcagagagagagaacactttcttcatggagacttcggcactcgaagcattaaacgtcgaaagcgctttcacagaggttctcactcagatttacagagtcgttagcaagaatgctcttgaaggtggagctgatccaaccactgctttgcctaaaggacaggtgattaatgttggaagcagagatgatgtttcagcggtcaagaaagcgggttgctgctcgacataatagccggcctcgaaa

SEQ ID NO: 3553 - DNA, 954 bp, Centaurea maculosa
ttatcactcacacggaatctctcctgatcttgatcttaacgcgattattcggatttttgatcatcttcttcagataaaaaaaccacaaatctataatcatagtagaacaatttcaatctcaatttcaatttcatcttcaattcttccaactagattcacaactttttgaaacctaatttcaccttttaattctatatatctataatcaatcatggcggcttacagagccgatgacgactacgattacctcttcaagttagttctgatcggcgattccggcgtcggaaaatcgaatttgctctccaggtttgctaagaacgagttcaatctcgaatcgaagtcaactatcggtgttgaattcgctactagaagtattcgtgttgatgataaaatcgttaaggctcagatttgggatactgctggccaggaaaggtaccgcgcaatcacaagtgcatactacagaggtgccgttggtgctttgctcgtctacgacacatcacgccacgtgaccttcgagaacgttgaaagatggttgaaggagcttcgagaccacaccgatgcaaacatagtaatcatgctggtgggaaacaagtcggatttgcgtcacttgcgtgcggtccccacagaggaggcaaagacgtttgccgagaaggaaaacacgtatttcatggagacatcagcactggaggctttgaacgttgaaacggccttcaccgaggtcctgacacagatataccacgtggtcagccgaaaggcactcgatgcagccaacgatgcttcggctctgcctaaagggcaaaccatcaatgtgggatccaaagatgatgttctgctgtgaagaagtgtgctgtctgctacagagatttgggacgtgtctggaatgagtgagcatgccagttcatggtagaattaaggtataagtgcagtcttgattgttgaaggcaaagaattcaa

SEQ ID NO: 3554 - DNA, 1864 bp, Pinus pinaster
gtggggccttgtaatcattcattcaccggttgccaggttgtccctgttgggttacacagccaactccagctaacgcgcagtccctgctaggtgcctaccggatactgctgactctgccgtcaattcccttttattatatactacttcattagacttcgcaagattcagccaagtggatctggctacagattttctcatctccaaggctgccagaactcaaatctgatcgcacacgactctctcctttggtcatttttgggggcttttgggtgtttattgcggacacccaatgcccaaagatctggatccaatacccatttcctagatcagcgtaaacaacgcgtcggtttaatattcagcgtgtatccgtccattcaacgggagattggatttctgcgatacattcattttgtatccatccaacagttattgggcgtctgcagtaggtcgatattcattatctatcccttgaaccagctattgggttcacgcaataagccgatattcatcgtgtatccattgaaaggctattatttttctccaatagcttgatatccattgtgtatccatccggccagatattgggtgtctattcattatctacccattgaaccggctattgggtttctgctataaggtgaaattaactgcgccgctattcattcaggttttgggttcttgagcacgcccaagagttcgtttggtgctgtgtggagatggcttacaaagtcgatgatgattatgactatttgtttaaggtggtcctgattggggattctggtgtcggtaagtccaatttgctctccagatttactagaaatgaattcagcctggagtccaaatctacaattggtgtggagtttgcaacacggagcattaatgttgatgggaaaatgatcaaggcccagatatgggacactgctggtcaggaaaggtacagagccatcacaagtgcatattatcgcggtgctgttggtgcattgttggtttacgacatcactcgacatgtcacctttgaaaatgttgagaggtggctcaaggagcttcgtgatcataccgagcacaacattgtggtgatgcttgttggtaacaagtccgacttgcgccatttgagggctgtttccacggaggatgcccagacctttgcagaaagagaagggctctatttcatagagacatctgcactagagtccaccaatgtggaaaatgctttcaagcaggtgctgactcaaatatacaggatcgttagtaagaaggctctggatgtttcggaagataatgcagcagctcccgcacaaggtcaaacaatcaacgtgaaagatgatgtcacggcaactaagaaagttggttgctgtagcacatcataagcagcaggtgaaatccctcaggattcggatttcagttcagatgcaggagtattatgttcattggaaaaactttgaccgatttctggaatcacttatagttgaattcgagcaggttctcatttggtttgattttaagaggcttcaaagttggactcacttagtaactagttttagacggagagaagagtgttgtagccaatggtgggtaatctgaattgtatatcttattcttgctgtattctctgaaacttctagtgtcccagttctgaaacttctagtgtcccagtactatctttgttctagtcagtggcttcagttttacatgccatcatttgtatccattatttcattttattctcacaatggaagacagatttttttgatcttagttaaaatattacatggaatatctttggtttgattcttttactactctgaacagtgttcattgtctgcatgtttatttgctgatgtggatgaggtaattgttgatatat

SEQ ID NO: 3555 - DNA, 1675 bp, Pinus taeda
tgcctaccggatgctgctgactctgccgtcaatttcccttttattatataccactttattgcttcgcaagattcagccaagtggatctggctacagattttctcatctccaaggctgccagaactcaaatctgatcgcacacgactctctcctttggtcatttttggggcttttgggtgtttattgcggacacccaatgcccaaagatctggatccaatacccatttcctagatcagcgtaaacaacgcgtcggtttgatattcagcgtgtatccgtccattcaacgggagattgggtttctgcgatacattcgttgtgtatccatccaacagttattgggcgtctgcagtaggtcgatattcattatctatcccttgaaccagctattgggttcccgcaataagccgatattcatcgtgtatcgattgaaaggctattatttttctgcaatagcttgatatccattgtgtattgccagatattggatgtctataataggccgatattcattatctacccattgaaccggctattgggtttctgctataaggtgaaattaactgtgcagctattcattcaggttttgggttcttgaacacacccaagagttcgtttggtgttgtgtggagatggcttacaaagtcgatgatgattatgactatttgtttaaggtggtcctgattggggattctggtgtcggtaagtccaatttgctctccagatttactagaaatgaattcagcctggagtccaaatctacaattggtgtggagtttgcaacacggagtattaatgttgatgggaaaatgatcaaggcccagatatgggacactgctggtcaggaaaggtacagagccatcacaagtgcatattatcgcggtgctgttggtgcgttgttggtttacgacatcactcgacatgtcaccttcgaaaatgttgagaggtggctcaaggagcttcgtgatcataccgagcacaacattgtggtgatgcttgttggtaacaagtccgacttgcgccatttgagggctgtttccacagaagatgcccagacctttgcagaaagagaagggctctatttcatagagacatctgcactagagtccaccaatgtggaaaatgctttcaagcaggtgctgactcaaatatacaggatcgttagtaagaaggccctggatgtttcggaagataatgcagcagctcccgcacaaggtcaaacaataaacgtgaaagatgatgtcacggcaactaagaaagttggttgctgtagcacatcataagcagcaggtgaaatccctcaggattcggatttcagttcagatgcaggactattatgttcattggaaaaactttgaccgatttctggaatcacttatagttgaattcgagcaggttctcatttggtatgattttaagaggcttcaaagttggactcacttagtaactagttttagacggagagaagagtgttgtagccaatggtgggtaatctgaattgtatatcttattcttgctgtattctctgaaacttctagtgtcccagtactatctttgttctagtcagtggcttcagttttacatgccatcatttgtatccattatttcattttattctcacagtggaacagattttttttgatcttagttaatattacatgaaaatatcctttggtt

SEQ ID NO: 3556 - DNA, 1475 bp, Pseudotsuga menziesii
ctttcacttatcaagatgctctgtactttgatttctcttttttataatataaccgcttatttttttacaagtatcagctatgtggattcggtaacagttttctcatctccgaggctcccagaactcaaatctgatcacacacaactctctctttagggtgtttgtggaggcacccaatgcccagagatctggatccaatacccatttcctagatcagtgtaaatctacgcatcagcttgatattcagtgtgtatacgtccattcaacaggctgctaagtttatgcaattacttgatattcgttgcgtctccatacggccagatattgggtgtttctaatcggctgctatccgttgaaccggctattgggtttctgcaataaggtgaaattaactgtgcagctatccattcaggtcttgggttcttgaggatacccaagagttcgtttagtgcggtgtggagatggcttacaaggtagatgatgattatgactatttgtttaaggtggttctgattggggattctggtgttggtaagtccaatctgctctccagatttactagaaatgaattcagtctagagtccaaatctaccattggtgttgagtttgcaacgaggagcattaatgttgatgggaaaatgatcaaggctcagatatgggacactgctggtcaggaaaggtacagagctatcacaagtgcatattatcgcggagctgttggtgcattgctggtctacgacatcactcgacatgtcacctttgaaaatgttgagaggtggctcaaggagcttcgtgatcataccgagcataacatcgtggtgatgcttgttggtaacaagtccgacttgcgccatttgagggctgtttccacagaagatgcccagacctttgcagaaagagaagggctttatttcatagagacatctgctctagagtctaccaatgtggaaaatgctttcaagcaggtgctgactcaaatatacaggattgttagtaagaaggccctggatgtttcggaagataatgcagcagctccctcacaaggtcaaacaatcaatgtgaaagatgatgtcacggcaactaagaaagtaggttgctgtagcacatcttaagcagcaggcgaagttactcgggattcagatttaagttcggatgcatatctcttatgttcatgagaaaacttcaaccgatttatggaatcacttatatttgaatttgagcaggttctcatttggtttgattttaagaggcttcaaagttggactcacttaataactagttttagagggagagaagtgttgtagcctgtggtgagtaatctgaattgtatatcttattcttgttgtattctctgaaacgtttagtgtcccaatgctcactttgttctagtcagtggcttcagttttacctgccatcatttgtatccattgtttcattttattctcacagtggaagacagatttttgatcttagtt

SEQ ID NO: 3557 - DNA, 1199 bp, Pteridium aquilinum
cccgttgtttgtttttggtaataagggaggagctccttcccccgccctcccccctctgtctctttctgtatatttcaaggtcgccatggcatacagatctgatgatgactacgattatctgttcaaggtggtgctgataggcgattccggcgtcggcaagtccaatctgttgtccagattcacacgcaatgagttcagcctcgagtccaagtccaccatcggtgtcgagtttgccacacgcagcatcagcgtcgatggaaagaccatcaaagcgcagatctgggatactgccggccaagaaaggtatcgggccattaccagtgcttattaccggggtgcagtgggtgcattgctggtgtatgatataaccaggcatgtaacctttgagaatgtcgaaaggtggctaaaagaactgagggatcacacggactcaaatattgtggttatgctcgtgggcaataagtccgacctacgtcatttaagagcggtatcagctgatgatagccagtcttttgcagagagagagggtctgtacttcatggaaacatctgcattggaatcaacaaatgtagagaatgcattcaagcagattttgactcagatctacagggttgtcagcaagaaggcccttgatattggggaagatcctgcagccgtgccaagccagggtcaaacgataagtgttaatagtaatgatgtgacagcaactaagaaagtcgggtgttgttcagcttagataaagttgcgactctaggcttgtgtagcaggtattaggtgtctagatgccatcattgttatttccctgtttcaaggcagggaggtctttattatgctttgtttggatttgagttgaattttggagatgagccagcagaggtgttgtagttctcagtcttcaatcgacttcacccactcttcatggtttgacctcctctgtggagctttcaacagggaagcctcgcaatttttggggtatcttggggtagccgaattcttttctgtatccacaaataattatgtggcaatcataagctgtgatctgtgtctaggtatcgaagaatggtacagtgtatgagtgttttgatgacattgggccttgagtttttggatgctgggaaagttttgttcctttcggcttcaagtagtgacatctttgctaaagtgaccattgtgattcttaatctatataattataagct

SEQ ID NO: 3558 - DNA, 1040 bp, Selaginella moellendorffii
ggcaaatgcaggggtttctagggctcttcttggcgaggcaccgcggccgtttccatttcttgtaacgggagcgcaagccttcgcttctttgagctgctgtcgggatttagggtagaacgcgagcacaaaggagggatttgtgctgccatggcgtacagatccgaggacgattacgattatctgttcaaggtagtgttgatcggggactctggtgtgggaaaatccaatcttctgtcacgattcacccggaacgagtttagcttggagtccaagtcgacgattggcgtcgagtttgcgacgcgcagcatcaatgtggatgggaagctcatcaaggcgcaaatctgggacactgcaggccaagaaaggtatcgagctatcaccagtgcttactaccgaggagctgtgggagcgttgctcgtctatgacgttacccggctggctactttcgagaacgttgagagatggctcaaggagctcaaggaccacaccgattccaacatcgtcgtcatgctcgttggcaacaagtccgatctccgccacctccgctgcgtttccaccgaagatggccaggcttactccgagaaggaaggcctgtacttcatggagacctcggcactcgagtccgtcaatgtggagaactcgttcaagcagatactcacgcagatctaccgcgtcgtgagtaagaaagctctggatgttggtgaggatccatcggctgttcccggcaagggccagacgatcaacgtgagcaaagacgacgtgactgcaaccaagaaggtcggctgctgtcctgaatgacgtcctctccagcaaaagcttgaagattatttctcttgtttgtttgtggagccgagaaaatctggaatgcagtgctgcgtgtatgtcataagattcacgacacgtggaatgccaagtcatccactggtcgcgcattgctcttttcatccctcgcgcgttggcaagggatgagagaattgtcaatgccaggcacactcaccctccaggccggccactgaatgaatgaaggatgtgtttgcgtc

SEQ ID NO: 3559 - DNA, 1450 bp, Cocos nucifera
ccggaagctgcccccatcacccgtctcgcttccacataaaaagatccggcccgagacgactaaaatctcgcctctcccctataaaaacggggaaagacggacacaaacgcaagccaccgccaccgccaccgccaccgtgcgagaccggggaggaggagaaccctatcgagtccagctctttctttccttcttgttcttgttaattaagatccaagaagaagagagaagtaagggaagaggggaaaaagaagagagggatggcggggtatagggcggaggatgactacgactatctgttcaaggtggtgctgatcggggactcgggggtggggaagtcgaatctgctgtcgaggttcaccaggaacgagttcaacctcgagtccaagtctaccatcggcgtcgagttcgccacccgcagcctcaacgtcgacggcaaggtcatcaaggcccagatttgggacaccgccggccaagaaaggtatcgtgccatcaccagtgcatactaccgaggagctgtaggtgcattgcttgtgtatgatgttactcggcatgcaacattcgagaatgctgagcgctggttgcgggagttgagagaccatacggatccaaatatagttgttatgcttgttggaaacaaatctgatcttcgtcatcttgtagctgtttcaacagaagatgggaaagcttttgcagagagggagtcactctatttcatggagacatccgcattagaagcaacaaatgtggaaaatgcctttgctgaggtcttaactcagatttatcggattgtaagcaaaaaagcagttgaggcaggtgatgattctgcttctgcagtccccagtaaaggggagaaaattaatgtgaaggatgatgtttctgctctaaagagagttggctgctgctcttcttaagttacaacgaaccttttccaaggtaagggcctgtttcagatgaattgtgtgatttggtgtaattccttttctcctctggagactggagtcaagacatggtttgtagctaaaggtttggataggttctgtttttattacttattatccaagaacgggagagcttgcttaggtttggttttactagatctgatatagccaaagttgttctttagagacatacagatttacatttccatgtttagattgtagcaattgcgcacaaattcctagcggattcaaaggttcaaattatgagcaatatatggcaacactggaatccacaggttccaagtgatggtagttcatactttgtaacctaattcagttttcaacctatcatgcaagaaaatttggaccaataatgcagctttttcctgaaatatttcttccttctctggatcaaacacaaccttgtttctggagaggtaaattgcggaataattactcccagagcagcatgattgttgtcgaatccttctgatgtttaaaacgtgaatgtg

SEQ ID NO: 3560 - DNA, 1060 bp, Cocos nucifera
gaagagagagatggccggttacagggcggaggacgactacgactatctgttcaaggtggtgctgatcggagattcgggggtggggaagtcgaatctgctgtcgaggttcaccaggaacgagttcagcctcgagtccaagtccactatcggtgtcgagttcgccactcgcagcctcaatgtcgatgccaaggtcatcaaggcccagatttgggacaccgccggccaagaaaggtatcgtgccatcaccagtgcgtactaccgaggagctgtaggtgcattgcttgtctatgatgttacccggcattcgacttttgagaatgctgagcgctggttgcgggagttgagagaccatacagatccaaacatagtcgttatgctcgttggaaataagtctgatcttcgtcatcttgtggcggtttcaactgaagatgggaaagcttttgcagagagagagtcgctctatttcatggaaacatctgcactagaagccacaaatgtggaaaatgcctttgcagaggtcttgactcagatctatcggattgtaagcagaaaggctgtggaggcagctgatgactctgcctctccagtccccagcaaaggagagaaaattaatgtcaaggatgatgtttctgcactaaagagagttggctgctgctcgtcttaagttacaacggaccttttcagaggtaaggggcctatttcagatgcttctgtgatttgctgtaatagatttctttttctatttggttgagacattgtttgtagctgaagggtttggttaggttctgtttttattacgtgtcattcaagaacatgagaccttgattaggcttggtttttactagatttgttattttgagatgatgaccaagtttattagaaagtcttttattggagacatgtagttctacatttccatgcttacattgtagcagtagcgtgcagattctaagtggattcaaagttttcaagttattggcaatacgtagcagcattgaaaaatccagagttccaagtgatggtaattcttgaaattagaacaagccaatggtgctacctt

SEQ ID NO: 3561 - DNA, 1209 bp, Gossypium raimondii
gggacatagaaaaagcatgataaacttgaaactatcccctgtttcacactctctttctcatattgttactccacacaaagcaaaagggaaagtaatatagtatcaacatcagtggttttgagaggaaaaaaggaagggtgaaatatggctggttacagagcagaggatgactatgactaccttttcaaggtagttttgatcggtgattcaggtgtggggaagtctaatttactctccaggttcaccaggaacgagttcagcctcgagtccaagtctactataggcgttgagttcgctactcgtagtttgaatgtggatggcaaggtcattaaagctcagatttgggacactgctggtcaagaaaggtaccgtgcaataacaagtgcctattaccgaggagctgtgggagcactccttgtgtacgacgttacacgccactccacattcgaaaacgtagagaggtggctaagagagttgagggatcatacagatcccaacatcgtagtcatgcttgtcggaaacaaatcagatcttcgtcacctcgtggctgtctcaaccgaggacgggaaatcctttgctgagaaagaatccctttacttcatggaaacttctgctctggaagctactaacgtggaaattgcatttgctgaagttcttacgcagatatacaacgtcgttagcaagaaagctatggagacaagcgatgatggggctgcttcagctgtgccctccaagggagagaaaatcgatgtcggtaaagatgtctcggcaatgaagaaagggggttgctgttcaagctgatatcgatctgaaagtctggggtttgttcagctgcattgatttctttgtaaaccattgtttcgtcacattttcgtaaaaagtgtgcattgtggaggcccgaacccgacttgtgaagtattgtccgcttttaacataggtccgagtttaagtctctacatataatatcgtggtagatgctttgaatttcttgatataggattggggtgttacatccataagctaaagtgctaaagtaggggattagcagataatggagattgagttacttgttggaaaatactattttctatcctcttccattttcaggcagatctaaaatgaatgaatggttttaaaggccttactttttgaggaaaaaaaacaccttaaatgaagaaaaatatttgtgtttgtagcttttctatcatc

SEQ ID NO: 3562 - DNA, 1006 bp, Phalaenopsis aphrodite
cgccgcgggaggaatccacaaaaatacttcgcttccccccgcggcgagagagggagagagagaaagagaggagcaatggcggcgtacagagcagaggacgattacgactacctgtttaaagtggtgctaatcggggactcgggagtggggaaatcgaacctcctctcgaggtttacgaggaacgagttcagtcttgagtcgaagtccaccattggggtggagttcgccaccaggagcgtcaatgtagatggcaaggtcatcaaggcgcagatttgggacaccgcaggccaggaaaggtaccgtgcgatcacgagtgcttactatcggggagccgtcggcgcattgcttgtctacgatgtcactcggcacgccacctttgagaacgcagaacgatggctacgcgaactaagggaccacaccgatccaaatatcattgtcatgcttgtcggaaacaaatccgatctacgtcatctcgtcgccgtcagcaccgaagacagcaaagcctttgcggagaaagaatccctttatttcatggagacgtcggcccttgaagccaccaacgtcgagaatgctttcgccgaggtcttaacgcagatctaccgcattgtgagcaagaagataattgattcgggtgatgatggcacgagttctgttcccggcaaaggggagaagattaatgttaaggatgatgtgtctgctctcaagaaagctggctgctgctcaagttgagcttagaaaatgttgtgggaagtaatattattatatagctttatttgtttttagtttctttgtattttcctattttggaacttttttctaatgtgtttttgaagtgttaaacatctttgatgttgatgcggctgtgtgatttaggaatgaattggtagtttcaaggaagatttgtagtgaaaatattgtagaaaaattatgatttatgtggacgccatcttgttattttgattggagctgtactttgggggaggagttttccatttgtataatattc

SEQ ID NO: 3563 - DNA, 1050 bp, Eutrema parvulum
ccagccagaaagacgcaagtcttaccctagtttttttttttcaaaagtctctgtctttctgtggaaatctggggaaatatttgaatccaaagagaaaagtgaagaaaaaaaaaggaagtgaagcttctttctgtgagcagtgttaatggcgggttacagagcagatgatgattacgactaccttttcaaggttgttctaatcggtgattcgggtgttggaaagtccaatttgctttctcgattcaccaggaacgagtttagcctcgagtctaaatccacgatcggtgtcgagttcgcgactcggagcttgaatgttaacgaaaaagtcatcaaagcccagatttgggatactgctggccaagaaaggtaccgagcaatcactagtgcatactacagaggagcagttggggcgcttcttgtctacgatgtgactcgtcactccacatttgaaaacgttgagagatggctaagggagctccgtgaccataccgacccaaacatagtcgtgatgctcgtgggaaacaaatccgatcttcgtcatcttgtggcggttcaaaccgaagatgcaaaatcttttgcggagaatgaatcgctctacttcatggaaacgtcagctcttgaatctactaatgtcgagaatgcgttttctgaagtgctcactcagatataccatgttgtgagcaagaaagcaatggaggctggtgatgatccaaactcgagtaatgttccttccaaaggagagaagatcgatattgatgtctccgctgtgaagaaaaccggttgctgctcgaactaaagactcgttagtctcgtgcagattgagggatttggtctgtatcgtcaagctaagatcggttttatcttcttcttttcttcacattcaaaattcttttgaagatgtttgcttttttttttaggatacaatctatgttatatgctttgaatttgcttgcttgaaaattgcttagctttggtcttattctgtaccggttaagggattttgtagtttaaccggtttcggtctatggtttgttcaccttttttctcttc

SEQ ID NO: 3564 - DNA, 1097 bp, Citrullus lanatus
ttctcctcatcccctttctctttggagtccagcccagcacaaacagcggtctctcccatttccaattcacaatctcgaaacaagaagatcgaaaaaacaaaccccaaaaagcgcaaatacagagatctagccattgcccatttctcttctcttactccaaccaaagttcttcttcttcttcttcttctttcagaaggaggactccgatggccggctacagagctgaagatgactatgactacctctttaaggtggttttgattggagattccggtgtgggcaagtccaatttactctccaggttcaccaaaaacgagttcagcctcgagtccaagtccaccattggggtcgagtttgctactcggagcttgaatgttgatggcaaggtcgtcaaggcccagatttgggatactgctggccaagaaaggtatcgtgcgattaccagtgcttactatcgaggcgctgtaggtgctctgcttgtatacgatgtcacacgacattccacttttgaaaatgttgagaggtggttaagggagttgcgagaccatacagatcctaacattgttgtcatgcttgttggtaacaaatcagatcttcgacacctggtggcagtctcaacagaggatgggaagtcttttgctgagaaggagtctctctattttatggaaacttctgcactagaagcaaccaatgtcgagaactcattcgccgaagtccttactcaaatctatcacattgtaagcaagaaagccatggaggctggtgaaggtgctgctgctgcctccgttccttcgaaaggagagaaaattgatgtcggaaaggatgtttccgctgtaaagaaagctggctgctgttcgagttaggcttttgatttgcattttttgatgtggctgatttgatattgctgcatctttatgtgcaccatagttgagtagaaattctgaagagatgtcttcaataggatattgatattccctggattgaattttatttactttccaatatattttggtctgaaaatttaagattgagcccagagagcttgattggtaacttggtaagaaggaatatatgcattaaatctattgatttcactt

SEQ ID NO: 3565 - DNA, 923 bp, Cucumis melo
gcgctaatactgagatctacccatttgcccatttctttctcttactccaaccaaagttcttcttcagaaggggaactccgatggctggttacagagctgaagatgactacgattacctctttaaggtggttttgattggagattccggtgtgggcaagtccaatttgctctcaaggtttaccaaaaacgagtttagtctcgagtccaagtccaccattggggttgagtttgctactcggagtttgaatgttgatcaaggttgtcaaggctcagatttgggatactgctggccaggaaaggtatcgtgcgataaccagtgcttactaccgaggtgccgttggtgcactccttgtctacgatgtcacacgacattccacttttgaaaatgtggagaggtggttaagggagttgcgagaccataccgatcctaacattgtcgtcatgcttgttggtaacaaatcagatcttcgacatctggtggcagtttcaacagaggatgggaaatcttttgctgagaaggagtctctctattttatggagacttctgcactggaagcaaccaatgttgagaactcattcgctgaagtccttactcaaatttatcacattgtaagcaagaaggcaatggaggcaggtgatggcactgctgctgcttccgttcctcctaaaggagagaaaattgatgtcagtaaggatgtttctgctgtaaagaaagctggctgctgttcgagttaggctttgatttgcattttttttttttttgatgtagctgatttgatactgctgcatccttatgtgcaacatagttgagtagaaattctaaagagatgtgttcaataggatatggatgttccctggattgaattttatttactttccaatatattttagtttgaaagtttaagtttgagcccaaaaaaaaa

SEQ ID NO: 3566 - DNA, 881 bp, Utricularia gibba
ggttggatatggcggcgggaggatatagggcggaggacgactacgattacctcttcaaacttgtgctcatcggggattccggcgtggggaagtccaacctgctgtcgaggtttactaggaacgaattcaacttggagtcaaaggcgacaataggagtggaattcgctacacggaccattcgcgttgatgagaaggtcatcaaggctcagatttgggatactgctggtcaggaaagatatcgcgcaatcacaagcgcatactatcgaggagcggttggtgcgctactggtctacgatgtcactcgccacatcaccttcgagaacgtggaaagatggctgaaggagcttcgggaccatacggatcagaacattgtgatcatgctggtaggaaacaaagcagatctacgccatctgcgtgctgtttccactgaggaaggaacagcttatgccgagaaggaaaacgtctactttatggagacttctgcactcgagtccttgaatgtggagagcgctttcactgaagttctcacccagattcatcacgtcgtcagccgcaaagcgcttgaaatcggcagcgactcttcggcattgccaacgggtcagaccatcaatgtgggatcaagggatgatgcttcaggtaccaaaagaactggctgctgctctgaatgaactactcaagattgcttcattacctgcctgcctgccctgcctatttcatttatcatccccaagcctgccgatcatcagtgctcttcttcactgtgtttttggctgatggattgcatgctttgactacagttgattacctctgagattttcacgtatggaatgacaattaatggacaggttttcagtccaacattgttacaaacattaattttt

SEQ ID NO: 3567 - DNA, 975 bp, Amorphophallus konjac
aggggggccggcaatggcgtacagggcggacgacgactacgactacctgttcaaggtcgtgctgatcggggactcgggggtggggaagtcgaacctgctgtcgcgcttcgcgaggaacgaagttcagcctggagtccaagtccaccaatcggcgtggagttcgccacccgcagcatccgaggtcgacgacaaggtcgtcaaggcccagatttgggataccgccggccaggagagataccgtgctattacaagtgcatactaccgaggagctgtaggtgcgctgcttgtgtatgatgtaacacgtcatatcacattcgaaaatgtggagagatggctgaaggagcttagggatcacacagaccaaaacattgtgatcatgcttgtaggcaacaaggcggacttgcgacatttgagggctgttcctactgcagacgcgcaggccttcgccgaaagggagagcaccttcttcatggaaacctctgctcttgaatccatgaatgtggagaacgcttttagagaagtgctcactcaggtataccatgtggttagtaggaaggctcttgacataggtgatgacccctcagcagtgccaaggggtcaaacgatcaacgtgggcacaaaggatgacgtctctgctgtgaagaaagtcggatgttgctcagttgagtgatatttctctctcgtacaccacctggtttaattgtgacgaggaatgcttacagcacaaattgaaaggagtttccacgtggacctcctggtttgactagcacagggaacatatattttgtccaggtcgccaaaaattttttgatctggactcatcctggacttctgccatctcggtgcataatgtacaagtctttgttctttttcataaacatattacaatttatttgtttgccgtaagggtttgttgcattccattatttgtcgtcgttgatttccattctgctcaccaagagatgctgaactacc

SEQ ID NO: 3568 - DNA, 1028 bp, Brassica rapa
aattcgaccagctagaaagacacaagtcttaccctagtttctttaaagtctccgtctttctgtcgaaatctgataacttttatttgaatccaaagagaaaatttcgttttttttaatatcgtgttgaatggcgggttacaaagcagatgatgattacgattacctattcaaggtggttctaatcggcgattcaggtgttggaaagtccaatctgctttctcgattcaccaggaacgagtttagcctcgagtccaagtccaccatcggggtagagttcgccactcgtagcttgactgttaacgacaaagtcatcaaagcccagatttgggacactgctggtcaagaaaggtaccgagcaatcactagcgcatactacagaggagctgttggtgctcttcttgtctacgacgtaacccgacactccacgttcgaaaacgttgagagatggcttagggagcttcgtgaccataccgacccaaacatagtcgtgatgctagtgggaaacaaatctgatcttcgtcatcttattgcggttcagaccgaagatgctaagtcttttgcggagaacgaatcactctacttcatggagacttcagctcttgagtctaccaacgttgagaacgcgttttctgaagtgctcactcagattcaccaagttgtgagcaagaaagcgatggaggctggtgatgattcgggtaatgttccttctaaaggagagaagattgatattgatgtatcggctgtgaagaaaactggttgctgctcgagctaaaagactcagtttagtctcttgcagattgttatggatttggtctgtttcctcaaagctatgatcgttcttcttttatacattcaaaattcttttgaagatgtctgcttttttattattaggaaacaatctatgttatgctttgcttgaaaactgcttagctttgctctggttttgtactgttaatcgattttgtaatttaaccggttttggtatatggtttgttcaccgttgttttctattcagtctgaaaaaaaaa

SEQ ID NO: 3569 - DNA, 902 bp, Cleome gynandra
tcggggtagaatcttgaaaaatcttaaaaggcaaatccgaagtgagagcttcgggtccgtgaactggaaacgagccataagggttcgttcctctttctctattgggtttcacggatcaaaggagaaattagggtttttaatcgacgtggatcagtcaaagtgaaggttttttttagctgcgttaatggcgggttacagagcagatgacgactacgattaccttttcaaggtggttctgattggtgattctggtgtaggaaagtctaatttactctctcggttcaccaggaacgagtttagtctcgagtccaaatccacgatcggcgttgagttcgcgactcggagcttaactgttgatgggaaagtcatcaaagcccagatttgggatactgctggtcaggaaaggtaccgtgccattacaagtgcttattaccgaggagctgtaggagcgcttcttgtctacgatgtcacacgacactcgacgtttgaaaacgtggagaggtggctgagggaacttagggaccatacggatccaaacatcgtagtaatgcttgtgggaaacaaatctgatttacgtcacctcgtggctgtccaaacagatgattcaaaatcctttgctgaaaaagaatcactttacttcatggaaacgtcggcccttgaatctacgaatgttgaaaatgcatttgcggaagtgcttacgcagatttatcatatcgtgagcaagaaggcgatggaagcgaatgacgaggcggctaatgttccttccaaaggagagaagattgatgtgagtaaagatgtttctgctgtcaagaaaggtgggtgctgttcgaattagggttcttgtttaagaggatcaaatcaaaatgtgttttttttctttactttacactacctaaaatttc

SEQ ID NO: 3570 - DNA, 851 bp, Guizotia abyssinica
ataatcaaatcaacacccaaatctctttgaaagcatctccattctccccctctactcattcataacccctgtttcatcattctttctcctcaatacccacagatctgcaaaatcctccttccaaatgggcgcctatagagcagacgacgattacgattacctcttcaaggtagttctcatcggagattcgggagtcggaaaatccaatctgctctccagattcacccgaaacgagttcagtctcgagtccaaatccaccatcggcgtcgaattcgccacccgcagcattcgtgtcgatgataaagttgttaaggctcagatttgggacaccgctggccaggaaaggtaccgtgcaatcacaagtgcatactaccgaggtgcagttggtgcattgctggtgtatgatgtcacacgccatgtcacatttgagaatgtagagagatggttaaaggagcttcgcgatcatacagattccaacatcgttatcatgcttgtcggtaataaagctgatttacgccatttacgagcggttcaatctgaagacgccacatcattcgctgaaaaagaacacacatacttcatggaaacctctgcacttgaatcattaaatgtagaaaacgcgttcactgaagttcttactcaaatttatcatattatgagcagaaaagcgctcgatggcggtgatgatcaggcggctttgccgaagggcagacgattaatgtgggtgggaaggatgacgtgtcagcagtgaagaagctggatgttgtttctctagaacgtggtttgatagtgatgaaagttgagtataatcatagtcttatattcatcaaacatttttcatgtgatgctta

SEQ ID NO: 3571 - DNA, 1002 bp, Sciadopitys verticillata
gcaacatattgatatatattcactgtctacccatccaagcaggtctgtggtttgggattcattgtgtatctatcgtttgaaccagctcttgggtcttttgcaatagcttcatatttattgtatattcatccattgaagcgggttcttgggcgtgtataaatttatttgatcagtgacattctgtgtgtatatatatccagggcttgggtcttgatacccaagatttttttctggtaggaagatggcctataaggcagatgatgactatgactatctttttaaggtggttttgattggggattctggtgtggggaagtctaatctgttgtccagatttactagaaatgaattcagtctggagtccaagtctactattggtgtggagtttgcgacgaggagcatcagtgtggatgggaagatgatcaaggcccagatatgggacactgctggccaagagaggtacagggcaattacaagtgcatattatcgtggagctgttggtgcattattggtttatgacatcactcgacatgtcacctttgaaaacgttgagaggtggctcaaagaacttcgtgatcacacggagcataatattgtggtgatgcttgtaggtaacaagtctgacttacgccatttgagggctctttcgactgaagatgcccagacatttgctgagagagaagggctctatttcatagagacatctgctctggaatctacaaatgtggaaaatgctttcaagcaggtgcttactcaaatctacagggttgtgagtaagaaggccttggatgcttcggaagatactgccactgctccaccacaaggccagtcaataaatgtcaaggatgaagtaacagctactaggaaagtcgcatgctgtggcacataagaaagttgatctccaattcagatttctgttctgttcagagcaggaaacatttcataaccattttggttggtagagaatgcctggccaatttcttgaatttcttaatttttttt

SEQ ID NO: 3572 - DNA, 1544 bp, Brassica oleracea
ctgcaatttatatttaataaattgaattggatatggattcagatattttggattagatctcagacaggggaaagagagctcgccacgtgtttgtttcgacacgcgccagcgtgtacgatgtcaatgttacattacatcgggaggcataacgaacaagacaacgacaatggcggagaagagccaaatccctgataataataacagcgccacgccttcgtcggggaagaaacctgcggcggaggtcggatccggttcgagctatccgggtcagaagatgccgtatccaaaccgacccgagtcggtgaatccggatcaggcgacgctgagggagcagtggaagttcgcaataaggcagtacagcaagtggtactcacacgcttggggcactgctattctcgccggcggcgtcttcttcggactcggttggatcatcaaaggctctaatcctcttccttcactccaatcaagttctaagcatactaaacgcgatgaagacaaatgattccgcgtctgcgtttggggaagcataagatgagagatggtgcatcaacaatgtcacatctgtatgtacatttcaaggatcatccgacgtaagaagcagagaaagagcgcacaaagcgattacggttgtagagtagaaacttttaaaaaaaaaacttgaatataaactttgtttgtatacaaatttgcaagaaattagtgaaaatgttaatgcttaataaataaaatacaaagaaagaaagagaaacgagtgtatctaagcggagcagcaaccaggttttttaacggctgagatatcatctcgacctccgacattaatcgtctgtcctttaggcaaagcagtggttggatcatctccagcttcaagagctttcttgctaaccactctgtaaatctctgtgagaacttcggtgaaagcattctcaacattcagagcttcaagtgctgatgtctccatgaagaaggtgttctctctctccgcaaaggccttcgcttcttcggtagagatagctctaaggtgacgaagatcagctttgttaccaacgagcattatcacaatgtttgcgtccgtgtggtcccttagctccttgagccatctctcaacgttctcgaatgtcacgtgacgtgttacgtcgtaaactagcaacgcaccaacggctcctcggtaatatgcgctcgtgatggctcgatttgagctttgacgatcttgtcatcgcattggatgctacgtgtggcgaattctacaccgatggttgcacgtgagtcgttgctgaagtcatttctggtgaaacgggataaaagattagattttccgacaccggagtctccggttaagaccaccttgaagaggtaatcgtaatcgtcttctgctctatatgctcccatgttatgtccaaagctaaactctttggtctttacgagtttgttcttgacacagttttattcaagaatgagaatgttatttggctgttccaagaacttgggttgacaatacttcaatcccaaatgtttttttgtttggttctaaaaataatatttttgtc

SEQ ID NO: 3573 - DNA, 844 bp, Brassica oleracea
aagacttcagattttgcttgtcatccaaagttcttggaatagccaaaaaatctatgttggatacgtttctccgagaaaaacgctatattaacaaaagggtatcgaccaaacatgggagcatacaaatctgaggacgattatgattacctgttcaaagttgtgttaacaggagattccggtgtcggaaaatcaaatctgctctcccgattcaccaaaaacgacttcagccacgattcgcgctcgaccattggcgtcgaattcgccacacggagcattcaagtcgacgacaagattgtcaaagctcaaatatgggatactgcgggccaagaaaggtatcgagccatcacgagcgcttattaccgaggagccgttggtgcgttattggtctacgacgtaacacggcacgtgacattcgagaacgttgagagatggctaaaggagttaaggaaccacacagacgcaaacattgtgattatgctcgtaggtaacaaatctgatctgcgtcaccttcgagccatcccgacagaagaagtgaaagcttttgcagagagagagaacactttcttcattgagacttcggcactcgaagcattaaacgtcgaaagcgctttcacagaggttctcactcagatttacagagtcgttagcaagaatgctcttgaaggtggagttgatccaaccactgctttgcctaaaggacaggtgattaatgttggaagcagagatgatgcttcagccgtcaagaaagcgggttgctgctcgacataatagccggcctccaaattttaaagggtcttaaacaatttagtaaaatcttttgcaaacttttttttttctaatttag

SEQ ID NO: 3574 - DNA, 1018 bp, Distylium racemosum
gatccaatacccatttggtagatcagcctattgcaacaggttgatattcattgtgtatccatcttttgaggccagtttgattgaggtttgagggttaagatccgttgtgtatctgtccaggagttggatcctttacacccaggatttttgtggggtggaaagatggcttataaggcagatgatgactatgactattgttaaggtggttctgataggggactctggtgtggggaagtccaatctgctctccagatttaccagaaatgaattcagcttggagtccaagtctaccattggtgtggagtttgcaacaaggagcatcaatgttgatgggaagatgatcaaggctcagatatgggacactgctggtcaagaaaggtacagggcaattacaagtgcatattatcgtggagcagttggtgcattattggtttatgacatcactcgtcatgtcacttttgaaaatgtggagaggtggctgaaagaactccgtgatcacacagagcataacattgtggtgatgcttgtgggtaacaaatctgacttacgccatttgaggggtctttccactgaagatgcccagacatttgctgaaaaagaagggctgtatttcatagagacatctgctttggaatctacaaatgtagaaaatgctttcaagcaggtgcttactcaaatctacagggttgtgagtaagaaggccttggatgcttcagaagatgcttcagctgttcctccacaaggccaaacgataaatgtcaaggatgatgtaacagctactaagaaagttggttgctgtagcacataaacaagctgatttcatttcagtctgtcaagagcagggccaatttctggaattatttttctataatttttagtttagagttggtaggtaaggtaagttagttccgactttaggtttaggtaagtaagtttaaagtttaaagggacggttccttaactaagtttaaacgttttaaaacctttaacgtacgactacttacgggtaaggtaggtt

SEQ ID NO: 3575 - DNA, 1527 bp, Trifolium pratense
aggcggcgtgtatcttcggcatccttttctgtaacagtcatacacgtttctctctctttcctcttcttttccaaatttccatttcaatcacaatcactttttacttccttctttcaaacaaacccttttcaatttgagatctatcttttcattttgaatcaatgggtgttactgcagatgaagaatatgattacttgttcaagttggttttgatcggtgattctggtgttggaaagtctaatcttttatctagatttactagaaatgaattcaacttggaatctaaatctactattggtgttgaatttgctacccgtagtgtcaagattcttgataagcttgttaaggctcagatttgggatactgctggtcaagaaagatatcgtgcaatcacaagtgcttactaccgtggagccgttggtgcattacttgtgtacgacacaacaaggcatgtaacatttgaaaatgtggagagatggttgaaggagcttcgagatcacacagacgcctccattgtaatcatgcttgtaggaaacaaagcagatcttcgacacttgcaagccgtgtcaacagaagaagcaaccacatttgcagagaaagaaaacatatatttcatggaaacttctgcactcgagtcactgaatgtggatagtgctttcgtggaagtgctgactcagatatacaatgttgtgagcaagaaggctctcgagaaagagaacggttctgcatcattgcctaagggagagactatcaatattggtaaagatgatgtgtcagaggttaagaagagtggatgctgcagtacagcatagtgtttgaattgaaagatgtatacagtagaagaggaagatcttagttacatagtaaattttcatcattttgggattcatatgaaatgttttgatatttgattgatacctttatttaccattgaacattttcctatttgttgtggcaaagtcattattttgagatgtttttgttttgctctgcctcaagagctcattattgttattataattttgaggtgtagttattattatcttcaaatctttaccttcatggcttcatctgtcttttacaatggtcttattaatttttctattttcaatatttagatatgattaatgacaaaatgttagccttgtaatgagtatgactaaattaaacagagtgactccactagtcaatggaccatatcatagtatacaattcagaccaagtctatgaggatttagacattaaagttaatggaaaattctgttggtgaacttactgaggacttaaaatattgttttaagagacctccaaagtgattattttctcttgacaattatttcattatcgattgccaataagtaagaatttatcccgtaggaaagtgttcggtatgggagtggaaccaccgtgttcgttttggatcctctaaattgtattcttgagtgattgtatttaccattgggtggagtactgcttgtacttccaccattgcttataggttagtacctacatgtactcgaggttccg

SEQ ID NO: 3576 - DNA, 804 bp, Brassica napus
tgagtagcatcatcccatgttcttggaacagccaaataacatttttattcttgaatataactcgtctcccgacaacaaactcataaaaacaaaagaggtttaagtaggtggacaaaagaagatgggagcatatagagcagaagacgattacgactacctcttcaagggggtcttaaccggagactccggggtcggaaaatcaaacctgttatctcgtttcaccagaaatgacttcagccacgactcacgtgcaaccatcggggtggagttcgccacacgtagcataaaatgcgatgacaagatcgtcaaagctcaaatctgggacacagccggccaagaaaggtaccgagccatcacgagcgcttactaccgaggagccgtcggtgcgttactagtttacgacgtgacgcgtcacgtaacgttcgagaacgttgagaggtggctaaaggagctaagggaccacacagacgcaaacattgtgataatgctcgttggcaacaaagctgatcttcgtcatcttagagctatctcaacggaagacgcaaaggcctttgcggagagggagaacacttttttcatggagacgtctgcacttgaagctctgaacgttgagaatgctttcaccgaagttttgactcagatttacagagttgttagcaagaaggctcttgaagctggagatgatccaaccacggctttgcctaaaggacagacgattaatgtcggaggcagagatgatatctcagctgttaaaaacctggttgctgctctgcttagacacacacacttgtctctctctctgtc

SEQ ID NO: 3577 - DNA, 1045 bp, Eutrema halophilum
caacatctctctgagatagattttattacacccatcaaagatttcaactttcttctttatttcttatttgggttttagacaaaaaaaaaaaaatcaataatgggagcgtatagagccgacgacgactacgattatctcttcaaactagtcttgatcggagattccggcgtcggaaaatccaaccttttgtctcgattcaccagaaatgaatttagtattgagtcaaagtcaaccatcggtgtcgaatttgctacaagaagcgttcatgtcgacgagaaaatcattaaagctcagctttgggacaccgccggtcaagaaagatacagagcaatcacgagtgcatactacagaggagcagtaggggcacttctagtatacgacataactcgacacgtaacgttcgaaaacgttgaacgatggctcaaggagcttcgtgaccataccgatgccaacgtcgtgatcatgcttgtcggaaacaaagccgatcttcgtcatcttcgtgccgtcccaacagaagaagctagatctttctcagagcgagagaacatgttcttcatggagacttctgctctcgatgctacaaacgtcgagcaagctttcactcatgtcttgactcagatatatcgtgtaatgagccgtaaagctcttgatggcactggagacccaacgtctttgcctaaaggacagaccatcgatatcggaagcaaggatgatgttactgctgttaaatcctctggttgttgctcaggttgagatctattgttctgtttttttttttgtaaactgttttattggaaggaggtttctgtttttggattggttgtatctgaattttgtgattttttggagggaggatatgttttaagggtcacgagaccggtttggttttacaacacaaaccgaattttaacgtattattattgaacaattaagacatggtccggtttattaggtcgttataccttttcaagaaccgaaccaaaccgaaaccggaaaaggacatctcttgggggttcaaagtagtttagtcaagttgatagaaacc

SEQ ID NO: 3578 - DNA, 1204 bp, Gossypium hirsutum
tgataaacttgaaactctcccctgtttcacactctctttctcatatttttactccacacaaagcaaaagggaaagtaatatagtatcaacatcattggttttgagaggaaaaaaggaagggtgaaatatggctggttacagagcagaggatgactatgactaccttttcaaggtagttttgatcggtgattcaggtgtggggaagtctaatttactctccaggttcaccaggaacgagttcagcctcgagtccaagtctactatcggcgttgagttcgctactcgtagtttgaatgtggatggcaaggtcattaaagctcagatttgggacactgctggtcaagaaaggtaccgtgcaataacaagtgcctattaccgaggagctgtgggagcactccttgtgtacgacgttacacgccactccacattcgaaaacgtagagaggtggctaagagagttgagggatcacacagatcccaacatcgtagtcatgcttgtcggaaacaaatcagatcttcgtcacctcgtggctgtctcaaccgaggatgggaaatcctttgctgagaaagaatccctttacttcatggaaacttctgctctggaagctactaacgtggaaattgcatttgctgaagttcttactcagatatacaacatcgttagcaagaaagctatggagacaagcgatgatggggccgcttcagccgtgccctccaagggagagaaaattgatgtcggtaaagatgtctcggcaatgaagaaagggggttgctgttcaagctgatatggatctgaaagtctggggtttgttcagctgcattgatttctttgtaaaccattgtttcgtcacatatacgcaaaaagtgtgcattgtggaggcccgaacttggcttgtgaggtattgtccgcttttaacataggtccgagtttaagtctccacatataatatcatggtagatgcttaaaatttcttgatataggattggggtgttacatccataagctaaagtgctaaagtaggggattagcagataatggagattgagttacttgttggaaaatactattttctatcctttttccattttcaggcagatctaaaatgagtgaatggttttaaaggtattactttttaaggaaaaaaacaccttaaatgaagaaaaatatttgttttgtagctttccttcatcttttggtcaattgt

SEQ ID NO: 3579 - DNA, 2449 bp, Aristolochia fimbriata
ctgaaaaaggccgcctctttaccttcgccgatggaatccagccaagccaagccgacagaaatctcaaaatttcggctacaaaaaggaaagcagagggaagcgcagggcgaggttcgaaaaaacaaacggaaaactgcggaaagctcttttcgcttcttataggaaaggataacgagggaggcgtttgattcttcttggaatttttgcttctgttcttctcttcttgctgttgtctaggggaggaagtaaatggcttcttatagagctgaggacgactacgactacctcttcaaggtggttttgatcggcgattccggcgtcgggaagtctaatttgctctctaggttcaccaggaacgagttcagtctcgagtccaagtctacgatcggagtcgagttcgctaccaggagcttgaacgtggatgggaaggttatcaaagctcagatttgggacacggcgggccaagagagataccgtgccataacaagtgcttactatcggggagctgttggtgccttactggtctatgatgttacccgccacgctacttttgagaatgttgaaaggtggttgaaggagctgagggatcatactgaccctaacattgttgttatgctaattggaaacaagtctgatttacgccatcttgttgctgtctctactgaagatggaaaagcttttgcagagaaggaatctctctacttcatggaaacatctgctttggaagctacaaatgtggataatgcttttgctgaggtcctaacccaaatttatcggattgtgagcaaaaaagcagttgaaactggggatgagggagcagcagctgcagttcccagcaaaggggagaggataaatgtgaaggacgatgtgtctgccttgaaaaaggtgggttgctgctcgacttgaggattctgacattgatctgctggcaactcatttcatataagcggtagtttccttttgaagggtttttactttgtttgttgttgagcatagagaggagagcggggggaagctattcagactttctattttgttgaacagcagaggatctttgagtaggaacaaggttgttacagttgttggtttagttagttgaaatgaaatgatggctccaaatcccggaagagtagctgtattttacccgcggaagtggactttgcaaggtgaaatcggtgtggaggctttgtcaagtagatgatgatgtcccacgcaatgggcagttatatacgtaacccaatattttttacctggttgttttcaaagacatgtttcttgattacatttaccctgtgtaaaccgtttccatctattgttggttgtttctagctccaatttctaacatttcttttaaaaaatgtttccatagttctttcctgtattgggtaaaacctttttgacacactagatcttactgtttactagtaaaaccttcgtttattatgtcgttgttgccctgaggcctctggatgagaagataaaaaaagaagaattagataaatgaccgagagggttggatgactgcaaatatttaattgtaaatgattacaagagttcctgcccgctgttattatttgcaggtccagagtcgttgtaaggagaaaacacgtgggtcatggactcttcaaattggtggaaaactaaccggccatcgtacatgatgaagtgaccttaggaagtaaagaattacaacggaggagaaccaacggtccatgctttctgacacctcgaatcctacaagcctcatcgatcgccaccggcgattatataagacaatttagcccatttgaacccccatcaacgtacatcaaaatgcttctagactgtcaccttgtccagtgtcgggactggtggttctccagtcacgtgctacggcagttgtccgtgctttacggttttcacttaaatcttcttttcatatctaaataccgggaagccaatccgagattccgaatgcgttagttcaaagctgagaagttttatgccattttggcaagagctagtagtgcacaaataaagggttttcctcagctttgatgaaatcgtcccgtgaacaatcgaataagcgcatatatcattccagattacacaaaattgtaagacttagagataactgcattcattatccctctctcttcctgtcatttgctctgtctctttttctctctcctcctctctcccctctctgttgtcgacaaatggagcggtcactgcgtgagttgttgtgggtatcgatcgagtagacagagcccgatttttttaatgacgataacggaatgaacgtaattaacagcgaaaatgtcaaaacccatcatacagcaatcactgtttccttttgaacaacgcaccgagacggctcccaggttcccagtaccgcacgttactgatctcgagtctcaatacccaaatgcaaataaaactgagacataatcttcccacactagttaat

SEQ ID NO: 3580 - DNA, 1161 bp, Theobroma cacao
tagagggagagatcttaggcaaggcttaataaccttgaaacaacccgtatttcactctctctttctcatatttccttgaagtaaagcaaaggcgaagtaaaaaagagtgcaacaacggtggttttgagaagagtgaaaagatggctggttacagagcagaggatgactatgactaccttttcaaggtggtgttgatcggtgattcaggagtgggaaagtccaatctgctctcgaggttcaccaggaacgagtttagcctcgagtctaagtccaccattggcgtcgagttcgctactcgtagcttgaatgttgatggcaaggtcatcaaggcccagatttgggacaccgctggtcaagaaaggtatcgtgccataacaagtgcctactaccgaggagctgttggtgcacttcttgtgtacgatgttacgcggcactccacatttgaaaatgttgagaggtggttaagagagttgagagatcacacggatcccaacattgtagtcatgctcattggtaacaaatcagatcttcgtcaccttgtggctgtctcaaccgaagatgggaaatcctttgctgagaaagagtctctctacttcatggaaacttcagctctggaagctactaacgtggaaaacgcatttgctgaagttcttactcagatctaccatattgtgagcaagaaggctatggagacaggcgacgaaggggctgcttcagctgttccttccaagggcgagaaaattgatgtcagtaaagacgtctctgcaatgaagaaaggggggtgctgctcaagctaggatgttaacctgaagtcgattgtcttaaggatgtggctgggggtttgtttctgccgcatggatttctttgtaaaccttggttttgtaaaatttttctcaaaaaggtacctacagtaggggagatcggccgagattgatttaatttacattcaaaatttttccgggtggctgttataacttatttttagtagacaagaggcgaatgaggaacaaggtattacactattgcatttaaataggtgcttaggaaaatctgttggctgagaacagttgttcccggcacttatattgaaattaccatatctagtctttcccttcccaggcagacccaaaatgaatgaatgatggtacttatccttctctc

SEQ ID NO: 3581 - DNA, 1052 bp, Helianthus annuus
cggggatcacctttttgtcctctattttcatttgcatctttcttctaatataccctaacacaaccgttataactgccgttcaatttctgaaatcctgaaataaaaaaaatcatcatcgtcatccaaattttgatctctttctttccattcatcctcatgtccctttaaaatcacaatagtcgtcgatagggatatggcgcatttttgtagagacgatgactatgattacttgtttaaggttgttttgatcggggattcaggtgtcggtaaaaccaatcttttgtcacgattctccaaaaacgaattcaacatggagtgtaaatccaccattggggttgaattcgccacccgtagcatcgaagtcgatgacaagatcatcaaagcccagatttgggataccgcgggtcaagaaaggtaccgcgctataacaagtgcatactatagaggtgcggtaggtgcattgatcgtatatgatatcacacgacacgtaacatttgaaaacgttgaaagatggctaaaagagcttcgagatcacacggatcaaaatatcgtgatcatgcttgtagggaacaaagctgatcttcgacacctacgagccattcaaatggatgacgcaaagttatttgccgagagagagaacaactttttcatggaaacatcggctctcgaatcattaaacgtcgagaatgctttcaccgaactattgactcagatttatcacgtcgtcagcaaacgggcacttgaagtgggtagtgatcccatggttccaagcagaggacaaacaattaatgttggaggtaaagatgattctcctgctgctgttaagaagaacgaagggtgttgtagttgaaaaagatatgtttacacatttataaaactaggatgcagcggaaaacacatacactgcaagggtatgcattgttcggtttgttttggtattatcttcaacccgaaatgaagtcatcggctagtctatgttattaaccaattagtttgtcatcggcttgatttgttcattagattgacggttttttgtttattcgtttgattca

SEQ ID NO: 3582 - DNA, 4661 bp, Ananas comosus
agatagaggggccaaggtgtgagccagtgtaacggagagatctcgctgtggttgtcgatcccaatctccctctttgggcgacccctctcttctatgccggagatctctccccgtccaccaatcgacggctgagatccgttgccctcttctctttacaaattcgagatctaagatccgaggtgagcactctttcccctcatttcccctcctacctcccagatccgagctcctacacgggccctaaccctaaccctaaacctaatgccgccgattcctccaccatcggtttcgatctcgtgagcttcttctcgtcgctagggttttgaaggtatacggtggatcgagagtgacgaatcgaggaggaagaaacagagatgctgaccaaattcgagacgaagagcaatcgggtgaagggcctcagcttccacagcaaacgcccatggatccttacgagtctccacagtggcgtgatccagctatgggactatcggatgggcacactcatcgatcgcttcgacgagcacgatggtcccgttcgtggcgtccactttcacaagtcgcagcccctcttcgtctccggaggagatgattacaagattaaggtttggaattataagacacaccggtgcctatttacccttcttgggcacctcgattatatccgtaccgttcaattccatgacgaatacccatggatcgttagtgccagtgatgatcagactatcaggatctggaactggcaatcacgtacctgtatctcagtgctgactgggcacaaccactatgtcatgtgtgcctctttccatccaaaggaggatttagttgtatcagcgtctcttgatcagacggtccgtgtctgggatattggagcactaagaaagaagactgtgtccccggccgatgacatgttgcgactgagccagatgaacacagatctgtttgggggagtcgatgccgttgtcaagtacgttctagagggccatgatcgtggagtcaactgggcatcgtttcatcctagcttgccgcttattgtttccggggcagacgatcgccaagtgaagatatggcggatgaatgatacgaaggcttgggaagtggataccttgagggggcacatgaataatgtatcttgtgtaatgttccatgcaaagcaagatattatcgtttccaactctgaggataaaagcattcgcatatgggatgctacaaagcgcacgggaatccagacttttcggcgggagcatgatcgcttctggatccttgccgcccacccagagatgaaccttctagcagctggccatgatagtggcatgatcgtcttcaagttggaaagagaacgcccttctttttctgtaagtggggatacgatgtactatgtgaaagaccggttcttgcggttctatgagttctcatcccaaaaggataaccaggtggtttcgatacgaaggccggggtctatgagcttaaatcaaggacccaggacactgtcctatagccctacggagaatgctgtgttgatctgctctgatgttgatggtggatcatatgaactttatatcattcctaaagagtctgtaggaaggagtgattatatgcaggatgcaaagaagggagctgggggttcagctgttttcgtagcccgcaataggtttgcagtccttgataagagcagcaatcaagctctagtgaagaaccttaagaatgagattgtgaagaaaggtactcttcctgttgctactgatgcaatattttatgctgggacagggaacttgttgtgcaaagctgaggatagggtggttatatttgatcttcagcagcgaattgttcttggtgaacttcaaacaccttctgttaagtatatagtttggtctagtgacatggaatctgttgctcttctaagcaaacatgctatagttattgctaataagaaacttgtccatcgttgcacgctgcacgagactatccgtgtgaaaagtggtgcttgggatgagaatggcgtcttcatttatacgaccttgaaccatatcaagtactgccttcctaatggggacagtgggattataaaaactcttgatgttcctgtttacataaccaaggtttctgggagcaatatctattgcttggatcgggaagggaagaacagggtcatatcaattgatgcttctgagtacattttcaagcttgcacttttccggaaaagatatgatcacgtaatgagtatgatcaagaactcacagttatgcggacaggctgtaatatcttatctgcaacagaaaggatttcccgaagttgctctccatttcgtgaaagatgaacggacccgatttaatctggctttagaaagtggtaatatacagattgctgttgcttctgcaaaggagatagatgagaaagaccactggtataggttgggcatcgaggcccttcgtcaggggaacaccagcatcgtggaatatgcataccagaggacgaagaactttgaaaggctgtcttttctctatcttgtgacaggaaacatagaaaagctgtccaaaatgctaaggatagctgagattaagaacgacataatgggccaattccataatgccatgtatctaggtgacattagggaacgtgtcaagatcttggagaatgctggccacttgcctcttgcatatgtcacggctgccactcatggactgacggaaatcagtgagaggcttgcggctgaattgggagataaagtcccctctcttcctgaagggaaagcccgttctcttctgatgccccctgcgcctttgacaagcagtggggattggccattattaagggtgatgcggggcgtttttgaaggcggacttgatgttatagggagagcagaggaagaggaggaagaagaaggtgctggtgctgactggggtgaggaggaactggatattgtcgatgtcgaacgtgtgattcagaatggtgacataacagcagaagatgacgaggctgagcaaaatgaagagaatgaggaggaaggagggtgggacctcgaagatctggagttaccacctgaaatagacacgccgaaggcttcaagtaatgttcgttctttatttgttgctccttcgccgggcatgccagtgagccaaatctggatcaataaatcctcccttgctggggagcatgctgcatctggcaactttgacacagctatgcgcctactcaaccggcagttgggcatcaaaaactttgccccgttgaagcccttgtttatggatctccacatgggcagtcacacgtatctgcgagcttttgcaatggcttcagttatatccatcgcagtagagaagggatggagcgagtccgctagccctaacgtgagaaacccgccagcgctggtcttcaagttctcgcagatggacgagaagctgaaggcagcttaccgggccacgactgaggggaagttcccagaggctttacggctgtttcttaacatattgcatattgttccactcattgtggtggattccagaagggaagttgatgaagtgaaggagctaatcgagatagcaagagagtacgtgcttggcttgaaaatggaagtgaaaaggaaggagcttaaagatgatctagttcggcagcaagagttggcagcttattttgctaacagtaagcttcagaagatccacatgagactagtgctcacaagtgccatgaccatctgcttcaagggaggaaactatgccactgcggctcattttgccaggatgcttctggaaggtagcccaaatgaggcccaagcgaagaaggctagacaggtgcttcaggcttgcggtgataggaaggatgctaatcagttgaattatgattataggaatccgtttgttgtttgtggggctacctttgttcctatataccgtggccagaaggatgtttcctgcccttactgtgcttctcggtttgtgccatccattgcagggcagctttgtagtgtatgtgagcttgcagtggtgggggcagatgcatcaggtcttctttgttttgctgcacagacaagataagtggcgaaaggtaactatctcatcatatgtcatatttctttagcgtctttagcttaagactatcatcctatattttgtctgggaccttgctgattgtgtgaaaggtgaaacaataagaatactgctcttttgtagtcggccttatgggcaattatcaaacatagatttcgattagctcatgcagatcctgttaagagagacattgtaagtccatcttcttcacagttgctggtgaggcttttattttaatcctgtatttgttaaaagttgtgtagaattctttttgggaacgtctattgtttacataagcttgtcatttatattcagcatgtctgtaattttttttttttttacgagccatctttctgtgtggatcgactttttccttctaactgtattcattccgtttaagtatacagtgccttgtattttgtacttgtttaactatatagttctcttattcggtaagcttctatttggcagcttgtgtgacattttgcgctgatcatatgagtttgtgacttctgaaacagaaggagaaaaataccaacagtttagttgacttgataatactgccctagctttttaaagctaattatgttagtttaataagacgcttttgttataatctgt

SEQ ID NO: 3583 - DNA, 4177 bp, Phalaenopsis aphrodite
gaaccggagacaacatgaaagccagcggagatcgacacaccgagctgttgcactgtaatcagatctcagcccagcgcggttgcaattctctaccggaggtcgggatctcgtcgacgatctgagatacctaggccctgagttgttctcttcttcgcattccatcgtttttagatctggatagcgtcggatctcacctgtccggcgttttatttcaactttcgattttggatttcgtatgcaaccgacgggtagggtttttggagatccatactcgtattagggacggagcaaggcaaagatgctgactaagttcgagaccaagagtaatcgggtgaaggggcttagctttcatagcaagaggccgtggatccttgctagtcttcacagcggtgtgatccagctatgggattatcgcatgggaaccctgatcgaccgcttcgacgagcacgatggacctgttcgtggcgtccactttcataaatcgcagcccctttttgtctctggcggtgatgattacaagatcaaggtttggaattacaaaactcaccgttgcttgttcactctgcttgggcaccttgactatattcgtactgtacaattccatgatgagtatccttggattgttagtgcaagtgatgatcaaactattaggatttggaattggcagtctcgtacctgcatttcagttttgactggccacaaccactatgtgatgtgcgcatcatttcatccaaaggaggatctcattgtgtccgcttctcttgatcagactgttcgtgtttgggatattggtgccttgagaaagaaaacagtgtctcctgctgatgatattttgcgtctaagccagatgaatactgatttgtttggtggcgttgatgcagttgtcaaatatgttttggaaggtcatgatcggggagtcaattgggcatcttttcatcctaacctgcctctcattgtttctggagccgatgaccggcaagtgaaactatggagaatgaatgattcaaaggcatgggaagtcgacacattgagagggcatatgaacaatgtttcttgtgtgatgtttcatgcaaagcaagatatcattgtgtccaactctgaggacaagagtattcgcatctgggatgctaccaagcgcactgccattcagacatttcgccgtgagcatgatcgtttttggattttgtctgcacattcagaaatgaatctacttgcagcgggccatgacagtggaatgatcgtattcaaactagagagagagcgtcctgctttctctgtagttggggattgcttatattatgtgaaagaccgttttctgaggttttatgaattttcaagtcagaaagataatcaggtggttccaataaggagacctggatctgtgagtttgaaccagggaccaagaacactctctttcagtcccaccgagaatgctgtcataatctgttcagatgcagatgggggcacttatgaactctatattgttcccaaagacaattctggaaggacagatgttgttcaggatgcaaagaaagggggaggagggtcagctgtttttgtggcccgcaataggtttgtagtgctagacaagagcactaatctagcagtagtcaagaatctcaataatgaaattgtaaaaaagagtcctcttcctattgttacagatgcaatcttttatgctggaacaggaaatctgctgtgtagggctgaagataaagtcgttatatttgaacttcaacagcgtcttattctgggagaacttcaggtccctgctgtcaagtatattgtttggtcaagcgacatggaaactgttgcattactcagcaagcatgttatagttattgccagcaagaaacttgttcaccgctgtacattgcatgagacaattcgtgtgaaaagtggtgcgtgggatgagaatggtgtcttcatttacacaaccctgaaccacattaagtattgccttcctaatggggataatggtattataaggactcttgatgttcctatatacttgaccaaggtttctggcaacagtgttttttgtttggatcgtgatgggaagaaccggatcataacaattgatgctacagagtatatcttcaagcttgctcttctgaggaaaaaatttgaccatgttatgagtatgatcaagaattctcagttgtgcgggcaggctgtgattgcatacttacagcaaaaaggttttcctgaagtagctcttcactttgttaaagatgagagaaccagattcaacttggctcttgagagtggtaacatccaaattgctgttgcgtctgcaaaagagatagatgagaaagaccattggtataggttgggcattgaggccctacgacaggggaacaccggtattgtagaatatgcttatcagaggacaaagaactttgaaaggctgtcatttctgtatcttgtcacaggaaataaggaaaagctgtcaaaaatgctgagaatagctgagatgaagaacgatgtgatgggtcagttccataatgctatgtatcttggtgatatccaggagcgtgtgaagatcttggagaagactggtcacttgcatcttgcatttatcacagcttcaactcatggcctcattgaaactgctgaaaggcttgcggctgaattgggggatgatattcctgctatccccaaagagaaaacccgctctcttcttttgccacctgttcctcttttgaatggtggtgactggccattgttgagggttatgagaggcatttttgagggtggattggatattgctaacaagtcaggatatgatgatgtcgaagaagaagtttctggtgctgactggggtgatgaagacttggacattgttgatgttgagcgagtgatccagaatggggatggcgatgcagaagttgataatgttgaagcaactgaagaaaatggaggctgggaccttgaagatctggagttgcctgcagaagttgcaagtccggtggctacaagtaatagtcgtgcatcggtgtttgttgcccctacgcaaggtatgtctgtgagccaaatctggacacagaagtcatctcttgctggggagcatgctgcagctggaaactttgacacagctctgcgccttcttaatcggcagttaggaataaataattttactccattgaagccaatatttttggaattatacacaggcagtcatacatatcttcctgcttttactgcggctccagtaatttcagttgctgttgagaaggggtggaccgagtccaccagtcctaatgttagaagtccaccatctctagtattcaagttttcacaactggatgaaaaactcaaggctgcataccgtgcaacaacagaggggaagttccctgaggccttgaggctatttctcaatatattacacattattcctattattgttgtcgattctaggagggaggttgatgaagtcaaggagttgattgagattgctaaagaatatgttttgggcctgaagattgaggtcaagaggaaggaaattaaggatgatgtgattcgacaacaggagcttgctgcttacttcacaaactgcaagctccaaaaggttcacaccagattggtgcttactagtgccatgactatttgtttcaagggaggaaactatgctacggcaacccattttgctaggatgcttttggagagtagcccaactgatgcacaagcaaagaaggcaaggcaggttctacaggcttgtggtgaccgaaaagatgcgcaccagctgaattatgattacaggaatccttttgtggtctgtggagctacctttgttccaatctaccgcggacagaaggatgtctcttgtccttattgtggagctaggtttatcccaaccattcaaggtaagctttgcactgtttgtgagattgcagttgtgggtgcagatgcatcagggcttctctgctcttcgacgcaattgcggtaaatgaaggtatttaccaagcactcattatatgtgtttcctatcaagcttgtcacgccatatctttttcagaaccaaatatatttcacgcaaaagaataaaaacaggtaatctggttttagcagtttgttcagttttttaaatttgtgctcccccttcctttgagctgtaggaattttgtaagacatgcagttattatttgaaagctgacgttatgagttcaatttgctt

SEQ ID NO: 3584 - DNA, 4031 bp, Allium cepa
agaaatttgaagagaaagacaaacctagctctccatagatcagccggacctagtacgatcacagatctattctagaatccaaagcctaattccattcgatacttttattctgttcaattatcttcgcgtgtatcgataaagatgctgacaaaattcgagacgaagagcaatagagtgaaaggattaagtttccacccaaaaaggccctggattctagcgagtttgcatagtggagtgattcagttatgggattaccgaatgggaactctcattgatcgatttgatgagcatgatgggcctgttcgtggtgtacattttcataaatctcagcctctttttgtttctggaggtgatgactacaagataaaagtttggaactacaaaacacataggtgcctatttactctgctgggtcaccttgattacatccgtactgtccaattccatgatgaatatccttggattgttagtgcaagtgatgatcaaactattagaatttggaattggcagtccaggacatgtatttcagtattgactggtcataaccactatgtcatgtgtgcttctttccatccaaaggaggatcttctagtttctgcttcacttgatcaaactatccgtgtctgggatactagtgcattgaggaagaagagtgtgtctcctgctgatgatgtaatgcgtctgagtcagatgaattcggatttatttggtggggttgacgctgttgtgaagtatgttttagaaggtcatgaccgaggtgtcaattgggcttcattccaccctaaccttccactcattgtgtctggtgcagatgatcgccaagtcaaactatggcgaatgaatgatacaaaggcttgggaagtggatacgctgagagggcacatgaataatgtgtcctgtgtcatgtttcatgcaaagcaagatgtcatagtttccaattctgaagacaaaagtattcgtatttgggatgctactaaacgcacaggcattcaaacgttccgacgtgaacatgaccgattctggatcatggctgcccacccagaaatgaatttattagctgcaggtcatgactctggtatgattgttttcaaattagaaagagaaaggcccgctttctctgttagtggcgatgttttgtactatgtgaaagaccgatttttgcgcttctatgaattctcatctcaaagagacaatcaagttgttccgataaggcgccctggttctgtcagcttgaatcaatcccctagaacactatcttatagccccacagagaatgctgtgttaatttgttcagacatagatggtggatcatatgaactccatattgttcccaaggataccagtggaagaggtggagatttcatgcaagatgcaaagaaaggagcaggagcttccgctatttttgtggcacgtaatagatttgcagtactcgatagaagcactaatcaagttcttgtgaaaaatttgaagaacgaagtcgtgaaaaggagcgctttacctattgctactgacgctattttctatgccgggacaggaagtttgctatgccgtgctgaggacagagtggtgatatttgatcttcagcagaggattgttcttggtgaactacaaacgccttctgttaaatacatagtctggtctactgacatggagagtgttgctctgttaagcaagcatgctatagtcattgctaataagaaactctcacacagatgcacgcttcatgagacaattcgtgtgaaaagtggcgcatgggatgaaaatggcgtatttatctatacaaccctaaaccacatcaagtattgccttcccaatggcgataatggaattattaaaactttagatgttcctatatatctcacaaaagtcataggtaacactctcttttgcttggaccgagatggaaagaatagagccataacaattgatgctactgagtatatcttcaagcttgcacttttaaagaagcgatatgatcatgtgatgagtatgataagaaattcacaactatgtgggcaggctgtgattgcttatctacaacaaaaagggttccctgaagttgctcttcatttcgcaaaagatgagcgaactcgattcaatctagccctagaaagcggcaacatccaaattgcagtcgcatctgccaaagaaatcgacgaaaaagaccactggtatcgtctaggcattgaagctttaagacaaggaaatactagcatagtggagtatgcatatcaaagaacgaagaatttcgagagactatcattcttatatctcataaccggcaacagggaaaagctttccaaaatgctaaagatagccgaaatgaaaaacgacgtgatgggtcagtttcataatgccatgtatctaggagatgttgaagaaagggtcaaaatcctagaaaatgcaggtcatttgcctcttgcatatgtcacagctaaaactcatggtctgtctgaaattgccgataagcttggtgctgagctggaaagtaaaggtatagttccgactataccagaaggaaaaacaagttctctactcatgccgcctgctcctctgttatgcagtggagattggccattgttaagagttatgagaggtattttcgaaggggggttagattctaatgtaggaagaggtggagatgaagatgaatacgaaggtgctaatgctgattggggtgaagaagacttggatatagtagatgtagcagatgctgtacaagatggtgatgtaaacgctgaagtggatgacattgaaggacatggagaagaagatgatgtggaaggaggatgggatctagaagatttagagcttcctgctgatgtggacgcatcacgtgccagcaatgcacgtgcttcttctgtatttgttgctcctactgcaggaatgcctgtaagccaaatctggattcagaagtcatcgtttgctggagagcatgctgcagcaggtaacttcgacactgctatgcgattgcttagcagacagttaggaatcaggaactttgccccattgaaaccgttgttcaaagaaatgcatcttggtagtcacacttatcttgatgctttcgcttccgctcctcaattttctactgcccttgaaagagggtggagtgagtctgctagccctaatgtaagaggcccgcctgccttggtttttaaattttctcagatggatgaaaaacttaaagcggcttatcgtgccacgacagaagggaagtttccagaggctttacgccttttcttgagcattttgcacaccatccctcttatcgttgtcgattctaggagagaggtagatgaaattaaagaacttatagacatagcaaaggagtacgtattggggttgaaaattgaggttaataggaaggagctgcctagagaagatgtggttaggcagcaagaactagctgcatacttcacgaattgcaagcttcaaaaaggtcatgctaggcttgtgctcactagtgctatgaacatatgttacaaaggagggagctactccaatgctgctaattttgctaggatgctactggaaaataacccacctggaaatcaagctgagagaatcagaagagttttagctgcatgcagtgataaggtcgatactgttcagttgaattacgacttcagaaacccctttgtcgtttgtggagccacttttgttcctatctatcgtggccagaaggacgtctcgtgcccttattgtggagcgcacttcgtaccagcttatgagggccagatatgtgctatttgtgagctggcggtggttggagctgatgcttctggattgctatgctcgcctactcagaggagataagttgaagtttctttctttttcgtgtttttattggggttaagactttgagaatattcaagctatatatgttttgacgctgaacaataaaaaatagtaaatgttatgttttaagcatttcgttctgtttgagtcgataggtgcttattgcatgcaaaggagggtttggtagcaaccgaggtcttctactttaatggttgaggtttagttatcatttg

SEQ ID NO: 3585 - DNA, 1330 bp, Cleome spinosa
ggctcgaggtaaaattcattgcagtttgaaagcgagattttcaagtccttcctccggttacaagtcaggattgtctaagggaagacctccatttgaggcattaacattgtggaacaaactaaaagagcagagccgacaatccttgttaaaactagtgggcatcttagcttgcactttcctcatagttccatctgttgatgctgttgatgctctcaaaacttgtgcctgcttactgaaggaatgcaggatagaacttgccaagtgtatttctaacccttcctgtgctgccaacgtcgcttgtctccagacctgcaataaccgaccagatgaaacagaatgccagattaagtgcggagatctctttgagaacagtgtcgttgatgaattcaacgaatgtgctgtctcgaggaaaaagtgcgtgcccagaaaatccgatctgggagagtttcctgctcctgacccggctgttctcgttaagagattcaacattggggacttcagtggaaagtggtacatatcgagtggcttgaatccgacctttgataccttcgattgccagttacatgagttccacactgaatctgacaagcttgttggcaacctctcgtggagaatacgcaccccagatggcgggttttttacgaggtcgacagtgcaaaaatttgtgcaagacccaaaccagcccggcattctttacaatcatgacaatgagtaccttcactatcaagatgactggtatatcctgtcttctaaagtagagaacggacccgatgactacgtttttgtgtattaccgaggaagaaacgatgcttgggatggctatggtggtgcagttgtgtacacaagaagtgcagtcttacccaataacattgtaccagaactcgaaagagcagcaaaaagcgtcggccgggacttcagcaagttcatcagaacagataacacttgtggacctgagcctccgctcgtggagagaatagagaagacggtggaagaaggggagagaacgatcattagggaagtcgaacagatcgaaggggaggtggcgaaagtgggagagaccgagatgactttgcttcagaggttggtcgaagggtttaaggaactgaagcaagacgaggagaatttcttgcaaggtttgaacaaagaagagatggagctgttgagtgaactgaaaatggaagcaagtgaagttgagaaactatttggcaaagcattgcctattaggaagctgaggtaataagaagaaacccagacttcaagaacactcacatacatacatacatatatatatatatgtctacattcattttgcagaatgcatgtttaacat

SEQ ID NO: 3586 - DNA, 1292 bp, Gossypium raimondii
atgtactttcataaatacgtatatagcttgctttagagagagagagagagagggatttctactaaagcaaaagcaaataaaaaaaatgaaaaaaccttgtgttgggtgattgttaaagggtcaattttgtgtctataaatgtctatctggtaaagcagaaaactgccttttttttgcaacacaaaactgtagctctacttaacctatattcatcaaaagaaggagaagagttggaattcaagagcttagcctttctcatagttcaattccttgccagctttgaaccatggagttccctaatctagacccagaaagctcttcccagaaaaaaatgggaagaggcaaaatcgagattaagcggatcgagaacaccactaatcgacaagttaccttctgcaagcgccgcaatggactgctcaaaaaggcctatgaattatctgttctttgtgatgctgaggtggctctcatagtcttctccagccgtggccgtctctatgaatatgctaacaacagtgtgagagcaacaattgagagatacaagaaagcatgctcagatgcaacaactccagggtctgtggctgaagccaacattcagttctaccagcaagaagccaccaaactccgacgacaaattcgtgatgttcagaacatgaacaggcatatccttggagaggctctgagctcattgacctttaaggaactcaagaaccttgaaggcaggctggagaaaggcatttgtagaatcagatccaaaaagaacgaattactgtttgcagaaattggattcatgcaaaagagggaagttgaactgcagaacgataacatgtacctgcgagcaaaaatagctgaaaatgaaagagcgcaacaacaatcaaaccagctgatgcaagcagcctcctcctacaatcgcaactttctgccagtaaacctgctggaacccagtaataatgattactccaaccaagaccaaactcctcttcaacttgtataagcttctctcttccacctccatctattcaagctgacatgcaagcagcagcctctaatgttctaccaactttatctctggttaagcatatatatatatatcttataagccttgcaagtatagacatatatatatttatatatggtttataaacagttgaaagcctagttgttgattatgatgaatgtaaggaacttaggtttcggcactggactcctttttaactgttttattgcaggaaaggtttatttttgtattatatatgtttcttaaaactctacatatagttttcatcccttctctc

SEQ ID NO: 3587 - DNA, 1166 bp, Carica papaya
attttttggtctataaatacccatctgctaagacaaccaacttctattttctgcaagtgcgttattacaaaggaagagagagtgggttttcaagaattctcatcctttctttctttctccccttcatctttttccattaagcttagctagtttccttaccagctttcaaccacggagttccctaatcaagaaccggaaagcagctcttcccagaagaaaatggcaagagggaaaatcgagattaagcggatcgagaacacaacaaatcgacaagttactttctgtaaacgtcgtaatggtttgctcaagaaagcttatgagttatctgttctttgtgatgctgaagttgctctcatcgtcttcagcagccgtggccgtctttatgagtatgctaataacagtgtcaaagcaacaatagaaaggtacaagaaagcatgttctgatgccacaaacccaggatctgtcactgaggccaatactcagttttatcagcaagaagccacgaaactgcgaagacagatccgggagattcagaattccaacaggcatattctgggtgaggctctgggctctttgactttcaaggaactcaagaatctggaaggaagactggagaaaggaatcagcagaattagatccaagaagaacgaacttctatttgctgaaatagagtacatgcagaagagggagatagagctgcagaatgataatatgtatctgagagcaaagatagctgaaaatgagagagtgcaagaacagcaacaatccaatctgatgcagggatctgtttatgaatccatgccttcccaatcacaaacctataaccggaatttccttcctgtaaaccttcttgaacccaatcatcagtactccgccgatgatcacactgctctacaactcgtttgaaatccgggatgagcagcagctatataacatatatatatatatatgtatgaagcagtaaaagtgatatttcccgtatgtgtatgagatttgatcagagagagaaagagagtatggatagttgtaagaaattcagcaacgtgaatgaatgattttaaattcagcagctatttagctgtgttaattaaattagacattttaattaccttaaatcctaacccacttccctatgaatttaaattaatccatagattgatatttgc

SEQ ID NO: 3588 - DNA, 627 bp, Gossypium hirsutum
caagcggctatgttttccagaggaacaaatgcaccatctggcgtgggagtggctgatcacagcaaaagcattacctggagctgcaaagaaagaaggtgtttcgatacgtgatctttaagatcgatgagaagaaaaggaggtagttgttgaaaaaacaggaggtccatcagagaactatgatgatttcactgcttcattgcctgagaatgactgccgctatgcagtttacgactttgattttgtgacttctgagaattgtcagaagagcaagatcttttttattgcatggtcaccgtctgtttcaaggatccgtgccaagatgctgtatgcaacatccaaggaaaggttcataagggaattagagggcattcattacgaaatccaggcaactgacccaactgagatggatctcgaggtgattagagagcgtgcaagttaaaagtgttgaaatcccgtcatcaatgccgcatgcttaggaaactcctgtgtttaattattgttaaataacacctaggaaggctgattaggagctcagggtgttcaaaacatgtcgggactttatgctcctcattccacatgatgcttctgaggtgacaatggatgtgttattattgaacagttttgacc

SEQ ID NO: 3589 - DNA, 704 bp, Olea europaea
cctcaactgctgccatgtctttcagaggaggggcaaatgcgttatctggcatgggcgttgctgatcacagcaaaagcacatacatggaattgcaaaggaagaaggcatatcgctatgtgatctttaagattgatgagaagaaaaaggaagtcattgttgaaaagactggcagtccagccgagggttatgatgatttcactgcatcgttgcctgagaatgattgccgatatgcagtttatgactttgattatgtgacttctgagaactgccaaaaaagcaagatcttttttatagcatggtctccttctgtctctcagattcgtgccaagatgctttatgccacctccaaggaaaggttcaggagggagctgcaaggtatacattatgagattcaggccaccgacccaactgagatggaccttgacgtgatcaaagagcgtgctaattaaatgctcttgccttgtgcaacgttatcttgtctttggcaaaagttcgatactttagtatcaagattaacaaatatgtcatctattaagtagtgtttaagcaatacttgtttccgacacacatgtatggcataatcatgtataaataaatacgacactgggaaggctgatttaggaattccaacatatatcccagattgtggggattatgcaattcgtgattctcatgatgcttccctgatgaaaaacgtattcgat

SEQ ID NO: 3590 - DNA, 631 bp, Petunia hybrida
ctgtgggtctgatcgctttaccgatgtctttcagagggaaaaatgcaacctctggcatgggggttgctgatcacagcaaagctacatacatggaactgcaaaggaagaaggtgcatcgatatgtgatatttaagattgatgagaagaaaaatgaggttgtggttgagaagactggaggtccagctgagagctatgatgatttcactgcagctcttccagagaatgactgccgatatgcggtatatgatttcgattttgtcacatctgataactgccaaaagagcaagattttcttctttgcttggtctccttctgtttcccgcatccgatcgaagatgttgtatgccacatcgaaggacaggttcaggagggagctggaaggcatacactatgagattcaggccactgaccctactgaagtagaaatcgaagttctcagagaacgcgctaactgattggcacttcctactattaaacaaccattcataatatttttgtctaattgcaacttaaaatgcatgatttacttaactacctattgagcaatagctcctcttttcacaaataacttgggaattgggatgctgattaccagtgtcatgatgatgatatcatgttttctggttatggg

SEQ ID NO: 3591 - DNA, 1085 bp, Theobroma cacao
gtgaaccgaccattttttccccctagtcttactgtaagtcccacctctctctttcatttatctctgcctctcctgttgttactaaaccaggcctgctcttcatttcctccttacttttgtattttattccgaacttccttttgctgcgatgtcgtttagaggactcagtcggccaaacgctacatcaggcatgggcgttgctgatcacagcaaggatacttttttggaactgaaaaggaagaaagtttaccgctatgtgatttttaaaatcgatgagaagaaaagggaggttgtggttgagaaaaccggtggacctgttgagagctacgatgacttcactgcatctctgcctgagaatgattgccgatatgctgtctatgactttgattttgttacttctgagaattgtcaaaagagcaagatttttttcattgcatggtccccttcatcctctcgaatccgtgcaaagatgctttatgccacttcaaaagacaggtttagaagggaactggatgggatccactatgagattcaggctactgacgctacagagatggatcttgaagttttaagggatcgtgctcactgaacactctgcagtttagctgtttcatttgaggaatttccttcttcgctttgccgagtctgaaatgagtcctccttgcttcataaagctatgtgcagaacctttttgtgcatgtctaatccttgaataaccagaatctggtgaagctgatatgaagctctgggctaatactatctggttgctgttaattctggttctttactgttttattgctctcaacgaagaaagtaagtcatggatatttggaaactctgaaactatttgcagatatattggtatgtctaattgttgtactttttgcttccctatccaatgcatttcgtgttccagtgtttggatgtggagtccgaacaccaaagtgaaacagaagttagccgggaggcttatctaggttgaatcaaagcgaaagccttttgctgtaaaaattaaggggcatcgctctagaatgcatcaagaaagccaagatagtgcaggaatatttgctgggctgaataaaaca

SEQ ID NO: 3592 - DNA, 765 bp, Jatropha curcas
attccttctcatattcattcttcactgttagttctgcttcttgtactttttcagcagctatgtcattcaggggactaagccggcctaatgcaacatcagggatgggtgttgctgatcacagcataaacacattcttggaactgcagaggaagaaagttcaccgctatgtggtatttagaattgatgaaaaaaagaaggaagtcgtggttgagaagactggtggccctgctgagagctacgaggatttcgctgcatctttgcctgagaatgactgcagatatgctgtatatgactttgattttgtgacttctgagaattgtcagaagagcaagatatttttcattgcatggtctccttcaacctctcgaatccgtgccaagatgctctacgcaacttctaaagacaggttcagacgagagctggatggtatccactatgagattcaggccactgaccctactgagatggatctggaagtgatcagagaacgcgctaattaaacagtccccgcaaacctaaggtttcttcctcaagggagacaaatctgttatgtttttgccaatttatgaataatgaatcttgctacacttaagtcacttacagaatcctttccagcacaaaaactggatgttccttaaataaccagcagtgggagaggctgatagtgatgagaagcactatttactctttgttgctgatcagatgaagagaagtttgttgttggtacttccaattttaaaatctgctatcatataaatttgcagt

SEQ ID NO: 3593 - DNA, 895 bp, Coffea canephora
cggccgggggaccgcagaatcaaacttgcagttcaggtttacacaatcacattcatactctcatttcttctttgaatatttgaaacttctcttcgtggccctcccgcagttaccgtatcttcagctatgtctttcagaatcagaggacaaaatgctacttccggtatgggagtcgctgatcacagcaaagatgcattcttggagttgaagaggaagaaggcttaccgctatgttatattcaagatcgatgagaagaaaaaggaagttgtagttgagaaaactggcaatccagctgaaagctatgacgattttactgcttccatgcctgaaaatgattgccgttatgcagtctatgactttgattttgtcacctctgagaattgtcaaaagagcaagattttcttcattgcatggtctcctgcaatctctagaattcgtgccaagatgctttatgctacatccaaagaaaggtttaaaagagagttggatggaattcattatgaaattcaggctactgaccctactgaaatggatctcgaagttatcagggaccgtgcaaattaaagcttctgatgttcattatctttgtaagaagcaaaaattgatagagctccatcttcaaagcaattatcatgttgactcctttgagctatccacatatccatttctggagcaagtgctgcaaaaataatgatacctggagttactgatttgaggccatggtcagtctctagttgcctagtgtataatgttctagtatgacttgcttcttctcatgaggcgttcataatcttgactcgagtacatacattaggcgtatatttggttcaacagactttggtttgtttattgtgtattgcactttaaggagaataatgccaaaagccttttcctt

SEQ ID NO: 3594 - DNA, 920 bp, Manihot esculenta
gctgtgcagtttttaaattgaagcttcttcgcttcattcctcactgttagcttctgaaccttgttcttctttcttagctgtcatgtctttcagaggactcagccggcccaatgcaacttcagggatgggcgttgctgatcacagcataaacacattcttggaactgcagaggaagaaggtccatcgctatgtggtgtttaaaattgatgagaagaagaaggaggttgtagttgagaaaaccggtggccctgctgagagctatgaggatttcactgcttctttgccggagaatgactgccgatatgctctatatgactttgattttgtgactgctgagaattgtcagaagagcaagatcttcttcattgcatggtctccttcaacatctcgaatccgagccaagatgctctatgccacgtccaaagaaaggttcagaagggagctggatgggatccactatgagattcaggctactgaccctacagagatggaccttgaagtgctcagagaccgcgcaaattgagcagtctctgcaattcagaggtttctacctcagaggaggttaatctactattgttattccagcttctgaattatgcctctcctattaagcttcttgcagaatccttttccaaacaagataaaccacatgttccttaaataactagcaatggaagaggcaagctcgcatgctcgctgctgctgatcggataagaaaaagtttgttgttgtttacttggaagtttaaatatgttatcctatcaatttgcagtaagtacttgtctttctttttaattttcttttgcatcccctgcttttttccctatctgtgttctttgtgccgcatagaggcaagaaaattggatagttgaatggtgaaaaatgaaaatcatgaatcaatttcccttgctttggaatcc

SEQ ID NO: 3595 - DNA, 725 bp, Euphorbia peplus
tacctgccatgtctttcaggggacttagccgtccgaatgcaacgtcggggatgggggtggctgatcacagcatgaacacatttacggagctgcagaggaagaaggtgcatcgttatgttgtgtttaagattgatgagaagaagaaggaagttgtggttgagaagattgggggtcctgctgaaaactacgacgatttttctgcttctttgcctgagaatgactgccgttatgctatctatgattttgattttgtcacttccgagaattgtcagaagagcaagatcttcttcattgcttggtctccttcaactgctcgaatccgtgccaagatgctctatgccacttcaaaagacaagttccgaagggagctcgatggtattcactacgagattcaagctactgaccctactgagatggatcttgaagtgctgagggagcgtgcaaattaaacggtttgcagctcatagggcttcttcttattcaaggtagaaagatgaatcgggtatgcttttgccagcttatgaatcctgtgtgttgcttcactaagcaactatccttttactgaaacaggatgaaaatggcaccatctttgttataataaccttaactggggagagtatgataagaagctctgttgttgagaagatgaagtttgttttttgggtacttgaaaagaattatgcaatatgttaattgtatgaatttaaagtagataatcttgtatt

SEQ ID NO: 3596 - DNA, 647 bp, Euphorbia esula
ctttcaggggactaagccgaccgaatgctacgtcggggatgggggtggctgatcacagcttgaacactttcacggagctgcagaggaagaaggtccatcgttatgtggtgtttaaaattgatgagaaaaagaaggaagttgtggttgagaaaattgggggtcctgctgaaaactatgacgatttttctgcttctttgcctgagaacgattgccgatacgctatctatgattttgattttgtcacctccgagaattgtcagaagagcaagatcttcttcattgcttggtctccttcaacggctagaatccgtgccaagatgctctatgctacttctaaagacaagttccggagggagctcgatgggatccactacgagattcaagctactgaccctactgagatggatcttgaagtgctgagggagcgtgctaattaaacggcccccagctcatagggcttcttcttattcaaggtagagatgaatgcatgtggtatgctaattttgccagcttatgaatcctgtttgttgcttcactaagcaacttgctactatccttttactgaaacaggatgaaaatggcaccatcttttgttataataaccataactggggagagtttgataagaaagaagctctgttgttgag

SEQ ID NO: 3597 - DNA, 1091 bp, Utricularia gibba
gctgccttcgatcgtaatgtcttttcgctggggagtgagaaatgcaatatcagggatgggtgtggcagatgacaccaaaacaacttacatggaattgcagaggaaaaaagtgtaccgctatgtgatattcaagattgatgagaagaagaaggaggttgtggttgaaaaaactggcaaccctgctgagaactacgaagatttcactgcatctctgccagagagtgactgtcgctatgcggtttatgatttcgatttcgtaacttctgataaatgccaaaagagcaagatcttcttcattgcatggtcaccctcggtctcccgcatccgttcaaagatgctttatgcgacttccaaggaaaggttcaggagggaattggagggcgttcactacgagattcaggcgaccgatccaaccgagatggacatggacgtgatcaaggagcgtgccaactgatcccatcaccatcatcacctataaagaagtatacttgtccatggtgtctttccttcatagttttattaacttttaaccttgaataagctggcttaggggaaatgctgattgggagctctctcacctgcaacatgcttctccccacaagtgatgcgttttccggttatgttatcatgtaatgaagctgtattcgaaactgtggtgctgctatggtcttttgcttgcttttgtaccttcccaattgctgcaactgccataagccacagggatgttcgttgcagactcagattccaatgacagggacaatgatgcagggtgctggtctatctgtatatttgtgaccatgaaacattgcttctttgttatcttcctcattctgctgacaaggaagttccggcccaactccccggtagcctattcgcagaatctgttttccgatgactcttcccggtccaaggatctttccggtcattcttgatagcaacgcaggggtttgattctacaccaaaaaacaaataccaaatgtctggtccaaaccagacaaacaaaaaagaatgaaaagctctcctccacttagatggcaatactgtgtttcggtctggtgttttttttattatttatgttggtggctcttatg

SEQ ID NO: 3598 - DNA, 2053 bp, Ricinus communis
gagaaaatgaggtagagaaataaagaaattataatttttttctttcaccaaaaattattattttttattttattgaaaagtgggaaaaatttgaaggaagaatattttaaaaaagtaattaataatcaaagaatctaatatttcctctctttctctccctcctctttcacccacttccaaacatagggttaccattcaagaaaacattagagagaagaagagaataccatcattgttcttttggaagcattcaattgccatctacttcaagatttaccaatattccttcccatttctaaatctatttttctttttctttttcttttctttttgccttttacgtccaaaacttggccactcctttctcttttataacaactgctgtggtgtgcttatccttcttaaattgaagcaagctgttctcttcattgctcattccttattctacagtttgctttacttcttaatctttctactgttctgttagcatgtctttcaggggaatatcccggcctaatgcaacatcagggatgggtgttgctgatcacagcataaacacattcttggagctgcagagaaagaaggtccaccgctatgtggtgtttaaaattgatgagaagaagaaagaggtcgtggtagagaagactggtggccctgctgagagctatgaggattttgctgcatctttgcctgataatgactgtcgatatgctgtttatgactttgattttgtcacttcagagaattgtcaaaagagcaagatcttcttctttgcatggtctccatcaacctctagaatccgtgccaagatgctctacgccacatctaaagacaggttcagacgtcagttggatggtatccactatgagattcaggctactgacccgacagaaatggatcttgaagtgcttagagatcgcgcaaattaagcttgcgctgtaattccaaggtttcttccacacagaaggttatgctatagttttgcaactcatgaattatgcctcttgcaacactaagcagctaatttgcagaatccttttctggtcaagataaactgcatttttcttgaataactagggagagaccgataagaagctgtatctactctttgctgctgatcagatgaagagaaatttattattgggtacttgtatttttatgatattttatcatacaaattcgcatttagatatttacgttctcttctttgcttcttctttcttctatttttcgaatgtgttctttctattgcacagagataagagtattggattgttggttggtgaacactgttgggatcagttttctttggaagctaagatagcccaagtgcttggctagtagagatatatgtaaaaagaaattcttttatgattctagaatgaacttaatgaaagttacatttgaggttgatcaaagaggaaaaaggcaaaaagggaacaatctgccgctttgtccattggaatcggcaatagatgaggagaaatcgaactagcaaggcttcctttacaaaatcatgctaatataggataacctacgcagccaaaacaatcctttccagttgcacttccagttttcctggatgcagctattcttcactctctacctcattttcacgggacatctcctccaaagattttcctttggattctggcaccaagaaagtaaacagcatgcctaataaattgactatacccaacaagatgagtgaattcttcacaccaattcctgcagggtaccctgcatctgccttggacttgtcctggttctgagccaaatacaagaacccaaatgcgccgaccatagccccaagcttcccagacgctgctgatataccatggcatgtagaccttaacctcgcggggaaaatctccgctggcactatgaatgtggtagaattaggtccaaagtttgcaaagaagaaagtaaatgaatacattaccacaaatccaattctattttccttgtgtgtccagtgattgtaaggaatggctaaggcaaacataaacactgtcatgaagaaaaatcccatcatttggatggcaaaccttcc

SEQ ID NO: 3599 - DNA, 3163 bp, Ricinus communis
aatttttttctttcaccaaaaattattattttttattttattgaaaagtgggaaaaatttgaaggaagaatattttaaaaaagtaattaataatcaaagaatctaatatttcctctctttctctccctcctctttcacccacttccaaacatagggttaccattcaagaaaacattagagagaagaagagaataccatcattgttcttttggaagcattcaattgccatctacttcaagatttaccaatattccttcccatttctaaatctatttttctttttctttttcttttctttttgccttttacgtccaaaacttggccactcctttctcttttataacaactgctgtggtgtgcttatccttcttaaattgaagcaagctgttctcttcattgctcattccttattctacagtttgctttacttcttaatctttctactgttctgttagcatgtctttcaggggaatatcccggcctaatgcaacatcagggatgggtgttgctgatcacagcataaacacattcttggagctgcagagaaagaaggtccaccgctatgtggtgtttaaaattgatgagaagaagaaagaggtcgtggtagagaagactggtggccctgctgagagctatgaggattttgctgcatctttgcctgataatgactgtcgatatgctgtttatgactttgattttgtcacttcagagaattgtcaaaagagcaagatcttcttctttgcatggtctccatcaacctctagaatccgtgccaagatgctctacgccacatctaaagacaggttcagacgtcagttggatggtatccactatgagattcaggctactgacccgacagaaatggatcttgaagtgcttagagatcgcgcaaattaagcttgcgctgtaattccaaggtttcttccacacagaaggttatgctatagttttgcaactcatgaattatgcctcttgcaacactaagcagctaatttgcagaatccttttctggtcaagataaactgcatttttcttgaataactagggagagaccgataagaagctgtatctactctttgctgctgatcagatgaagagaaatttattattgggtacttgtatttttatgatattttatcatacaaattcgcatttagatatttacgttctcttctttgcttcttctttcttctatttttcgaatgtgttctttctattgcacagagataagagtattggattgttggttggtgaacactgttgggatcagttttctttggaagctaagatagcccaagtgcttggctagtagagatatatgtaaaaagaaattcttttatgattctagaatgaacttaatgaaagttacatttgaggttgatcaaagaggaaaaaggcaaaaagggaacaatctgccgctttgtccattggaatcggcaatagatgaggagaaatcgaactagcaaggcttcctttacaaaatcatgctaatataggataacctacacagccaaaacaatcctttccagttgcacttccagttttcctggatgcagctattcttcactctctacctcattttcacgggacatctcctccaaagattttcctttggattctggcaccaagaaagtaaacagcatgcctaataaattgactatacccaacaagatgagtgaattcttcacaccaattcctgcagggtaccctgcatctgccttggacttgtcctggttctgagccaaatacaagaacccaaatgcgccgaccatagccccaagcttcccagacgctgctgatataccatggcatgtagaccttaacctcgcggggaaaatctccgctggcactatgaatgtggtagaattaggtccaaagtttgcaaagaagaaagtaaatgaatacattaccacaaatccaattctattttccttgtgtgtccagtgattgtaaggaatggctaaggcaaacataaacactgtcatgaagaaaaatcccatcatttggatggcaaaccttcccattttatcgatgagagccaccgtgaaccaatagcccgggacagtactgcatagagcaataagtgtttgtgcccttgcaattctaaaaacctcctgaatagcattcattgattttgctgaaggaatccatccaatggcactgaatatgtccttctggaatagattttgactgtaaaatgcaatgtcaagtaagaaccatgtacttgtggttccaagtaagtgaagtccatggcgacgaagaaactcttttgaaaacagaccaaaagaactggttggctgctgattcgacctctcaatcttctgaggttctgcctcaatattgacctgcagaaccttggacatatcacttgctgcctgctgtgcattctttgcaactagagcagtgtagcgagcagtttcaggcatcttcaatcgccagtaataagtcagtccagctggtaatgctccaaccataagaataattcgccaaacgtaatctgcttgagggacagtcgaaccgattggatcaacttcataagcaggagcactgaacttggagtcaaatgcagatgctacgataatagcaaatatgcctcctgctaaaattccaaacccttgcatcgcaaagactgctgcaatgaacgcaccgcgagtctttttgttagcatattcagacatgatcgttgcggaaagcgggtagtcaccgccaataccaaatccaagccagaacctgaagaagcaaagggttgccataactgcttttggatccttcccgaaagaaaggcctgaacaaacagaacaaatgaccataagcatcagggtaattccatagaccttctttctacccattttgtcaccaagccaaccaaaaaatagttggcctgacaaagttccaacgaatgcaacaccattaacagctgctgatacattaggaggcaatgtgccaggtttctctgcaccatcaacatgatagtatatgcggccgagcaatttcgttacaagggatatgcagaatagatcatatgcatcagtgaagaaacccattccagcaataacaactgcagtgaaatgataaagctgtgtctttgccacatcaagtttattaagaacgtgcaaatgatcgttggccattttcttgcaatgcccactaattaaccaaaacc

SEQ ID NO: 3600 - DNA, 1069 bp, Citrus clementina
atccgttgcgttgccattcgcagagagagagagagagaccccacgctgtcctccccacacaaatacacagttcgaatcttccccattccaccatttgcatttttctttaaaaatcttcttttttttttttaattattaggccacttcttttagttttattctgtgcgcaaaacattttcgttctctttcattgtttatttacttgctctggtgatctgcgttttgttgctgctgccgccatgtctttcagaggactaagtcgaccaaatgccacttctggcatgggcgttgctgatcacagcaaaaatgcattcacggaattgcaaaggaagaaggttcaccgttacgtgatttttaagattgatgagaagaaaaaggaggttgtggttgagaagactggtggccccgctgagagctacgaggatttcgctgctgctttgcctgagaatgattgtcgatatgctgtatatgactttgactatgtgacttctgagaattgtcagaagagcaagatattcttcattgcatggtccccttcaacctctagaatccgtgccaagatgctgtatgccacatctaaagacagatttcgacgggagctggatggtatccactatgagattcaggctactgatcctacagagatggatcttgaagagcttagaaaccgtgcaaactgaagagtctgcagttttgcagtttcttccttccatgaaaaaaaaaatcagcaaggggttctgccaactgttgctccttgcttcattaatctatatgcaaaaatctatgcgtaatcttcgaataactggcaatgtgggaagactgattgggctgaggttatcttgttgcggtgaaattagcttcccagtggtttattgctactctgatgaatataagtttgtttgttgggtatttggaaattctggaacatattgtcgtaacattgatctctaattcatattcgctgtccttgtgcttcctccttgattttattttctataatgtgaaagtggaccagagaagatttcaaatgaagggatcacattctcagaaatagaactactgcgcgtta

SEQ ID NO: 3601 - DNA, 861 bp, Hevea brasiliensis
tgaagctgcttctcttcattcctcactgtttgtttatgagccttgttctttcttagccgccatgtcattcaggggactaagccggcccaatgcaacgtcagggatgggcgttgctgatcacagcataaacacattcttggaactgaagaggaagaaggtccacctatatgtggtgtttaaaatttatgagaagaagaaagaggttgtggttgagaaaactggtggccctgctgagagctatgaggatttcactgcttctttgccagagaatgattgccgatatgctgtatatgactttgattttgtgacttctgagaattgtcagaagagcaagatcttcttcattgcatggtctccttcaacatctcgaatccgagccaagatgctctatgccacatctaaagacaggttcagaagggagctggatggtatccactatgagattcaggcaactgactctacagagatggatcttgaagtgctcagagaccgtgcaaattgagcttcctctgcaattcagaggtttccacctcaggggagacaaatccgccattgtttttccaacttctgaattatgcctcttctattaagctacttgcagaatccttttccaaacaagataaacaacatattccctaaataactagcactggaagaggctgataagaagctcccgtactctttgctgctgatcagataagagaagtttgttgttggttacttggaagtttaaatatgttatcataacaatttgcagtagagactcttttctttttcttcctccgcttttccttatctgtgttctttgtgttgcacagaggaaaaaaattggacagttgaaatgttgaaaatcatggaagg

SEQ ID NO: 3602 - DNA, 1083 bp, Citrus sinensis
atccgttgcgttgccattcgcgcagagagagagaaagagaccccacgctgtcctccccacacaaatacacagttcgaatcttccccattccaccatttgcacttttctttaaaaatcttctttcttttttttaattattacgtataaaactaggccacttcttttagttttattctgagcacaatacattttcgctctctttcattgtttatttacttgctctggtgatctgcgttctgttgctgccgccgccatgtctttcagaggactaagtcgaccaaatgccacttctggcatgggcgttgctgatcacagcaaaaatgcattcacggaattgcaaaggaagaaggttcaccgttatgtgatttttaagattgatgagaagaaaaaggaggttgtggttgagaagactggtggccccgctgagagctacgaggatttcgctgctgctttgcctgagaatgattgtcgatatgctgtatatgactttgactatgtgacttctgagaattgtcagaagagcaagatattcttcattgcatggtccccttcaacctctagaatccgtgccaagatgctgtacgccacatctaaagacagatttcgacgggagctggatggtatccactatgagattcaggctactgatcctacagagatggatcttgaagagcttagaaaccgtgcaaactgaagagtctgcagttttgcagtttcttccttccatgaaaaaaaaatcagcaaggggttctgccaactgttgctccttgcttcattaatctatgtgcaaaaatctatgcgtaatcttcgaataactggcaatgtgggaagactgattgggctgaggttatcttgttgtggtgaaattagcttcccagtggtttattgctactctgatgaatataagtttgtttgttgggtatttggaaatcctagaacatattatcgtaacattgatctctaattcatattcgctgtccttgtacttcctccttgattttattttctataatgtgaaagtggaccagagaagattacaaatgaagggatcacattcttagaaatagaactactgcgtgttat

SEQ ID NO: 3603 - DNA, 569 bp, Eutrema parvulum
tttgtttttaatctatctcaatagccaaatgcaacatccggaatgggtgttgcagatcagagcaaaaccacatatcatgagctgcagaggaagaagactcatcgatacgtcgtcttcaagatcgatgaagccaaaaaagaagtggtggttgagaaaaccgggaatcctgcagagagctacgacgatttcttagcttctctccccgacaatgactgcagatacgctgtttatgactttgatttcgttacatctgagaattgccaaaagagcaaaatcttcttcgtcgcttggtctccttcgacatctagaataagggcaaagatgctttacgcgacttcaaaagacaggtttaggagggagcttcaagggattcactatgagattcaagctactgatcctacagaggttgatcttgaagtcctacgcgaacgagcaaactgagaggaaaaaagttgtccctacctggaaacttatggtaaatgtaatgaataatcaatcatttcggtgacattggatttttcgtattctcgttgatggatttgtgtaaacacagtttcatgtttcatgac

SEQ ID NO: 3604 - DNA, 1395 bp, Lippia dulcis
ctttagatctaaaatttgttgtttggttgatcggtagtttgtgtgttggtattgttgttctttgattgaaatccttttaattttttatttggattcgctctattgtatgcgaaagttgctggtattgtggattctgatgtgaattttgttaaaattgagtcaatttgctgatgatggatctgggtggctgaggtgaaaattgattttgtttgggatttggaagatactggtggcgttaatttagtgattctatttacttgaagtacgcttctttagtagttcgctgacggagttgtggaggttgtgattaaatgaattgtggtgtgctttgatactgatatctcatctttgtcggatatgattagggttgctgtgtagcttttttgttttcagatcagaggggcctttttaagtttgctcatgatttagtctgtatgccatgatgcttttcattgcataaaaaacttgaatatattgtgtgtgtgcatacgtccgcgatcattgcaggtataaatttaatctgattttgttgacctcttggttttacttgaatcaagttgttgactgtatttgtgacaccagacaaatgcatcatccggtatgggtgttgcggatgagagcaaaagcacgtacatggaattgcagcgtaagaaggtacaccgctatgtgatatttaagattgatgagaagaaaaaggaagttgtggttgaaaagactggcacgccagccgagaattacgatgatttcacttcttctctgcctgagaatgattgcagatatgcagtttatgactttgattatgtgacttctgagaattgccaaaagagcaagatcttcttcattgcatggtctccttcgagctctcgaattcgttcaaagatgctttatgcaacatccaaggaaaggttcaggagggagctgcaaggtatacattatgagatccaggcaacagacccaactgagatggagctcgatgttatcaaagaacgtgcaaattgaaatccttttctgtttctcctaatccgaagcctaacttccatagttgtggcttttcagtacttgtgtgtggtaaagttacatataaagcttaatggtaaataatttggcacgcggggaaggctgattagaggagctctattgctgctccttgttctcatgatgcttccccaatgaaaaatgtgtccctgcttatggttatggctatcaacagttcaattctggaaatatgggaatttgttgatgtcttgtgacctgtatcatttataacatgttaatacctataaactattttaaaatgttttgtgctatattgttaaattgtctgattctagccttgtgtgtgtgcatgaattttgatgtaatttgtgcttgcaaaattttatattcccacttgaa

SEQ ID NO: 3605 - DNA, 862 bp, Liriodendron tulipifera
gtattctctctctctttctcctttcttcccttttacctttccgaccaaacccaattgcttccattctttataaacagctctttctcttctcctcttctccatttccttctgctctcgatttgcagccatgtctttccgaatgtcaagtgctccttctggcatgggagtggccgatcatagcaaggctgcctttatggaactgaagaggaagaaggtttaccgctatgtgatatttaagatcgacgagcagaaaagggaggttttggtcgagaaaactggaggtccagctgagagttatgacgacttcactgcagctttgccagagaatgattgtcggtatgcagtctacgactttgatttcgtgactgcggagaattgccaaaagagcaagatcttcttcattgcgtggtctccatccatctcccgaatccgagccaagatgctgtatgccacaaccaaggaaaggttccgacgggagctcgacggcatccattacgagatccaggctactgaccccacggagatggatatggatgtgattagagaccgcgcgaactaagcaggctcttgctaagaaggatttcctgtgatcaggagcagaatttgcacaactattagggactgctttgggtttggattagtagctgatcatgtgcaatatcttattcctcagtagacataaaatagtagcattaaaaaaataaatcaacacctgatggaaggctgatgggaaggcccacttgtttcagtgggccccaccactgttatgatgcttctacaggtgtggtcggggtttggtcttatatggaatttgactctctatgtgctactatgacactggctggaatatatatattttact

SEQ ID NO: 3606 - DNA, 896 bp, Eutrema halophilum
agagcgaagcgacgcatccaatctccttttatataagttttcttttatatttataaattcgtgtcgtctacgtctctcacgctctaaatctcttcaaaaaaaaaaaaatcaattcttgtctgaagaaagcagaatcaatccatggctttcagaggacttagcaagccaaatgcaacatccggaatgggtgttgcagatcagagcaaaaccacatatcatgagctgcagaggaagaagactcatcgatacgtcgtcttcaagatcgatgaagccaaaaaagaagtggtggttgagaaaaccgggaatcctgcagagagctacgacgatttcttagcttctctccccgacaatgactgcagatacgctgtttatgactttgatttcgttacatctgagaattgccaaaagagcaaaatcttcttcgtcgcttggtctccttcgacatctagaataagggcaaagatgctttacgcgacttcaaaagacaggtttaggagggagcttcaagggattcactatgagattcaagctactgatcctacagaggttgatcttgaagtcctacgcgaacgagcaaactgagaggaaaaaagttgtccctacctggaaacttatggtaaatgtaatgaataatcaatcatttcggtgacattggatttttcgtattctcgttgatggatttgtgtaaacacagtttcatgtttcatgacaactgtataaatctcagttgatgtttcagattgcacatctaaaaagtcaaaacctcaggcttaacttaaactgcaaaagcttaagattgtctttaggttgatgcaggcttgtagtgatgttatttccggaccgggtccaaccgggaaccgaaagtgtttcgaccggataaataaactcccgttaaa

SEQ ID NO: 3607 - DNA, 495 bp, Capsicum annuum
ccccccccccccccccccccccccttaacaatgtctttcagaatcaaaggggcaaatgcgccctctggcatgggggttgctgatcaaagcaaagctacatatatggaactgcaaaggaagaaagtgcatcgatatgtgatatttaagattgatgagaagaaaaatgaggttgtggttgagaaaactggatgtccagctgagagctatgatgatttcactgctgctcttcctgagaatgactgtcgatatgcagtatacgattatgatttcgtgacacctgataactgccaaaagagcaagattttcttctttgcctggtctccttctgtttcccgaatccgatcgaagatgctgtatgccacatctaaggacaggttcaggagggagctggaaggcatacactatgagattcaggctactgatcctactgaagtagaacttgaagttctcaaagaacgcgcttactgattgaaacttcctaccatgaaacaacca

SEQ ID NO: 3608 - DNA, 772 bp, Capsicum annuum
ctcatcactttaacaatgtctttcagaatcaaaggggcaaatgcgccctctggcatgggggttgctgatcaaagcaaagctacatatatggaactgcaaaggaagaaagtgcatcgatatgtgatatttaagattgatgagaagaaaaatgaggttgtggttgagaaaactggatgtccagctgagagctatgatgatttcactgctgctcttcctgagaatgactgtcgatatgcagtatacgattatgatttcgtgacacctgataactgccaaaagagcaagattttcttctttgcctggtctccttctgtttcccgaatccgatcgaagatgctgtatgccacatctaaggacaggttcaggagggagctggaaggcatacactatgagattcaggctactgatcctactgaagtagaacttgaagttctcaaagaacgcgcttactgattgaaacttcctaccatgaaacaaccattcataatgtttctgtataatcgcgtcttacaaggctcgatttacttaactatgacataaataactcgacgcttgggttgctgattaccagactcgtgatagcgatatcatgttttctggctatgagttctctcattctcatgatgcttcccagtcgagaaacgagtatggttatgtaatttgaatgattcaagtatcaactatagtaaggctaagcaatatatgtaatgtgttactctattagtatctgatcgatgatgcttgtttttcgtctgatacactactatgctga

SEQ ID NO: 3609 - DNA, 1112 bp, Castanea mollissima
gacacagcagtcctgtgactcaaaaaaagtccgagattaaggagagggataggaaattgcagttccctttggttgtttggcattattctttgttgtccaatttataaaaagacttcttgccttttccttttccttccaaaactttttcatccgggggggtatacgtgctataagggtatacccatcagctttagcttcctcttcttcatcatcttcttcttcttccatagtattattattatactttcttcgttaccatgtctttcagatggctcagcaggccaaatgctttgtccggcatgggtgttgctgatcacaccaaaaacacgtttctggaattgaagaggaagaaggttcaccgttatgtgattttcaaggttgatgagggtaaaaaggaggtagtggttgagaagaccggtggtccagccgagagctatgatgatttcactgcagctttgcctgagaatgattgccgatatgctgtatatgactatgattttgtgacttctgataactgtcaaaagagcaagatatttttcattgcatgggctccatcatcctctcgaatccgtgccaagatgctctatgctacatctagagacaggtttagacgggagctggatggtgtccactatgagattcaggctactgaccccacagagatggatcttgaagtgatcaaagaccgagcacactgaataatctctgcagttactgagttttgttcagtggggaaaagatctgatatcactatgccaacttatgaattagttatccctgtgcagaacccattttagaaacaagatagtattgcatgatccgtgaataaactaacatctgggaggctcaaggtttaggctaatttttgctggaaactgagagtcaatttccttattgattactgcttctcaggtgaagatggctttgttaaagggaatctagaaactctaaatgtaagtcattatattgatttcatctttaaaggattgtcctgtaaaaggatatttacaaactcttgttgtatatcgtcttataagtttggtttcaggggatgcatttgatactgccaagtgctgttacttaactctatatacaataatgtatatttaatt

SEQ ID NO: 3610 - DNA, 814 bp, Cleome spinosa
tcggggtatttcgttgagttctcttgatctcatctccttctcatctctgtttacattctctgttctctgtcgcttaaggcaatgtccttcagaggtttcagccggccaaatgcggcatctggaatgggagtttcggatcaaagcaagagcacgtacatggagctgcagaggaaaaagggtcatcgttacatagtcttcaagatcgacgagaacaagaaagaggtgatggtggagaagaccggtgcagcttccgagagcttcgatgatttcgtcgggtctctgcccgagaacgattgcagatacgctgtttacgacttcgatttcgttacatctgagaactgccagaagagcaagatcttcttcatcgcctggtcgccttcgacttcgagaatccgagcaaagatgctttacgcaacgtccaaagacagattcagaagagaattggaaggcatccactacgagattcaagccaccgacccttcagaggttgacctcgaagctctccgcgaacgagcaaactgatgatcatcatccccttcaacttctttgtattctccgtattggtagtgattgtgtaacgtgctgtgttgctgcaataatgctttggtacgatgagaagcccaatgtggcgacatatatcaaggtgaaggaaggctactgtgttgttattttttctgattccgaatgaaatcgtctatatgcttatattgtgattattatggaattgttgctgctctgctgtaccttcctttgaatccatttcaatgccttttccgccctttggagtgaatccttttgtttccgcgattttaca

SEQ ID NO: 3611 - DNA, 994 bp, Gossypium hirsutum
ccttgtagttttattaactaatataagcgccatagctctgtttcattagtctccgcctctgttactgcctcttgggctcttgttacttaacctagggctgttctttattttccttttctctctgttcttttgtccctttgctttacttctttttgcttccatgtcgtttagaggattcagtcggccaaatgctacatcaggcatgggcgttgctgatcagaccaaggatactttcttggagctgaaaaggaagaaagtttatcggtatgtgatatataggatcgatgagaagaaaagggaggttgtggttgagaaaactggtgcccctgctgagacctatgatgacttcgctgcatctctgcctgaaactgattgccgatatgccgtctacgactttgattttgttacttctgagaattgtcaaaagagcaagattttcttcattgcatggtgcccttcatcctctcgaatccgtgcaaagatgctttatgccacatcgaaagacaggcttagaagggaactggacggtatccattacgagattcaggctactgaccctacagagatggatcttgaagtggtgagggatcgtgctcattgaacagtttgcagttttagctgttccatttgaagagattacccaactctgcgttactccttgcttcataaagctaggtgcaggatcattttcgcatacaagttagtgtatatttagtccttgaataaccagaatctggtaaaaagctgatctgaagctctaggctaaaagtaactttgttgccatgaattcagattctttaccattcacatatattggcaatttggcatgtctcacaaatgttctctttgcttccctacctaatgtatttcctgctccaacatttggaattagaaatattgtgggattaaagaaaaagcctttcagtataattgaggagcatggtttacaatgcttcaagaaagttaataaaatgtaggaatttttcaaaaaaga

SEQ ID NO: 3612 - DNA, 985 bp, Gossypium raimondii
ttccctgtagttttattaacaatataagcgccatagctctgtttcattagtctccgcctctgttactgcctcttgggctcttgttacttaacctagggctgctctttattttccttttctctctgttcttttgtccctttgctttacttctttttgcttccatgtcgtttagaggattcagtcggccaaatgctacatcaggcatgggcgttgctgatcagaccaaggatactttcttggagctgaaaaggaagaaagtttatcggtatgtgatatataggatcgatgagaagaaaagggaggttgtggttgagaaaactggtgcccctgctgagacctatgatgacttcgctgcatctctgcctgaaactgattgccgatatgccgtctacgactttgattttgttacttctgagaattgtcaaaagagcaagattttcttcattgcatggtgcccttcatcctctcgaatccgtgcaaagatgctttatgccacatcgaaagacaggcttagaagggaactggacggtatccattacgagattcaggctactgaccctacagagatggatcttgaagtgttgagggatcgtgctcattgaacagtttgcagttttagctgttccatttgattacccaactctgcattactccttgcttcataaagctaggtgcaggatcattttcgcatacgagttagtgcatatttagtccttgaataaccagaatctggtaaaaagctgatctgaagctctaggctaaaagtatctttgttgccatgaattcagattctttaccattcacatatattggcaatttggcatgtctcacaaatgttctctttgcttccctacctaatgtatttcctgctccaatatttggaactagaaatattgtgggattaaagaaaaagcctttcagtataattgaggagcatggtttacaatgcttcaagaaagttaataaaatgtgggaatttttcaaa

SEQ ID NO: 3613 - DNA, 1009 bp, Fagus grandifolia
attgcagttgtgttgggttgtttggcagtattccccatttgttagataaaaagaaaagagagagagttttgcgtccgaaactcttttttatcttccttaatatctctccttcttcttccattctcttaaacactttattttcgctaccatgtctttcagatggctcagtcggccaaatgctttgtccggcatgggcgttgctgatcacaccaaaaacacctttttggaattgaagaggaagaaggttcaccgttatgtgatttttaaggttgatgagaataaaaaggaggttgtggttgacaagaccggtggtccagctgagagctatgatgatttcactgcagctttgcctgagaatgattgccgatatgctgtatatgactatgattttgtgacttctgataactgtcaaaagagcaagatatttttcattgcatgggctccttcatcctctcgaatccgtgccaagatgctctatgccacatctagagacaggtttagacgggagctggatggtgtccactatgagattcaggctactgaccccacggagatggatcttgaagtgatcaaagaccgcgcacactgaatagtctgcagttctaaagttttgttccttgggaaaagacctgatggcgctttgccaatgaattagttatccctgtgcaaaacccattttagacacaagatagtattgcataatccttgaataaactgacatcggggaagctcaaggtttaggctaatatcttttagaaactgagaaagtcaatttccttattgattgctgcttctcaggtgaagatgactttgttgaagggaatttagaaactctaaatgtaagtcatcatataaatttgggcttgaaaggattttcctgtaaaaggatatttagaaactcttgttgtatatcatcatatgaatttggttttcagggaatgcatgtgaaactgcaaagttctgttatttactatctccaatttccaaaattgttttggaaaaagatcct

SEQ ID NO: 3614 - DNA, 2144 bp, Eucalyptus grandis
gggagttcgaaaataatgaactttccttcgtagataaaatgagcagagggaagaagtcgtttttgtcgcggactcttctctctttttattacgtcttgcctccacagaaaaattgctctggaaaagacagggagaaaaaaaggctgagtcctctccttgttagaacgagtctctcgacattcgggaggcacctgttgctctcgttccttcgttgattccgacttccgtgtctgtaatctgcggtgcttctcagcctgccatgtcgttcagatggctgagtcgggtatttctctctcgctgcaaccatcccttttttgtttttttgtttttttttttttggcgattctatgtcgaacccttgacgcgtttcgggttgctcgtttgagttcttggtgaaagtttgaattttgagtgggagtagtgatgatataatcgtttatctgaaaagggtactcttagagcagcctgatttttacgggcgatggatttgttttgcttgtcgcctctagtttttgtcgcttgtgagtgtcgctggagcgaatgacgatttttcgtttgtttacggatgattgacatgatcatcgaggacgtgtcaatcgcagttttggtttgctcacttttgcacaagcataaactgttaacatcttgcctgatgttgggatcgctaagcatattcgtgggcttttgaaatcggcggaacttgtgagtgtctactgcttcttttacttaattgcatttcgtatacttacctgtggaataaaaaggatactctggctgtactttattccggggaaaatgcgaaagacatcccttagactatgaaaatgtttagctggaatctacgacttttaaatgaccatgcattgttgttcacccttcggaatgttggaagttatgaccattggaaggccatttccaaagaggaaaatgagttgatggtttggcccactttgatgttttttccattagttgtgcaggcgattcgtgctattttgagtggcaattcagtggctgcatttggcttattgcaaaattttcctaaattattcccatattccaccgtgtccgcggctattatacaattagacaatgatttgtatttttctgtaacttgagtatgcaactataattaggagcataatagcataatggggtttctgcgtgcagaactcttgtatagatcttattctaaagaggaactttggtttgtttgaattacctcatttgaaacctcgagtcgggttcttgtattccttttactcagggaaatgccacatctggcatgggtatatctgatcatagcaagagcactttcatggatctaaagaggaagagagtccatcgctacgtgattttccagattgatgagaagaaaaaggaggttgtggttgagaagactggtggcccagctgaaagctatgaggatttcacagctgcactccctcagaatgattgccgttacgccgtttatgattacgactttgtgacttctgataactgccaaaagagcaagatattcttcattgcctggtctccctcaacatcacgtatacgtgccaagatgctctatgccacctccagagagagattcagacgagatctggacggcattcattacgagattcaggctactgaccccacagaaatggatctggaagtgatcaaagagcgtgctaattgataaccagcttacaggttaaacattgacgattccctgttgtcccaaagaacgatgcattgcctgacgacatcggacattagatattcaatagtgcctagaaaatctgtaaatagtacaagttgttactactgttgacgaccacaatatgaggctttgttatgatcagctcgtaaggcatctttgctttaaattttacctgcttgcatttccaggataacagcaattgctaagtagctggaaattctatcagaagtacttatatgctttggttgctgaacttaccttaagtttgacttgtaacgttttttaagttttcattgccttactttaggcagagaagcacattgatcccttcaattatggccttgcaagtcataagtttatcctctgtctcaggagtatcttttgatgtaatttgattcggtctttttctttaccaacctatcataaaacgtgtttccaa

SEQ ID NO: 3615 - DNA, 736 bp, Raphanus sativus
atacttctcttcttcttcttcttcttcgtctctcaaacccgagtcttgtctgaagaaagcagaatcaatccatgtctttccgaggacttagcaagccaaatgcaacatctggaatgggtgttgcggatcagagcaagaccacataccacgagctccagaggaagaagactcaccgctacgtcgtcttcaagatcgatgagctcaaaaaccaagtggtggttgagaaaacagggaacccagcagagagctacgacgacttcttggcttctctccccgacaatgattgcagatacgctgtttacgactttgatttcgtcacctctgagaattgccagaagagcaaaatcttcttcgtcgcatggtctccatcgacatctagaataagggcgaagatgctatacgcgacatctaaagagaggtttaggagagagcttcaagggattcactacgagattcaagctactgatcctactgaggttgatcttgatgtccttcgcgaacgagccaactgaagggatatatttgttctctctatttaagaaaaatactctttatggtgtaatgtaatgaaaataatcattcggatttctcgtatttctcgtgggtgcatttgtgtaaccacagtttcttgttctatggacaagtgtattattaaactccagttgatgtttcagattactcatctataaacaagcctctttgtaacttagtgtgttataacctgaccggtgttttt

SEQ ID NO: 3616 - DNA, 775 bp, Raphanus sativus
gggagcaaagcgacgcatccgcatccgcacccgatctccttttttatataaactaaattaacctttttaatatatattcttctctcatacttctcttcttcttctctcaaacccgagtcttgtctgaagaaagcagaatcaatccatgtctttccgaggacttagcaagccaaatgcaacatccggaatgggagttgcggatcagagcaagaccacataccacgagctccagaggaagaagactcaccgctacgtcgtcttcaagatcgatgagctcaaaaaccaagtggtggttgagaaaacaggaaacccggcagagagctacgacgacttcttggcttctctccccgacaatgattgcagatacgctgtttacgactttgatttcgtcacctctgagaattgccagaagagcaaaatcttcttcgtcgcatggtctccatcgacttctagaataagggcgaagatgctatacgcgacatctaaagagaggtttaggagagagcttcaagggattcactacgagattcaagctactgatcctactgaggttgatcttgatgtccttcgcgaacgagccaactgagggatatatttgttctctgtttaagaaaaaaatacttttatggtgttatgtaatgaaaataatcattcggatttctcgtatttctcgtgggtgcatttgtgtaaccacagtttcttgttctatggacaagtgtattattaaactccagttgatgtttcagattactcatctataaacaagcctctttgt

SEQ ID NO: 3617 - DNA, 726 bp, Raphanus sativus
ttttctatataaaaatttaccctttttaatatatattctttcttatacttctcttcttctctcaaacccgagtcttgtctgaagaaagcagaatcaatccatgtctttccgaggacttagcaagccaaatgcgacatctggaatgggtgttgcggatcagagcaagaccacataccacgagcttcagaggaagaagactcaccgctacgtcgtcttcaagatcgatgagctcaaaaatcaagtggtggttgagaaaacaggaaacccggcagagagctacgacgacttcttagcttctctccccgacaatgattgcagatacgctgtttacgactttgatttcgtcacctctgagaattgccagaagagcaaaatcttcttcgtcgcttggtctccatcgacttctagaataagggcgaagatgctatacgcgacatctaaagagaggtttaggagagagcttcaagggattcactacgagattcaagctactgatcctactgaggttgatcttgatgtccttcgcgaacgagcaaactgagggatatttgtgttctatatttaagaaaaatactttttatggtgtaatgtaatgaaaataatcagtcggatttctcgtattctcgtgggtgcatttttgtaaccacagtttcttcttgttctatggacaagtgtattaaactcagttgatgtttcagattactcatctataaacaagcttctttg

SEQ ID NO: 3618 - DNA, 864 bp, Glycine max
ttctcttctaagttctaacattgcattattcacttcaaagttcaattctttctctgtcgtcgctctttcttcaacttcaagcttaattcctcatgtctttcagaggcctcagccggccaaatgccacatcaggcatgggtgttgctgatcacagcaaaaacaccttcatggaattgaagcagaagaaggttcatcgttatgtgatctttaaggtcgatgagaagaaaagggaggttgtggttgagaagactggtggcccggctgagagctatgacgattttgctgcatctttgccggagaatgattgcagatatgctgtctttgactatgatttcgtcacttctgagaactgtcaaaagagcaaaatcttcttcattgcatggtccccttcaacatctcggatccgtgccaagatgctctatgccactactaaagacaggtttagacgtgagctagatggtgtccattatgaaatccaggctactgaccccacagaaatggatcttgaagtgctgagagaccgtgcacattgaaatgtttaagcacttaaattcattttcatatcagaatctactaggttttacctttaatgaattacctcttcatgctttgtcatctgcagagcccatcttgccacagatatataactcgtatccaataatatgaatctgaaggctgatgggtttaaagcttttggcagttattgttgtaaatcccagtgtgctggacttgtattgtatgagcgtgactctatggatccagatagattacttggatgaaaaagttccttgttctaactttggcaagtatctatagaaaatttcaaaacttgcatttatcaatatttaatttgcttcttgaaag

SEQ ID NO: 3619 - DNA, 2877 bp, Zea mays
tgccaatctccaactcatacccctattccagaccctgattcttccacaagggggcagttgtcggtgatggaggcgttcggcgggttcttcgtggacgagaaggcagcgcgggtggagaacatcttcctcgagttcctgaagcgattcaaggagtctgatggcgcgggggagccgttctacgaggcggagatggaggtgatgcggtcgcgggagtccactaccatgtacgtagactttgcgcacgtcatgcgcttcaacgacgtcctccagaaggccatctctgaggagtacctcaggtttgaaccgtacttgaggaatgcatgcaagaggtttgcgttggagcaccgggctggcgagaaccgtgccccgctcatctcagatgatagccccaacaaagatatcaacattgctttctataacatcccgatgctgaaaaaactgagagagcttgggacagccgaaattggtaagctcacatcagtaatgggtgttgtgacacggacaagtgaagtgcggcctgaactattgcaaggaaccttcaaatgtctcgactgtgggaatgttgtgaagaatgtggagcagcagttcaagtacactgagccgataatatgcgttaatgcaacatgccagaacagaacaaaatgggcccttcttcgtcaggaaagcaaattcacagattggcagcgggtcagaatgcaggagacatcaaaagagatacccgctgggtcacttcctcgttcccttgatgtcattctgcggcatgagattgttgagaaggccagagctggggacacggttatatttactggaactgttgttgcagttcctgatgttatggcactaacttcacctggcgaacgagcagagtgtcgcagggaagctcctcagcgaaaaaacggaggtgttcaagaaggtgtaaagggcttgaagtcccttggagttagggatctgtcttatcgccttgcctttgtagcaaattcagtgcaggtcgcagatggtaggagagaagtggacatcagggaacgggacacagatggtgatgacagtgagagacagaaattcacagaagaagaggaagatgaagttgttaggatgaggaacactcctgatttctttaataagatagttgatagcatatgtcctaccgtatttggtcatcaagaaattaagagggccgtgcttcttatgcttttgggtggtgttcataagataacacatgaagggatcaaccttagaggtgacatcaatgtctgtattgttggtgacccaagctgtgcaaagtctcagttcctaaaatatactgctggtattgttccaagatctgtttacacgtcagggaagtcatcatcagctgctggtctgacagcaactgttgctaaagaaccagagactggtgaattctgtattgaggctggtgccctgatgctagctgataatggtgtttgttgtatcgatgaatttgataaaatggacattaaggatcaggtcgctatacatgaagcaatggaacagcaaacaattagcattaccaaagcaggaatacaggcaactttgaatgcacgaacatcaattttagctgcagcaaatccgaccggaggccgttatgacaagtcaaaaccacttaagtacaatgttgcattgcccccagctattctttcaagatttgatctggtctacatcatgatcgatgaacctgatgaaaacactgactaccacattgctcatcacattgtaagagtccatcagaaacgtgaagaagcacttgcccctgcatttagcaccgcacaactgaagcgttatatttcttttgcaaaatctttgaaacctcagcttagttcagaagcaaagaaagttctggtggagtcgtatgttacgcttcgtaggggggacagtactcctggaactagggttgcttataggatgacagttcggcaattggaagcattgattcggctgtcagaagctattgctcgaagccatttagaaagagttgttctcccagctcatgtccgcctggcagttaaattgctcaagacatccatcatcagtgttgagtcaagtgaagttgatctctctgacttccaagatgctgaagatggaacaaatgtaccttctgagagtgacgccggacagccagctgaagaagatgctgctcctcagcagcagggtgcagaaaatgaccaagcagcggataatggtaagaagaaattggtaataactgaagaacacttccagagagttactcaagctttggttatgagactaaggcagcatgaagagtcagtcaagaaagatggagatggtttagctggcatgaagcaaggggatcttatcatctggtatgttgagcagcagaatgccaaaggggcatatagttctactgcagaggtgaaggaagaagtgaagtgtatcaaggccattatagagagacttatacagcgggaaggccatcttatagtcattgacgaaggtactgcagccgcagccgaagatggcagtggcgcaaggagaacatcagagagtagaatactggcagttaacccgaactatgttattgattagcaacggcatcttaacatgctgttaacccaagccagttgatgtggttagctaactgaagctatgattctggtgatgtgtccgttgtgctctagagttgttgtaccatctccgtcactggtgtgctcgttccaagggagcacatgatctccaaaactacatactacgtttagtgatgcaggataattagcatctgtagtcttactaattttgacccgtgtttccctagtgaattttcgtagcaacagctttgatttatcagtcactgagtgctgcaattttctatttgctttctcaagttcaccctttgttgatcca

SEQ ID NO: 3620 - DNA, 2794 bp, Zea mays
ctagacctattccagccgagagtgacaatctccagtccaaagctctattgcagacctcgaatcttccacaaggggcattcgttagtgatggaggcgttcggtgggttcttcgtggatgagaaggcggtgcgagtggagaacatcttccttgagttcctgaagcgattcaaggagtcggatggcgcgggggagccgttctacgaggccgagatggaggctatgcggtcgcgggagtccactaccatgtacgtagactttgcgcacgtcatgcgcttcaacgacgtcctccagaaggccatctccgaggagtacctcaggtttgaaccatacttatggaatgcatgcaagaggtttgtgttggaacaccgggctggcgagaaccgtgccccaatcatctcagatgatagccccaacaaagatatcaacattgccttctataacatcccgatgcttaaaaaactgagagagcttgggacagccgaaatcggtaagctcacagcagtaatgggtgttgtcacacggacaagtgaagtgcggcctgaactattgcaaggcaccttcaaatgcctcgactgcggcaatgttgtaaagaatgtggagcagcagttcaagtacactgagccgataatatgcgttaatgcaacatgccagaaccgaacaaaatgggcccttctccgccaggaaagcaaattcacagattggcagcgggtcagaatgcaggagacatcaaaagagatacctgctggatcacttcctcgttcccttgatgtcattctgcggcatgagattgttgagaaggctagagctggggacacggttatatttactggaactgttgttgcagttcctgatgttatggcactaacttcacctggcgaacgagcagagtgtcgcagggaagctcctcagcgaaaaatgggaggtgttcaagaaggtgtaaagggcttgaagtcccttggagttagggatctctcttatcgcctcgcttttgtagcaaattcagtgcaggtcgcagatggcaggagggaaggggacatcagggatcgggacacagatggtgatgacagcgagagacagaaattcacagaagaagaggaagatgaggttgttaggatgaggaacactcctgatttctttaataagatagttgatagcatatgtcctaccgtctttggtcatcaagaaattaagagggcagtgcttcttatgcttttgggtggtgttcataagataacacatgaagggatcaaccttagaggtgacatcaatgtctgtattgttggtgacccaagctgcgcaaagtctcagttcctaaaatatactgctggtattgttccaagatctgtttacacgtcagggaagtcatcatctgctgctggtctgacagcaactgttgctaaagaaccggagactggtgaattctgtattgaggctggtgccctgatgttagctgataatggcatttgttgtatcgatgaatttgataaaatggacatcaaggatcaggtcgctatacatgaagcaatggaacagcaaacaattagcataaccaaagcaggaatacaggcaactttgaatgcacgaacatcaattttagctgcagcaaatccgaccggaggccgttatgacaagtcaaaaccacttaagtacaacgtggcattgcccccagctattctttcaagatttgatctcgtctacatcatgattgatgaacctgatgaaaacaccgactaccacattgctcatcacattgtaagagtccatcagaaacgtgaagaagcacttgcccctgcatttagcactgcacaactgaagcgttatatatcttttgcgaagtctttgaaacctcagctgagttcagaagcaaagaaagttctggtggagtcgtatgttaccctccgtagaggggacagtactcctggaactagggttgcttacaggatgacagttcggcaattggaagcattgattcggctgtcagaagctattgctcgaagccatttagaaagagttgttctcccagctcatgtccgcctggcagttaaattgctcaagacatcaatcatcagtgttgaatcaagtgaagttgatctctctgactttcaagatgctgaagatggaacaaacgtaccttctgagaatgatgctggacagccagctgaagaaggtgctgctcctcaacagcaggatgcagaaaatgaccaagcagcggataacggtaagaagaaattggtaataactgaagaacacttccagagagttactcaagctttggttatgagactaaggcagcatgaagagtcagtcaagaaagatggagatggtatggctggcatgaaacaaggggatcttatcatttggtatgttgagcagcagaatgccaaaggcgcatatagttctaccgcggaggtgaaggaagaagtgaagtgtatcaaggccattatagagagactcatacagcgggaaggccatcttatagtcattgacgaaggcacagcggctactgccgaagatggcagtcgctcaagaacatcagagagcagaatattggcagttaacccgaactatgttattgattagcaacagcatcgtaacatgctactaactcaattcagctgatctgtttaactaacagaagctataatttgggtgatgtgtctgttgtgccctagcattgttgtatcatctccgtgactgatgtcattgcaagggatcacatgatctccaaaactatataattcgtacagtattttgctttcttaagttcacccttttgggtccatttaagggcttt

SEQ ID NO: 3621 - DNA, 3004 bp, Setaria italica
ggccgcctgccccttcttcttccccaaccccaaaaccctcaccagcgcgcccacacgccgagacgaaatccccgaccggaagtcctagtccagatctagactcttagcgaaggcaccgccgtcggcgatggaggcgttcggcggattcttcgtggacgagaaggcgacgcgggtggagaacatcttcctcgagttcctcaagcggttcaaggagtcggatggcgcgccggagccgttctacgagacggagatggaggcgatgcggtcgcgggaatccaccaccatgtacgttgacttcgcgcatgtcatgcacttcaacgacatcctccagaaggccatcgccgaggagtacctcaggtttgaaccatacttgaggaatgcatgcaagaggtttgtgttggagcaccgggctggcgagaaccgagctccaatcatctcagatgatagtcccaacaaggatattaacgttgccttctacaacatcccaatgctaaaaaagctgagagagcttgggacagcggaaattggtaaacttacatcagtaatgggtgttgtgacacggacgagtgaggtgcggcctgaactattgcaaggcaccttcaaatgccttgactgtgggaatgttgtgaagaatgtggagcagcagttcaagtacactgagccgataatatgtgtcaatgcgacatgccagaaccgatcaaaatgggcccttctccgccaggagagcaaattcacagattggcagagggtgagaatgcaggagacatcaaaagagatacctgctggttcgcttcctcgctccctggatgtcattttgcggcatgagattgttgagaaggctagggccggggacacggttgtatttaccggaactgttgtcgcagttccagatgtaatggcactaacttcacctggtgagagagcagagtgtcgccgggaagctcctcaacgaaaaagtggaggtgttcaagaaggtgtaaagggcttgaagtcccttggagttagggatctctcttatcgccttgcttttgtggcaaattcagtgcaggtggcagatggcaggagagaagtggacatcagggatcgggacacagatggtgatgacagtgaaagacagaaattcacagaagaagaggaagatgaggttgttaggatgaggaatactcctgacttcttcaataagatagttgatagcatatgtcctaccgtctttggtcatcaagaaattaagagggctgtccttcttatgcttttgggtggtgttcacaaggtaacgcatgaagggatcaaccttagaggtgacatcaatgtctgcattgttggcgacccaagctgtgcaaagtctcagttcctaaaatataccgctggtattgttccaagatctgtttacacgtcagggaagtcatcatctgctgctggtctgacagcaactgttgctaaagaaccagaaactggtgaattttgtattgaggcaggtgctctgatgttagctgataatggaatttgctgcatagatgaatttgataagatggacattaaggatcaggtcgctatacatgaagcaatggaacagcaaaccattagcataacaaaagcaggaatacaggccactttgaatgcacgaacttcaattttagctgcagcaaatccgacaggagggcgttatgacaagtctaaaccacttaagtacaatgtggcattgcccccagctattctttcaagatttgatctggtgtacatcatgattgatgaacctgatgaaaacactgactaccacattgctcatcacattgtaagagtccatcagaaacgtgaagaagcactggcccctgcatttagcactgcagaactgaagcgttatattgcgttcgcgaagtctttgaaacctcagctgagttcagaagcaaagaaggttttggtggagtcgtatgttacccttcgcagaggtgacagtactcctggaaccagggttgcttacagaatgacagttaggcaattggaagcattgattaggctgtcagaagctattgctcgaagccacttagaaagaactgttctcccagctcatgtccgactggcagttaaattgctcaagacatctatcatcagtgttgaatcaagtgaagttgatctctctgacttccaagatgctgaagacggaacaaatgtaccttctgataatgatgctggacagccagctgaagcagatgctgctcctcaacaacagggtgcagaaaatgaccaagcagcagataacggtaagaagaaattggtaataactgaagaacacttccagagagttactcaagccttggttatgagactacggcagcacgaagagtccatcatgaaagatggagatggtctggctggcatgaagcaaggggatcttatcatttggtacgttgagcagcagaatgccaaaggcgcgtacagttctactgcagaggtaaaggaagaagtgaagtgcatcaaggccattatagagaggcttatacagcgggaaggccaccttatagtcatagatgacggcgcagcagccgcggccgaagacggtgctggtgcgcgaagaacatcggagagcagaatattggcagttaacccgaactacgttattgattagcaacagcctggaaccatgccgctaacccgggtcagttgatgtggttaaccaatagtaatgagctccctgtgccatgctctggcattgttgtaccatctccatctctgacgtgctctctcagtggtgcgcatgatctccaaaaactgtataattagcttccgaagctgtataattagtttcttgcttctaggtttagtgaggtgtgatgattatcatctgtagtgtacctgtgtaattttgaccgtgtggcctttcgtggaaacaattagaagcagcttaattcctattgaatacagatatttggttttacattacatgtctgctctttctggatcaagttaaattggaaccaaacattgcttatgagcaatatggtttttc

SEQ ID NO: 3622 - DNA, 3114 bp, Setaria italica
ttggcgccaagccgccgcctccttcccgccaagaccaccccaacccgcctggcctcctggccgcctgccccttcttcttccccaaccccaaaaccctcaccagcgcgcccacacgccgagacgaaatccccgaccggaagtcctagtccagatctagactcttagcgaaggcaccgccgtcggcgatggaggcgttcggcggattcttcgtggacgagaaggcgacgcgggtggagaacatcttcctcgagttcctcaagcggttcaaggagtcggatggcgcgccggagccgttctacgagacggagatggaggcgatgcggtcgcgggaatccaccaccatgtacgttgacttcgcgcatgtcatgcacttcaacgacatcctccagaaggccatcgccgaggagtacctcaggtttgaaccatacttgaggaatgcatgcaagaggtttgtgttggagcaccgggctggcgagaaccgagctccaatcatctcagatgatagtcccaacaaggatattaacgttgccttctacaacatcccaatgctaaaaaagctgagagagcttgggacagcggaaattggtaaacttacatcagtaatgggtgttgtgacacggacgagtgaggtgcggcctgaactattgcaaggcaccttcaaatgccttgactgtgggaatgttgtgaagaatgtggagcagcagttcaagtacactgagccgataatatgtgtcaatgcgacatgccagaaccgatcaaaatgggcccttctccgccaggagagcaaattcacagattggcagagggtgagaatgcaggagacatcaaaagagatacctgctggttcgcttcctcgctccctggatgtcattttgcggcatgagattgttgagaaggctagggccggggacacggttgtatttaccggaactgttgtcgcagttccagatgtaatggcactaacttcacctggtgagagagcagagtgtcgccgggaagctcctcaacgaaaaagtggaggtgttcaagaaggtgtaaagggcttgaagtcccttggagttagggatctctcttatcgccttgcttttgtggcaaattcagtgcaggtggcagatggcaggagagaagtggacatcagggatcgggacacagatggtgatgacagtgaaagacagaaattcacagaagaagaggaagatgaggttgttaggatgaggaatactcctgacttcttcaataagatagttgatagcatatgtcctaccgtctttggtcatcaagaaattaagagggctgtccttcttatgcttttgggtggtgttcacaaggtaacgcatgaagggatcaaccttagaggtgacatcaatgtctgcattgttggcgacccaagctgtgcaaagtctcagttcctaaaatataccgctggtattgttccaagatctgtttacacgtcagggaagtcatcatctgctgctggtctgacagcaactgttgctaaagaaccagaaactggtgaattttgtattgaggcaggtgctctgatgttagctgataatggaatttgctgcatagatgaatttgataagatggacattaaggatcaggtcgctatacatgaagcaatggaacagcaaaccattagcataacaaaagcaggaatacaggccactttgaatgcacgaacttcaattttagctgcagcaaatccgacaggagggcgttatgacaagtctaaaccacttaagtacaatgtggcattgcccccagctattctttcaagatttgatctggtgtacatcatgattgatgaacctgatgaaaacactgactaccacattgctcatcacattgtaagagtccatcagaaacgtgaagaagcactggcccctgcatttagcactgcagaactgaagcgttatattgcgttcgcgaagtctttgaaacctcagctgagttcagaagcaaagaaggttttggtggagtcgtatgttacccttcgcagaggtgacagtactcctggaaccagggttgcttacagaatgacagttaggcaattggaagcattgattaggctgtcagaagctattgctcgaagccacttagaaagaactgttctcccagctcatgtccgactggcagttaaattgctcaagacatctatcatcagtgttgaatcaagtgaagttgatctctctgacttccaagatgctgaagacggaacaaatgtaccttctgataatgatgctggacagccagctgaagcagatgctgctcctcaacaacagggtgcagaaaatgaccaagcagcagataacggtaagaagaaattggtaataactgaagaacacttccagagagttactcaagccttggttatgagactacggcagcacgaagagtccatcatgaaagatggagatggtctggctggcatgaagcaaggggatcttatcatttggtacgttgagcagcagaatgccaaaggcgcgtacagttctactgcagaggtaaaggaagaagtgaagtgcatcaaggccattatagagaggcttatacagcgggaaggccaccttatagtcatagatgacggcgcagcagccgcggccgaagacggtgctggtgcgcgaagaacatcggagagcagaatattggcagttaacccgaactacgttattgattagcaacagcctggaaccatgccgctaacccgggtcagttgatgtggttaaccaatagtaatgagctccctgtgccatgctctggcattgttgtaccatctccatctctgacgtgctctctcagtggtgcgcatgatctccaaaaactgtataattagcttccgaagctgtataattagtttcttgcttctaggtttagtgaggtgtgatgattatcatctgtagtgtacctgtgtaattttgaccgtgtggcctttcgtggaaacaattagaagcagcttaattcctattgaatacagatatttggttttacattacatgtctgctctttctggatcaagttaaattggaaccaaacattgcttatgagcaatatggtttttctacatcatatacgagctgttggtgaacggtgtcacaaatatatcctattttg

SEQ ID NO: 3623 - DNA, 3209 bp, Panicum virgatum
cccctagcccaccaccacaccagcgggttcggcccaggaacatcgcttctctccatgcttgtcagcagagactgcagcaaccgtcttcggtccacggacccggtgcacgcggcccacccgctgcgagctcccttttggcgcgagatttggcgccaagccgccgcctccttcccgccaagaccacccccacccgcgcctggcggcgtaccccttcttcttccccagacccaaaaccctcaccagcgcgcccacacgccgagacgcgagagccaatcgcccgaccggaagtcccagtccagatccggaagcttacggaaggcgccgccgtcggcgatggaggcgttcggcgggttcttcgtggacgaaaaggcggcgcgggtggagaacatcttcctcgagttcctcaagcggtttaaggagccggagggcgcgccggagccgttctacgagatggagatggaggcgatgcggtcgcgggagtccaccaccatgtacgtcgatttcgcgcacgtcctgcgcttcaacgacattctccagaaggccatcgccgaggagtatctcaggtttgaaccatacttaaggaatgcgtgcaagaggtttgtgttggagcaccgggccagtgagaatcgggcgccaatcatctctgatgatagtccgaacaaggatataaatattgccttctacaacatcccaatgctgaaaaggttgagagagcttgggacagcggaaattggtaaacttacatcagtcatgggtgttgtgacacggacgagtgaggtgcggcctgaactattgcaaggcaccttcaagtgcctcgactgtggaaatgttgtgaagaatgtggagcagcagttcaagtacactgagccgataatatgcgtcaatgcgacatgccagaaccgatcaaaatgggcacttctacgccaggagagcaaatttacagattggcagagggtgagaatgcaggagacatcaaaagagatacctgctggttcgcttcctcgctccctggatgtcatcttgcgacatgagattgttgagaaggctagagctggggacacggttatatttactggaactgttgttgcggttccagatgtattggcactaacttcacctggtgaaagagcagagtgtcgccgggaagctcctcagcgaaaaaatggaggtgttcaagaaggtgtaaagggcttgaagtcacttggagtcagggatctctcttatcgccttgcttttgtggcaaattcagtgcaggtggcggatggcaggagagaagtggacatcagagaccgggacacagatggcgatgacagtgaaagacagaagttcactgaagaagaggaagatgaggttgttaggatgaggaacactcctgacttctttaataagatagttgatagcatatgtcctactgtctttggtcatcaagaaattaagagggcggtcctccttatgcttttgggtggtgttcacaagataacacatgaagggatcaaccttagaggtgacatcaatgtctgtattgttggtgacccaagctgtgcaaagtctcagttcctgaaatataccgctggtattgttccaagatctgtttacacatcagggaagtcatcttctgctgctggtctgacagcaactgttgctaaagaaccagagactggtgaattttgtatcgaggcaggtgctctgatgttagctgataatggcatttgctgcatagatgaatttgataagatggacattaaggatcaggttgctattcatgaagcaatggaacagcaaaccattagcataacaaaagcaggaatacaggccaccttgaatgcacgaacttcaattttagctgcagcaaatccgacaggagggcgttatgacaagtctaaaccacttaagtacaatgtggcattgcccccagctattctttcaagatttgatctggtgtacatcatgattgatgaacctgatgaaaccacagactaccacattgctcatcacattgtaagagtccatcagaaacgtgaagaagcactggcccctgcatttagcactgcggaactgaagcgatatattgcatttgcgaagtctttgaaacctcagctgagttcagaagcaaagaaggttttggtggactcatatgttacccttcgtagaggtgacagtactcctggaaccagggttgcttacaggatgacagtaaggcaattagaagcattgattaggctatcagaagctattgctcgaagccacttagaaagaactgttctcccagctcatgtccgactggcagttaaattgcttaagacatccatcatcagcgttgagtcaagtgaagttgatctctctgagtttgaagatgctgaagatggaacaaatgtaccttctgataatgatgctggacagccagctgaagcagatgctgctcctcaacaagagggtgcagaaaatgaccaagcagcagataacggtaagaagaaattggtaataactgaagaatacttccagagaattactcaagcgttggttatgagactacggcagcatgaagagtccatcatgaaagatggagatggtcttgctggcatgaagcaaggggatcttatcatttggtatgttgagcagcagaatgccaaaggtgcgtacagttctactgcagaggtgaaggaagaagtgaagtgcatcaaggccattatagagaggcttatacagcgggaaggccacctcatagtcatagacgaaggcacagcagccgcggccgaggacggcgctggcgcccgaagaacatcggagagcagaatattggcagttaacccgaactacgttattgattagcagcagcctgaaaccatgccgctaactcgggtgagttgatgtggttaaccaatagttgtgagctccctgtgccatgatgctctggcactgttgtacccatagtcacaggattcggggtcgatgcctcgtccctcgacccgggaacgtcgttccgattcgagggtcggggtcgaagagggtcagtgtcccattcaaggttggatcgtgtcctggtttgaaaggggtcgcaaccccattgctagcagatttaattgggataaggaggttaaggacagtggattggtgtggattttgttagacaatgagctgagtacatgtagcatggtctaaatgtactcttttatatgtttcttatatgcttgtgcagattagtttcttca

SEQ ID NO: 3624 - DNA, 2945 bp, Panicum virgatum
tcaacatattttgattgggattttggaggaagaggtactaaattgttgtcagctttcagtaacattctgtgtatctaatattgaattgttttagtttctgagtatcatccattacaccaatttgttaaaattgtgctaaagtctagtacacactaatctgtgctgtctgtagcctgtcaaaactttgctctaatggcctcatctattgtatcaggtttgaaccatacttaaggaatgcgtgcaagaggtttgtgttggagcaccgggccagtgagaatcgggcgccaatcatctcagatgatagtcccaacaaggatattaatattgccttctacaacatcccaatgttgaaaaggctgagagagcttgggacagctgaaattggtaagcttacatcagtaatgggtgttgtgacacggacgagtgaggtgcggcctgaactattgcaaggaaccttcaagtgcctcgactgtgggaatattgtgaagaatgtggagcaacagttcaagtacactgagccgataatatgcgtcaatgcaacatgccagaaccgatccaaatgggcccttctccgccaggagagcaaattcacagattggcagagggtgagaatgcaggagacttcaaaagagatacctgctggttcacttcctcgctccctggatgtcatcttgcggcatgagattgttgagaaggctagagctggggacacggttatatttactggaactgttgttgcggttccagatgtaatggcactaacttcacctggtgaaagagcagaatgtcgccgggaagctcctcagcgaaaaaaatggaggtgttcaggaaggtgtaaagggcctgaagtcccttggagttagggatctctcttatcgccttgcttttgtggcaaattcagtgcaggtggcagatggcaggagagaagtggacatcagggaccgggacacagatggtgatgacagtgaaagaccgaaattcacagaagaagaggaagatgaggttgttaggatgaggaacactcctgacttctttaataagatagttgatagcatatgtcctactgtctttggtcatcaagaaattaagagggcagtcctccttatgcttttgggtggtgttcacaagataacacatgaagggatcaaccttagaggtgacatcaatgtctgtattgttggtgacccaagctgtgcgaagtctcagttcctgaaatataccgctggtattgttccaagatctgtttacacatcagggaagtcatcatctgctgctggtctgacagcaactgttgctaaagaaccagaaactggtgaattttgtattgaggcaggtgccctgatgttagctgataatggcatttgctgcatagatgaatttgataagatggacattaaggatcaggttgctatacatgaagcaatggaacagcaaaccattagcataacaaaggcaggaatacaggccaccttgaatgcacgaacttcaattttagctgcagcaaatccgacaggagggcgttatgacaagtcgaaaccacttaagtacaatgtggcgttgcccccagctattctttcgagatttgatctggtgtacatcatgattgatgaacctgatgaaaacacagactaccacattgctcatcacattgtaagagtccatcagaaacgtgaagaagcactgacccctgcatttagcactgcagaactgaagcgatatattgcgtttgcgaagtctttgaaacctcagctgagttcagaagcaaagaaggttttggtggagtcatatgttacccttcgtagaggtgacagtactcctggaaccagggttgcttacaggatgacagtaaggcaattggaagcattgattaggctatcagaagctattgctcgaagccacttagaaagaactgttctcccagctcatgtccgactggcagttaaattgcttaagacgtccatcatcagcgttgaatcaagtgaagttgatctctctgagttccaagatgctgaagacggaacaaatgtaccttctgataatgaggctggacagccagctaaagcagatgctactcctcaacaagagggcgcagaaaatgaccaagcagcagataatggtaagaagaaattggtaataactgaagaatacttccagagagttactcaagcgttggttatgagactacggcagcatgaagagtccgtcatgaaagatggagatggtcttgctggcatgaagcaaggggatcttatcatttggtatgttgagcagcagaatgccaaaggcgcgtacagttctactgcagaggtgaaggaagaagtgaaatgcatcaaagccattatagagaggcttatacagcgggaaggccaccttatagtcatagacgaaggcacagcggctgccgccgaggacggtgctggcgcgcgaagaacatccgagagcagaatattggcagttaacccgaattacgttattgattagcagcagcctgaaaccatgccgctaacacgggtcacttgatgtggttaaccaatagtaatgagctccccgtgccatgatgctctggcactgttgtaccatctctgactggctctttgcaacggagcgcatgttctccgaaactgcataattagtttcttgtttctaggtttgtttagtgaggtgtgataactagtgtacctctgtaatttttgacccggtggccattgtggagacaaagagaagcagcttgtaaatcattggttatactgaaaccactaatttggttttccatgtacgccctttctggattaagttaaattggaaccgagtgctgctctgcttatgagcattgatttcttctcaacatatgccacagctgtgctgattagccaacaacagtgtcaaaggaatccgtctattttgcaagtatttttgcatgtgttttatgttttgagtaggcatat

SEQ ID NO: 3625 - DNA, 2310 bp, Triticum aestivum
ccattttcctagaaatcgcaaaccccaccacaccgataacctaagcttcaaattcagaatataccacctcaaactacgcagaaattcttcacgcgcccaacactcaccactgccggcgatgagcaccaccgagggaaagccggacgccgatgcggtggaggagatggcgcgggaggcggcggcgtggtgcgcgatgcacgggctcgtcgtcggggaccgcgcggacccgagatcaggaacagttcctggggttgggttggtccacgctccaatctccttgctcccgtcgcgtctcccggagtccttctggagccaggcgtgcgagctggccccgcttttcaacgagctcgtggatcgtgttagcttggatggggatttcttgcaggattccttgtccaaaacaaggcaggttgatgatttcacttccaggctcttagatattcacaggaagatgatggatgcaaacaagaaggagaatattcgactggggctgcaccgatcagattatatgctggattcagaaaccaattctcttctccaaatagagctcaacactatttcagtatcttttcctgggctttgttctatagtgactgagcttcacaggaccttgatcaatcagtatggaaatttattatgtctagatgccaaaagggttcctggaaatgatgcaagccgtcaatttgctaaagcattggccaaagcatgggatgagtttaatgttgacagtgctgtagttatgatgattgttcagcccgaagaaagaaatatgtatgaccaatactggcttgtcaaatatttgagggaatcacatggcgtaacaactattaggaaaaccttgtcagaggtggaggctgaaggccgggttctccctgatggaactcttgttgtaaatgacaggaaggtcactgtggtgtattttagagctggctatacaccaaacgattatccttcagaagcagaatggagtgcaaggcttttgatggaacaatcatctgctgtgaagtgtccttcaatatcatatcatttagtggggaccaagaagattcaacaagaactagcaaaacctaatgtgcttgaaaggtttcttgaaaataaggaggaaattgccaagctccgccaatgctttgcagggctatggagcttggatgatgaagaggttgtcaaatctgcgattgaaaaccctgacttgtttgtcttgaagcctcaacgtgaaggcggaggtaacaacatatacggtcttgatgtgcgagaagctctgatcagactcaagaaggaaggaggagatgctctctcagcctacatactgatgcaaagaatctttcccaaagcatctctcgctagtctggtccgtggtggtgtttgccatgaggccctcacagtatctgagcttgggatatatggagcctacctgcggaacaaagataaggtgatcatcaatgataagtgtggttacttgatgcgaacaaaagtttcttcttcggatgaaggcggtgttgctgcaggatttgctgttttggacagcttatacctgaccgacaagtgacataacctcaggaataccagctacaaatccgaaccagcattgacctaccatggatttagcattctgttgcatcggtcgcaacaaatgagatgaacaaagttgctgcacaatttgcagacgtcagccattagcatacagcacactgggtgaagaataaatgtcatgtatagatgacatgtttatgtatggaaaaataatccccgtgaaaaaacagattacaaattcttgtttcgtggatcactacacccttgactcggggccaggcagttgtgttatgcactgttaaggtgaattttcagcgttgccatttctgttggtcaatcatatacgaagaagttaaaaattctgtgagatgcaacttttttgagtgtaaaaaagaccatatgggcatgatcgtcatggaaaatcctccgctctgctgtcctgctctttccagatggatcatatgctttggatgctatcatgcaccagccaagatgttgtcgaaatcaagcagtcgagcagatcaataggccaaataaagaaggcatgtattttaaattttctgttatttccgtctgtcatgcatctctcttggcctcgctagctagcatttcctttgttttcctgatctgtggctcagtgccagtggagtcacatctattgttccatgccataactaatggcgtaaagttgcatactgtcagcaccacgatctctagggtagatcagtgccacgaaatatctatctgtcagaattcaagaaggaaattggttatcataga

SEQ ID NO: 3626 - DNA, 1960 bp, Secale cereale
ttttcctagaaatcgcaaaccccaccacaccgataacctaagcttcaaattcagaatataccacctcaaactacgcagaaattctgcacgcgcccaacacccaccactgccggcgatgagcaccaccgagggaaagccggacgccgctgtggtggaggagatggcgcgggaggcggcggcatggtgcgcgatgcacgggctcgtcgtcggggaccgcgcggacccgagatcaggaacggttcctggggttgggctggtccatgctccaatatccctgctcccgtcgcgtctcccgaagtccttctggagccaggcgtgcgagctggctccgcttttcaacgagctcgtggatcgtgttagcttggatggggatttcttgcaggattccttgtccaaaacaaggcaggttgatgatttcacttcaaggctcttagatattcacaggaagatgatggatacaaacaaggaagagaatattcgactggggctgcaccgatcagattatatgctggactcagaaaccaattctcttctccaaatagagctcaacactatttcggtatcttttcctgggctttgttctatagtgaccgagcttcacaggaccttgatcaatctgtatggaaatttattatgtctagatgccaaaagggttcctggaaatgaggcaagccgtcaatttgctaaagcattggccaaagcatgggatgagtttaatgttgacagtgctgtagttatgatgattgttcagcccgaagaaagaaatatgtatgaccaatactggcttgtcaaatatttgagggaatcacatggcgtaacaactattaggaaaaccttgtcagaggtggaggctgaaggccaggttctccctgatggaactcttgtggtaaatgacaggaaggtcgctgtggtgtattttagagctggctatacaccaaacgattatccttcagaagcagaatggagtgcaaggcttttgatggaacagtcatctgctgtgaagtgtccttcaatatcatatcatttagtggggaccaagaagattcaacaagaactagcaaaacctaacgtgcttgaaaggtttcttgaaaataaggaggaaattgccaagctccgtcaatgctttgcagggctatggagcttggatgatgaagaggttgtcaaatctgcgattgaaaaccctgacttgtttgtcttgaagcctcaacgtgaaggcggagggaacaacatatacggtcttgatgtgcgagaggctctgatcagactcaagaaggaaggaggagatgctctctcagcctacatactgatgcaaagaatctttcccaaggcatctcctgctaatctggtccgtggtggtgtttgccatgaggccctcacagtatctgagcttgggatatatggagcctatctgcggaacaaagataaggtgatcatcaatgacaagtgtggttacttgatgcgaacaaaagtttcttcttcggatgagggcggtgttgctgcgggatttgctgttttggacagcttatacctgactgacaagtgacataaccacaggaataccagctacaaatcagaaccagcattgacctaccgtggatttagctttctgttgcagcggacgcaacaaatgagatgaacaaagttgctgcacaatttgcagacgtcagccattagcatacagcacaccgggtgaagaataaatatgtcatgtatagatgacatgtgtatgtatggaaaaataatccctgtgaaaaaacggattacaaattcttgtttcgtggatcactgcacccttgactcggggccaggcagttgtgttatgcactgttaatgtgaattttcagcgtcgccatttctgttggtcaatcatatacgaagaagttagaaattctgtgagatgcaacttttttgagtgtaaaaaagaccatatgggcatggaaaattctccgctctgcaagtc

SEQ ID NO: 3627 - DNA, 2238 bp, Hordeum vulgare
tgcgttacctacctcctcctccttcgccgccgcccacaattccctccacattgaccagtgccgcccgccgcgtcccccatccggcaccggcgccacctgatccccttccagccctcccttgcctcccctcgatcctctcttctttgtccagcgccaccgcatccgcgccatgccagcctctttggtcgcggccccatcgcctggtatccatcgttgcagtccctggtcgtcagccccgtttgctgccgccccaactcgtctacatcgccagacagtacgctggaaattctgcacccgcccgaacgcccagcgcccaccactgccggcgatgagcaccgccgagggaaagccggacgccgctgcggtggaggaaatggcgcgggacgcggcggcgtggtgcgcgatgcacgggctcgtcgtcggggaccgcgcggacccgagatcaggaacagttcctggggttgggctggtccacgctccaatctccctgctcccgtcgcgtctcccggagtccttctggaggcaggcgtgcgagctggctccgcttttcaacgagctcgtggatcgtgttagcttggatggggatttcttgcaggattccttgtccaaaacaaggcaggttgatgatttcacttctaggctcttagatattcacaggaagatgatggatgcaaacaaggaggagaatattcgactggggttgcaccgatcagattatatgctggactcagaaaccaattctcttctccaaatagagctcaacactatttccgtatcttttcctgggctttgttctccagtggctgagcttcataggaccttgattaatcagtatggaaaattattatgtctagatgccaaaagggttcctggaaatgaggcgagccgtcaattcgctaaagcattggccaaagcatgggatgagtttaatgttgacagtgctgtagttatgatgattgttcagcccgaagaaagaaatatgtatgaccagtactggcttgtcaaatatttgagggaatcacatggcgtaacaactattaggaaaaccttgtcggaggtggaggctgaaggccaggttctccctgatggaactcttgtggtaaatgacaggaaggtcgctgtggtatattttagagctggctatacaccaaacgattatccttcagaagcagaatggagtgcaaggcttttgatggaacaatcatctgctgtgaagtgtccttcaatatcatatcatttagtggggaccaagaagattcaacaagaactagcaaaacctaacgtgcttgaaaggtttcttgaaaataaggaggaaatttccaagctccgtcaatgctttgcaggactatggagcttggatgatgaagaggttgtcaaatctgcgattgaaaaccctgacttgtttgtcttgaagcctcaacgtgaaggcggagggaacaacatatacggccttgatgtgcgagaggctctgatcagactcaagaaggaaggaggagatgctctctcagcctacatattgatgcaaagaatctttcccaaagcatcactcgctaatctggtccgtggtggtgtttgccatgaggccctcacagtatccgagcttgggatatatggagcctacctgcggaacaaagataaagtgatcatcaatgacaagtgtggttacttgatgcgaacaaaagtttcttcgtcagatgaaggcggtgttgctgcgggatttgctgttttggacagcttatacctgaccgacaagtgacgtaacctccggagtaccagctacatattcaaaccagcattgacctaccatgaatttagcactctgttgcatcggtcgcagcaaatgggatgagcaaagttgcttcacaatttgcaggcgtcagccattagcatacatcacactgggtgaagaataattatgttatgtatagatggcatgtgtatgtactgaaaaataatccccatgagaagaaggattgcgatttcatggatcaccacacccttaactcggcaccaggcagttgtgctatgcactgttaatgtgaattttcagcgtcaccatttctgttagtaaatcatatacaaagaagttcgatattctgcgagatgcaaccttttccaatgtaaaagaccatatgggcatgatcatcttggaaaattctccgccctttccagatgtatcatatgctttggatgctgtcatgcaccagtccaggttgttgtcgaaatcaagcagtcgag

SEQ ID NO: 3628 - DNA, 1858 bp, Brassica rapa
aaaggcatttcctcacatccttatatctctctcttcctcttctctctctatcttcctcctctgcttcccgcggagctttcagtctcaagtatgtcagtatctacacattgtttcacttcaccttgtcacgaccgtacgagattcttctcaggcgatgatggtaataaacttctaagaaagagaatcaaaggcactttcttggtcaagatcttaccttcttcccaaaacgcttatctaagagtaactgcgaaatcctcacgacccttatctggattcaggtcaggaatctctaagggagtatttgatattgtggcattgacctcaaagaatgcactcaaagagctgagtactccactgatgctaaagctcgtgggtgttgtagcttgcgcgtttctcatagttccatctgcagatgctgttgatgcgctaaagacttgtgcatgcttacttaaggggtgcaggatagaactcgcaaagtgcattgccaacccttcctgtgcagccaatgtcgcttgcctccagacctgtaacaaccgtccagatgaaaccgagtgccagataaaatgcggagatctgttcgagaacagtgtagtcgacgagttcaacgaatgcgccgtgtcaagaaaaaaatgcgttcctagaaaatctgacctcggagagtttccagcccctgacccttctgttctcgtcaagaacttcaacgtcaaggactttgacggcaagtggtacattacaagtggcttgaatccaacctttgacgcctttgactgtcagctccatgagttccacacggaagacggcaagcttgttggaaacatctcgtggagaataaaaaccccagacagtggcttcttcactagatcaaccgtacagaagttcgtgcaagatcctaaccagcctgctgttttctacaatcatgacaacgagtaccttcactatcaagacgactggtatatactgtcatcaaagatagagaacaaacctgaggactatatctttgtgtactaccgtgggcgtaacgatgcttgggatggatatggcggtgcggttgtgtacacaagaagcgcttctttacccaacaccattgtaccggagcttgaaaaggcagctaaaagcataggcagagagttcagcacgttcataaaaacggataacacttgcggtcctgagcctccgctggtggagagacttgagaagacggtggaggaaggggagaagattatagtcaaagaggttgaggagatagaagaggaagtagagaaagaagtggagaaagtcggcaagactgagatgactttgttccagagattagctgaagggtttgaagaactaaagcaagacgaggagaatttcttgagagggttgagtaaagaggagatggagttgttggatgagcttaaaatggaagctaatgaggttgagaaattattcggaaaagctctaccaatcagaaagttcaggtagagaaactatattattattattatacatacactgttgtaaaaaacattcaatcatttcataaaattggattacacataaagacacaaggattaagacatccttttagcactctaagaagaggtgaaactggtaataatagggatgataacaacaaggatgatcaaaagcaacacaatgataccaatacacatccatttcctactgcttctctgatgcttctttgccgtattcaactccttagcaccatctttaacataatggctcgcgttcatcacgtgatgctcgatctcatccatctgctcgccttgcgcctcgaccatcacagccatatctagaaacacttggtgtagctctaacaaactcttctctatctccttcgccgcatcataccttc

SEQ ID NO: 3629 - DNA, 2458 bp, Brassica napus
gcttcccgcggagctttcagtctcaagtatgtcagtatctacacattgtttcacttcaccttgtcacgaccgtacgagattcttctcaggcgatgatggtaataaacttctaagaaagagaatcaaaggcactttcttggtcaagatcttaccttcttcccaaaacgcttatctaagaataactgcgaaatcctcacgacccttatctggattcaggtcaggaatctctaagggagtatttgatattgtggcattgacatcaaagaatgcactcaaagagctgagtactccactgctggtaaagctcgtgggtgttgtagcctgcgcgtttctcatagttccatctgcagatgctgttgatgcgctaaagacttgtgcatgcttacttaagggatgcaggatagaacttgcaaagtgcattgccaacccttcctgtgcagccaatgtcgcttgcctccagacatgtaacaaccgtccagacgaaaccgagtgccagattaaatgtggtgatctattcgagaacagtgtagtcgacgagttcaacgaatgcgctgtctcaagaaaaaaatgcgttcctagaaaatctgatctcggagagtttccagcccctgacccttctgttctcgtcaagaacttcaacatcaatgactttgacggcaagtggtacattacaagtggcttgaatccaacctttgacgcctttgactgtcagctccatgagttccacacggaagacggtaagcttgttggaaacatctcatggagaataaaaaccccagacagtggtttcttcactagatcaaccgtacagaagttcgtgcaagatcctaaccagcctgctgttttctacaatcatgacaacgagtaccttcactaccaagatgactggtatatactgtcatcaaagatagagaacaaacaagacgactatatctttgtctactaccgtgggagaaacgatgcttgggatggatacggcggtgcggttgtgtacacgagaagcgcttctttacccaacaccattgtaccggatcttgaaaaggcagctaaaagcataggaagagagttcagcacattcataaaaacggataacacttgcggtcctgagcctccgctggtggagagacttgagaagacggtggaggaaggggagaagattatagtcaaagaggttgaggagatagaagaggaagtagagaaggaagtggagaaagtcggtaagactgagatgaccttgttccagagattagctgaagggtttgaagaattaaagcaagacgaggagaatttcttgaaagggttaagcaaagaggagatggagttgctggatgagctcaaaatggaagctaatgaggttgagaaattatttggaaaagctctaccaatcagaaagttcaggtagagaaactatattattattatacatatacactgttgtaaaaacatttaatcatttcataaaattggatacacaaaacacacaaggattaagacatcctttttagcactcaagatgaggtgaaactggtaatgatggggatgataacaacaagaatgatcaagagcagcacaatgataccaatgcacatccatttcctactgcttctctgatgcttctttgcggtattcaactccttagcaccatctttaacgtaatggctcgcgttcatcacgtgatgctcgatctcatccatctgctcgccttgcgcttcgaccatcacagccatatctagaaacacttggtgtagctctaacaaactcttctctatctccttcgccgcatcatacctgtcttgaatctcaaccacagtctccaagacctttcctctcccgtgctcctgaaccgcacgtgcgagaaactcttcacctccgtcgctaacaatcttctcgatcatctcttcgtctggtctctcgccagtaaccgtaaagtaccgtctctcaacggtctccttgtactcgctcatcatcctctgcctcagcccctgaaactccatcatcacttctttcagcttcttcctcaaaccgttagtaaccgccactctgcttctgaaaaccggagttcccgataaccgtttgatctctcggttcgctcgatccatctcctccagcgtggccttgatcgatttcgcttttcgtaaaccggagacgatctcgttggagatcttgttgcggagagacttcacggagtccgccttgtgcgcggatttgctctcgtcgttgtactgcgagatgcgagagagcgtttcggtgatcagagagatctctgatctcactttctcggcttcttctaggaacgaggagagatttgagtctgtgttgttgttgttcgccatctcgaggtcggagtctggtggtccggattctagatccttcatcgctgatttttttaggtcgacgtagcttgtgaacgatttggtcattaggtcgttcatcttttcgcctgaaaactcaaatcgaa

SEQ ID NO: 3630 - DNA, 1526 bp, Brassica oleracea
tgtccacaaagggaagacgctccatgtcttatccaaaggcatttcctcacatccttatatctctcttcctcttctctctctatcttcctcctctgcttcccgcggagctttcagtctcaagtatgtcagtatctacacattgtttcacttcaccttgtcacgaccgtacgagattcttctcaggcgatgatggtaataaacttctaagaaagagaatcaaaggcactttcttggtcaagatcttaccttcttcccaaaacgcttatctaagagtaactgcgaaatcctcacgacccttatctggattcaggtcaggaatctctaagggagtatttgatattgtggcattgacctcaaagaatgcactcaaagagctgagtactccactgctggtaaagctcgtgggtgttgtagcctgcgcgtttctcatagttccatctgcagatgctgttgatgcgctaaagacttgtgcatgcttacttaagggatgcaggatagaactcgcaaagtgcattgccaacccttcctgtgcagccaatgtcgcttgcctccagacctgtaacaaccgtccagatgaaaccgagtgccagataaaatgcggagatctgttcgagaacagtgtagtcgacgagttcaacgaatgcgctgtctcaagaaaaaaatgcgttcctagaaaatctgatctcggagagtttccagcccctgacccttctgttctcgtcaagagcttcaacgtcaatgactttgacggcaagtggtacattacaagtggcttgaatccaacctttgacgcctttgactgtcagctccatgagttccacacggaagacggtaagcttgttggaaacatctcatggagaataaaaaccccagacagtggtttcttcactagatcaaccgtacagaagttcgtgcaagatcctaaccagcctgctgttttctacaatcatgacaacgagtaccttcactaccaagatgactggtatatactgtcatcaaagatagagaacaaacaagacgactatatctttgtctactaccgtgggagaaacgatgcttgggatggatacggcggtgcggttgtgtacacgagaagcgcttctttacccaacaccattgtaccggatcttgaaaaggcagctaaaagcataggaagagagttcagcacattcataaaaacggataacacttgcggtcctgaacctcctctggtggagagacttgagaagacggtggaagaaggggagaagattatagtcaaagaggttgaggagatcgaagaggaagtagagaaggaagtggagaaagtcggtaagactgagatgaccttgttccagagattagctgaagggtttgaagaattaaagcaagacgaggagaatttcttgaaagggttaagtaaagaggagatggagttgctggatgagctcaaaatggaagctaatgaggttgagaaattatttggaaaagctctaccaatcagaaagttcagcacttaagaagaggtgaaactggtaatgatgggg

SEQ ID NO: 3631 - DNA, 2587 bp, Raphanus sativus
aggcatttcctcacatccttatatctctcttcttctctctctctatcttcttcctctgcttcccgcggagctttcagtctcaactctcaagtatgtcagtatctacacattgtttcacttcaccctgtcacaaccgtgcgagattcctctcaagcgacgatggtaataataaacttctaagaaagagaatcaaaggcactttcttggtcaagatcttaccttcttcttcccaaaactctagtctaagagtaactgcgaaatccccaccacccttatctggattcaggtcaagaatctctaagggagtatttgatattgtggcgttgacatcgagaaatgcactcaaagagctcaacactcaactggtgctaaagctcgtaggcgttgttgcctgcgcgtttctcatagttccatctgctgatgcagtcgatgctctcaagacttgtgcatgcttactaaaggggtgcaggatagaactggcgaagtgcattgccaacccttcctgtgcagctaatgtcgcttgtctccagacctgtaacaaccgtcctgatgaaaccgagtgccagattaaatgtggtgacctgttcgagaacagcgtagtctacgagttcaacgaatgcgccgtgtccaggaaaaaatgcgttccgagaaaatcagacctgggagagtttccagcccctgacccttctgtcctcgtcaagagtttcaacgtcaaggacttcgacggcaagtggtacattacgagtggcttgaatcccacctttgacgccttcgactgccagctccatgagttccacacagaagatggcaaactcgtcggaaacatctcatggaggataaagacaccagacagtggtttcttcactaggtcaaccgtgcagaagttcgtccaagatcctaaccagcctgctgttttctacaatcatgacaacgagtacctccactatcaagacgactggtatatactgtcatcaaagatagagaacaaacctgaagactacatcttcgtgtactaccgtgggagtaacgatgcgtgggatggatacggaggtgcggttgtgtacacgagagctgcttctttacccaacagcattgtaccggagctcgagaaagcagctaaaaccataggcagagacttcagcacattcataaaaactgataacacctgcggtccggagcctcctctggtggagagactcgagaagacggtggaggaaggggagaagatcatcgtgaaagaggtggaagagatagaggaggaggtagagaaggaagtggagaaagtgggtaagactgagatgactctgttccagagattagccgaagggttcgaggagctaaagcaagacgaggagaatttcttgagagggttgagtagagaggagatggagcttttggatgagctcaaaatggaagctaacgaggttgagaagttattcggaaaagctttaccaatcagaaagttcaggtagattgttgttataagacaaaatacatctttgtaaaaacacattcattggattattacacaacaaaaacacaaggattaagacatcctttagtgggtaataagtaaacacaaatgtctctcatcaagaagaggtgaaactggtgatgatggggatgatgacgatgagaatgatgatgagcaggacaatgataccaatgcacatccatttcctactgcttctctgatgcttcttcgcggtattcaactccttagcaccatccttcacgtaatggctcgcgttcatcacgtgatgctctatctcatccatctgctcgccttgcgcctcgaccatcacagccatatctagaaacacttggtgtagctctaacaagctcttctctatctccttcgccgcatcatacctgtcttgaatctcaaccacagtctccaagaccttccctctcccgtgctcctgaaccgcacgtgcgagaaactcttcacctccgtcggttataatcttctcgatcatagcttcgtctggtctctcgcctgtaacggtgaagtaccgtctctcaactgtctctttgtactcgctcatcatcctctgcctcagagcctgaaactccatcatcgattctctcagcttcttcctcaaaccgttcgtaaccgccactctgctcctgtaaaccggagttccggataaccgtttaatctcccggttcgctctgtccatctcctcgagcgtggccttgatcgatttcgctttccttagaccggagacgatctcgttggagatcttgtcgcggagagacttcacggagtccgccttgtgcgcggatctgctctcgtcgttgtactgcgagatccgggagagcgtctcggtgatcagagacatctccgctttcactttctcggcttcttcgaggaaagaagagaggttctcgtccgtgttgttgttcgccatctcgagatcgggatctggtcctgattcgagatcatccttcatagctgattttttttaggtcgacgtagcttgtgaacgatttggtcattaggtcgttcatcttatcgcctctgaaactcaaaatcgaaaataacctgagagtttgtgtgaagagagagatgagtgttgggggt

SEQ ID NO: 3632 - DNA, 1235 bp, Vigna unguiculata
agaaaaacacacaactcacatagaaagaagatgcacgcgaaaacagactccgaggtaacaagcctcgccgcgtcttcccccacgcgctcccctcctcgccgccctctctactacgtccagagtccgtcccgggactcccacgacggcgagaagaccgccacgacgtcgtttcattccacccctgttctaagccccgttgcctcccctccccactcgcgccactcctcctccacgcgcttctccaagaaggatcacagccacagtctcaagccctggaagcaaatcgatgtcattgaagaggaaggccttctccaaggtgatgatcaccgcaatgggctccctcgtcgctgctactttctcgcctttgttgttgggttcctgcttctcttctccctcttctcgctcatcctctggggcgctagtagacccatgaagcccaagatctccgtcaagagcataaagtttgatgatctaagggtacaagccggttcagatgcaactggtgtgaccaccgatatgatcacgatgaattccactttgaaattcacataccgaaacacaggcacgtttttcggggtccatgtcacagccacacccgtggaactctactattccgacatcgtaattgcttcaggcgatatgaagaagttttatcaatctaggaagagccaaaggttggtgagtgtagcagtgatgggtaacaagatccctctgtatggaagtggtgcaagcctaagtagcacaacgggtatgcccacagtgcctgtgccattgaacctaaaatttgtgctacgatcgagggcttatgtgcttgggaaattggtgaagcctaagtattacaaaaccattcaatgttccatcactttggatcccaaaaagctcacttctccggtttctctcaaaaatcttgcacatatgattgatacatgtacatgtgatagagaaaaaaaatgaaagttagaacattactctattattaatgattcttttgatgtttgggagaaatgggggttatacagctaagataaggacgcgtttttgggagtatttggctgcctcaaattgcggaaagacaaagacataatgttttatgatgttgggttgggtggagaaatgtaacattgtggatttgtgattggtcacttcaagaagacttttttatttttatttttttgtgttgattatttgtctgattttaatctattaattgtaaaagtgacaggtaatttgaattc

SEQ ID NO: 3633 - DNA, 857 bp, Vigna unguiculata
gatattccaatacagtggtggttgatggagcaaacgatatggggtcatttgccggtgctgatgagggcaaattccaaagaatctatcgaatacgttcttcaagccctttggagaactcgaaaaactggtcttggcacttctgatcgatgcaccatccaagacatgcttcaactacacaatgaatctgatctcgacccacttctggtttgcctccgaatgttaatcaggaggtgtgtttatgagaatacttcaaaggaggatattccaaagctgtttcctgatgaagttctgcctgaattgcaaaaattgttgacacttctgttgcagaagtttcagcgacagtggcaagaagatgtgatgaaagatcaaaatattgtgcctagattaaaggcgatgacatggaatatggcaaatctggagaaaggatcagcagaccctgcagcggttattgatttgaagcttcaaaatgatgctccatttcagttgggagttcaagatgtaaagttccagttggctacagattctatagatatgatgctgaaagccatgcactgtattagagaccagttttctaccatggatgaggcactaaatgggcattagcaccggtaaaccaaaggaatttcttagaagttatttttacaaagaatgaggttaaattggctctatggtggagctcaactgaaaacatgagattctgaatacataatgttaatgtaatttagattctcaattctcagaggctgagccttggcgtaatggtaaagtttactgccttgtgagtgcctagatactggaaacagcctctctgctttggttgataagactgctaccaacctctgtaccatatggatacc

SEQ ID NO: 3634 - DNA, 1135 bp, Glycine max
tttttgcttatgggccttgagttttaaccagggaccaaatcgcaatattcactaatttttcgagtactccgacacggtggtggtggtggtgtttgatggagcaaacgatatggggtcatttgccggtgctggtaagggcaaattcaaaagaatctattgaatacattcttcaggccctttggagaactcgaaaaactggtcttggcactaccgaccgatgcatcatccaagaaatgctccagctccaaaatgaatctgatctcgacccacttctggtttgcctccgaatgttaatcaggaggtgtgtttatgagaacactagcaaggaggatattccgaagctgttccccagtgaggttctgcctgaattgcaaaaactgttgacacttttgttgcacaagtttcagcgagagtggcaggaagatgtgatgaaagatcagaatattgtgcctcgattaaaggcgatgacatggaatatggcaaatctcgataaagaatcagcagaccctgcagctgttatcaatttgaagcttcaaaatgatggtcaatttcactcgggagagcaagatgtgaagttcaagttggctacagattctatagatatgatgctgaaagccatgcactgtattagagaccagttttctactgtggatgaggcactgaatgggcattagtaccagtaaaccaatggagtttcttacaagatacaactaatggaggacataaatgaaagacctaggcagggggaatcaaaacttgatcgatctttggcggggagttgtgttatcattcgggctaaagcctcaactgaccagatcatttactattctttatttaaaaaagaaaaactgttaatagtgttatgctttttggatcagaaaattccagtgcaaataagaaactcttttggtcatggatatgacaacctcatatgtaacttaatgcaagtcagtttttcacttgattttccttttgttttctcaagtgaactggtgcaaacacaagcaagatgcttgcacatccattgtggattactttgcagctgtaaaacataatgtgcattggattactggtttaaagttaatagttatgcttttaaaacttggaacataagttgcaaatgttcaaaacaaaa

SEQ ID NO: 3635 - DNA, 1728 bp, Glycine max
cagtcttgagcgaggttgttgggaatatcgatcatccactcggggagcatgagctgcttcgcgaaccacttgcgagcttccacggctttcagcttcgacgctccgatgagtcgaggctctcgtagccggaatccgaaccggcttcgaattccgcgagttcgaattcgggttcgggttttggttcggattctggttcggaggattggggtgggagagagagtgcggctgaggccaagaagcgcgcgtggcgctgggcgtcttggcgattctgtgcctggcggagcagagactgttccctgcgccgctcttgatcggagatcgccggtcgcttgaacggacggtggagatcgtgcggtgccatggcacagttcagcgcgtcgttttttggttagcagaaattcaatacaaaaatttacagtaactcatccatgaattcagcgcgtggtttgattttgaatgttaaagaagagagatataaagaggataaagaaatcgaagaccgactcaataatgggccggacaccttgtttgcttatgggccttgagttttaaccagggaccaaatcgcaatattcactaatttttgtgtatcatactccgacacggtggtggtggtggtggtggtgtttgatggagcaaacgatatggggtcatttgccggtgctggtaagggcaaattcgaaagaatctattgaatacattcttcaagcactttggagaacaagaaaaactggtcttggcactaccgaacgatgcatcatccaagaaatgctccagctccaaaatgaatctgatcttgacccacttctggtttgcctccgaatgttaatcaggaggtgtgtttatgagaacactagcaaggaggatattccaaagctgttccccagtgaggttctgcctgaattgcaaaaactgttgatgcttttgttgcacaagtttcagcaagagtggcaagaagatgtgatgaaagatcagactattgtgcctcaattaaagactatgacatggaatatggcaaatctggataaagaatctgcagaccctgcagctgttatcaatctgaagctacagaatgatgctctatttcactcaggagagcaagatatgaagttccagttggctacagattctatagatatgatgctgaaagccatgcactgtattagagaccagttttctactgtggatgaggcactgaatgggcattaggaccagtaaaccaatggagtttcttacaagatgttttacaaagaatgatatgcttgactaaattgctgccttttgcttttagatttacccacaggagaacatagatgaaagacccaggcagggggaatcaaaagttgatcaatctttggtggggagatgtgttatcattcgggctaaagcctcaactgaccagatcatttggtattctttatttgtaaaagaaaaactttaatagtctcgcttttaggatcagaaaattccagcgaaactagttaaacttgtagattaatggattgagcagtttctttttccaaataagaaactcctttggtcatggatgtgacaacctgatatgtaacttcaggcgagttgggttttcacttgttcttcctttgttttctcaactgaactggtgcaaacacaagcacgatgcctgcacatccattgtggattactttgcaagtgcaaaacataatgtgcattggattactggtttagaacttggagcataagttgcaa

SEQ ID NO: 3636 - DNA, 1410 bp, Cicer arietinum
accgcgcgtcgttttgaaggatcaaatcgtaaatattttgaatttccaccttttaaggtaaaaagaaaaaaataataatttaattttaatttaattttagttttcttgctcttattttctgtctgctcaacgcgagggttcagttgcaaacgtgctttttccgctccgagcaattatcggtcgaacttaggtatgcttaaatgttcacttagttcttcatgtttagtaattaatgtgctggaattttatattttgtagatagatgatcgaatatccctaattcttttggaagtatggagcaaacggtgtggggtcatttgccggtgttgctaagggtaaattccaaagaatcaattgaattcattcttgaagctctttggagaaccagaaagagtggtcttaactctgctgatcgatgcatcatccaagacatgctacaactccaaaatgactctgaccttgacccgcttctggtttgcctccgaatgttaatcaggaggtgtgtttacgagaatacttgcaaggatgatatttcaaagttgtttcctggtgaagttcttcctgaattgcaaaaactattgacacttctgttgcagaagtttcagcatgagtggcaaaaagaagtgatgaaagatcagaatgtcgtgcctcgattaaaggcaatgacgtggaatatggcaaatcaggataaagattcatcagaccctgcagctgttattaatttgaagcttcaaaatgatgctcggtttcactcgggggagctggacgtgaagtttcagttgactacagattctctagagatgatgctaaaagctatgcacagtatcagagaccagtttccagccatggatgaggcaccaaaagggaattagtatcgggaaaccaatagagttctatagaaaatgtctcacgaagaatggtacaataggaggacacagatgacaggcctgtggttggagtctcagtatcataccggttaaaacttcaactgaccggatcggcagatcacccttgttaatttattgttatagtcacgctttttggatggaaaaattccaatgcaatttgcttaaatgtaaatccaaagagagaaaatacaacttgcaaaaagtagaagatacaacctctgctgactattgcaaacgatgggagagtcgtgcagttattgataaccttactgccaaatgaaaattacttttcctttcttttcaatatttcttttgtttttattgcattggcaaatgttcaagtcctaggtttaatacctcatatgagttgggaatgccatgtttcctgattgatgaagactatagaagtctcaacacagatcataagttatttagtaaaatgatacaaaggattaaacatatttctttctttgtgatgtgtagttatttaagatcagactcc

SEQ ID NO: 3637 - DNA, 1641 bp, Cichorium intybus
agggtagcaagtgcgtctgagtatttggtcatcaccggattcgggatcgatgacatcaaaattgcaaagaaagcatgggtacttcccggccaatcctactccgtcttcgacatctctccggtcaactacactttcgaagtccaggccatgagcgccgagaaactccctttcattctccccgccgtattcaccatcggtccccgttccgacgacgacgacagtctccacaaatacgctaagcttatctctcctcacgataagctatctcaccatgtgaacgaacttgtcaaggggatcatcgagggggagacccgtgtcctcgctgcctccatgaccatggaagagattttcaaagggaccaaggattttaagcaggaggtgttcgagaaggttcaattggaactaaatcagttcggcctgtggatctacaacgccaatgtcaagcaattggttgacgttcctggacacgagtatttctcgtatttagggcaaaaaacacaaatggaggctgccaatcaagccagggtcgatgttgctgaagctaagatgaagggtgaaataggatcgaagcttcgagaaggccagacgctccagaacgcagcgaaaatagacgcggagacaaaggtcatagcaacacagaggcaaggacaggggaagaaggaggagataaaggtgaggacggaggtgaaggtgttcgagaatgaaagggaggctgaagtggctgaagcgaatgcagagctcgcaatgaagaaggcaaagtgggctaaggattcacagctggcagaggtggtggcgaaaaaggcggtggcgctccgggaggcggagctgcagaaggaggttgaaatcatgaacgcgttgactcagacggagaaactcaaggctgagttcttgagtaaagctagcgttgaatatgaaaccaaggtacaagaggcgaactgggagctttacaggaagcaaaaggccgctgaagcaattctctacgagagagaaaaagaagcggaggcccaaaaggcaatcgccgaggcaactttctactcccggcaacaagtcgccgacggtgaattatatgcaaaacagaaagaggcggagggtctggttgccctagcccaagctcaaggtacctacatacgcacccttttgggcgccatgggaggtaactacaccgctttacgagattatttgatgatcaatggaggaatgtatcaagagatcgcgaagattaatggcgaggcagttaagggtttgcagccaaagattagcatctggaccggcgcaaatggtggtggagatggcggtgatggtggtgccatgaaggaagtcgccggcgtgtacaaaatgttgccgccgttgttcaacacggttcatgagcaaaccggaatgttgccaccaacttggatggggaaaatcaccgaatcttaaacggttttttatgattccggaagcaggacttattattatattttattcaaagtatttgctatttaaaaatgaatattgtgcactttttgttagtgtttatagctaataggttgaatctcttttcctgcgaaatgatatatgtgttaatattcgtgtttattgcagtgaagttcgtatatatatttttgttgaatgtgaaagtgtgagatacactttgttaag

SEQ ID NO: 3638 - DNA, 1505 bp, Setaria italica
tcttgttgcaagcacaggttcacatttcgctgccacaggcggaacagggaaaaccgcgctaccgtctcaaaagcacaaacactcctcgcgtgcccactccttcaaaccttcatcaaacacccgttgcgccagcgccctcttcctcttctcccccctcctccctcccgcagccccacgcgcatcgcgccgcgcggctcccgaggcgagagggatggcccggcacgccaagacggactccgacgtgacgagcctggcggcatccacgccgccgcgctcccctcgcggccgcccggcctactacgtgctcagccccgccgcctcccacccggacgtccacctgggcgcgtccggccgcggcgccgccgccgccgagaagatgtcgctcgcggggtccacccccgccgagtcgccgctccactaccacttccaccaccaccgccatagccactcgggtgccgtcgccggtggcggcggcggcgtgcaccactcccgggagtcctccacggggcggctcctgttctcggaccagctccgctccggcggcgacgtcgccgccgtggtgagcgccccctggcgccggctcgcgcagtccagcggcgcgggcagcgtcggggacgacgacgacgaggacgcgtccctgcacggcggcttcctcgcatcgtcgcagtggcggtgctacgcgctcggggcgttcgcgttcgtcgccgtgttcgccttcttcctgctcgtgctctggggcgccagcaggtcctacaagcctcacgtcgtcgtcaagagcgtggtgttcgagtcgtaccacatccagggcgggacggaccggacgggcgtgccgacgaagatgatgtcgatgaacgcgacggtgcggctgcgcttccgcaaccgcggcaccttctttagcctgcacgtcaccgccacgccattcctcctcttctacggcgagctcaccgtcgcctccggcgagatgaaggagttctaccagccgcggaagagcgggcggatggtgacggtgtccgtggtggggaagcaggtgccgctctacggcgcgggcgtgagcctgcacagcaagcccaacaacggccgcctcggccccgcggtggtgcccgtccggctcgccttcgtgctgcgcgcgcgcgcccacatcctcggcctcctcctccactccaagttctaccgccgcgtgcactgccgcctcgacatccgggaggcacacctcggcaggcccgtccgcggcgtcgccgccgactgcgagtaccacgacgggaggtgacggtggcgatcgttcctgccgttcggcggcggggctggctcgtgctgtgctgttgggtatagagtaattgggtcgcgcagggttctgttctggggcctgtggtgtgtgatgaactggtgactgattggtcgtaggcttgtagtgttcgcattgttagaaggaatcgttgtgatatgtaactgggatatcgacggattatgatggggggcaacttggctaatgcgatgggtgttgctat

SEQ ID NO: 3639 - DNA, 1461 bp, Setaria italica
acagggaaaaccgcgctaccgtctcaaaagcacaaacactcctcgcgtgcccactccttcaaaccttcatcaaacacccgttgcgccagcgccctcttcctcttctcccccctcctccctcccgcagccccacgcgcatcgcgccgcgcggctcccgaggcgagagggatggcccggcacgccaagacggactccgacgtgacgagcctggcggcatccacgccgccgcgctcccctcgcggccgcccggcctactacgtgctcagccccgccgcctcccacccggacgtccacctgggcgcgtccggccgcggcgccgccgccgccgagaagatgtcgctcgcggggtccacccccgccgagtcgccgctccactaccacttccaccaccaccgccatagccactcgggtgccgtcgccggtggcggcggcggcgtgcaccactcccgggagtcctccacggggcggctcctgttctcggaccagctccgctccggcggcgacgtcgccgccgtggtgagcgccccctggcgccggctcgcgcagtccagcggcgcgggcagcgtcggggacgacgacgacgaggacgcgtccctgcacggcggcttcctcgcatcgtcgcagtggcggtgctacgcgctcggggcgttcgcgttcgtcgccgtgttcgccttcttcctgctcgtgctctggggcgccagcaggtcctacaagcctcacgtcgtcgtcaagagcgtggtgttcgagtcgtaccacatccagggcgggacggaccggacgggcgtgccgacgaagatgatgtcgatgaacgcgacggtgcggctgcgcttccgcaaccgcggcaccttctttagcctgcacgtcaccgccacgccattcctcctcttctacggcgagctcaccgtcgcctccggcgagatgaaggagttctaccagccgcggaagagcgggcggatggtgacggtgtccgtggtggggaagcaggtgccgctctacggcgcgggcgtgagcctgcacagcaagcccaacaacggccgcctcggccccgcggtggtgcccgtccggctcgccttcgtgctgcgcgcgcgcgcccacatcctcggcctcctcctccactccaagttctaccgccgcgtgcactgccgcctcgacatccgggaggcacacctcggcaggcccgtccgcggcgtcgccgccgactgcgagtaccacgacgggaggtgacggtggcgatcgttcctgccgttcggcggcggggctggctcgtgctgtgctgttgggtatagagtaattgggtcgcgcagggttctgttctggggcctgtggtgtgtgatgaactggtgactgattggtcgtaggcttgtagtgttcgcattgttagaaggaatcgttgtgatatgtaactgggatatcgacggattatgatggggggcaacttggctaatgcgatgggtgttgcta

SEQ ID NO: 3640 - DNA, 2032 bp, Secale cereale
atctcgccgcgcagccaacgcccgcgacgcgatctggtcgccgcgctcctcctcctcctcgtcgcggccttcgcctccgccgcgcgcgccgatctcgtcatctccagggcggataggaaggttgatctgacttcgcacatcgtccgcgtcctcacttcgctcaaggttgaaaatgccggctcggagcctgtctctaaagtcttgctggcttttcccaatatccaagcaaaaaacttggcagcgatcagagcattcggcactgagggaaaagtgaagggtctgagtagtattcttccgattgaagttgttgagccttctggtgttcccccagaactgaccttcttttcagcatcgttgcacaaacctttgacaaaggggaagattcttcacttagatgtcttgactgtatttacacactttctccagccgttcccagaagagatcacccaagccgattcgcagcttgttgtctttcaggatagctctcactacctgtctccttaccctgttaaggtccagacacttagtatcagattacctggtggaagggttgaatcgtacacaaaatatggaaacacaaaacttgtggagtccgagctaaaatatggaccgtttgaagatgttcccccgttttcctacaaccctattattgtgcactttgagaacaacaacccatttgcagttgcaaaggaacttataagggagattgagatatctcactgggggaacgtacagattacagaacattacaacattgttcatggtggtgccagactgaagggtgaattctccaggcttgactaccagtctagaccttatgcaagaggggtttcatcatttaggaatctcattgctagattgcctccaagggcccactctatttactacagagatgaaattggtaacatttcaacatcacacttatggagtgattctaagaagacccaactggaaattgaaccaaggtttcccttgtttggtggttggcaaacaacctttaccattggttatggtttaccacttcaagactttgttttcagttctgatggaaagagatttctcaatatcacatttggttctccaatggaggagattctcatagaaaagctcatcgtaaaggtggttctacctgaaggttcaaaggatattgatgtttcagctccatttccaacaaatcaatggcaagaggtgaagtattcacaccttgacattgctggaaggccagttcttgtcttggagaagcctgatgttattccagagcataatttgcatttccaggtgtactacaaattcaataacatctcgttgctcatagagccgatgatgttgattactggcttcttcctcctgtttgttgcatgtattgcctacatgcacactgacatgtcaatctctaagaactctccttcttatctggcaaagctgcaatgggatgaggtgcaagccactgttcagcaaatccagggtatctttggccagtgcttagctgttcatgataagctagaggcatcattgcacgatttgtctaggactggggacgctaaatcttgcaaagcagctcgtaaagctgctgatgcacagtttaaggaattagcgaaagagctgaggccgctgttgctatctgtacagtcatcccctcagtcttatcagatatcgccaaagctagaggacttggttgcgaaggagaaggacatgcaggacaagctcatggcaaggcatgccacggtggttgacagcttcgagaagaagcagcgcgggcaagacatagaaaaccggatttcttcccagcagcagaagatcgctgcgctgaggcaagaggttgaatctcttctagagtaccttagcgagatatgagcggatccggtctcgtcttatatcattagtgattagactgatgaaggtcatctgcactatatgtggagatgttgttggtaaacccatcatcctagttcctgaggctaggttttgaatagaccgtgtaacatgatataagcaccgtaatcattttggaaccgattaacttctttgcatc

SEQ ID NO: 3641 - DNA, 2570 bp, Oryza sativa
gcggctagggttttagggtttttttttttcccttctcctccccattcgccggcaagcctccgctcccacgcggcgacggtctcctcccatggcgaagaagggcgcgccacgcaggcagcagccggcgccggcggcgcggcaactggccgtggcgaagaaggggaaggcccccccgaaggcggcgaagagggcgccgaagaagaagcaggagctgctcgagccgtcctccgacgactccgagctggagcagcagcaggagcggctccaggaggtggaggaggatgagtcagggtcggacctcgacgccccctcggactccggcgccgaggagctctccgactccgacgatgcctccttggagggaggagacagcggcgacgaggaagacgatgacgaggaggaggaggaagatgacgacgaccccctcgctgacgacttcctcgctggaagtagtgacgacgaaagtgccgaaggagatgactccggagtggattcagatgagtctgacgaccttgaggctaagtcacgagcaattgatgaagcgaaggggaaggcagaagaagaagctgaggaggaactcaaactcaatattagatcagaatctgatgagttccgattgcctacaaaggaggagttggaggaagaggcacttagaccaccaaacctgccacatcttaaaaggaggatatcagaaattgtccgggtactctcaaactttagtaagctaaggcaaaaagatgtgccgcgaaaggattatgtcgatcaactcaagactgatgtaatgtcatactatggatacaatgattttcttgttgaagcatttattgagatgttcccagctgttgagcttgttgagctactggaatcttttgagaaaagaccacctgagtgcttgcggacgaatacattgaagacccggagaagggatcttgctgctgctcttataccaagaggatttaatctggatccgatagggaagtggtcaaaggttggtctggttgtatatgactccaccatttcagctggtgccactgttgaatatatggctgggcattatatgaaacaaggtgcaagttctttcttgcctgtgatggctcttgctcctcaggagaaggagcgaattgttgatatggcggctgccccaggtggcaagactacatatattggagctcttatgaagaatactggaataatttatgcaaatgagttcaatgagaaaaggttgcatggacttttgggcaacatacatcgcatgggtgttaccaataccatagtttgtaattatgatggtaaagagctacccaaagttcttgggatgaattcggttgacagagttcttttggatgcgccctgcacaggcacagggaccatttggaaggacccacaaattaaaacgtcgaagggcattgaggacatcagagactgcgcttttgtacaaaagcaactcctgttagcagctattgatttggttgatgccaactccaaaactggcggttacattgtttactcaacctgttcgttgatgattccggagaatgaggcagttattgactatgcccttaaaaagcgaaacgtaaagcttgtgccttgtggattagattttggacgtccaggattcatccggttccgagagcatcgattccatacttctttagataaaacaaggaggttttatcctcatgtgaacaacatggatggattttttgttgcaaagctgaaaaagttgagcaatacaatcccagtgacatccgaatcatctaaagtgcctgaagaagcaattgagaagactgatcctagcagcgacgatcttcaagaacagcccattcagtcaaaaatacacaaagatgtgaagaagatgaatgaagagacaaccatccttgatggggtgactgaggacaaacaacagacacatgataggcctgaaaagacgctcaaaaaccataagaagggtgagaagaaacggaatggccctggcagtggtaaaaaagaaacacacaacgaaaaagaagagcctacaagtgaaaaaaagcagcctgtgtctgctaaaattaaaaaaactgttcccaagagaacatcaggaaccaaagaaaagaagccagatactgaccaaggagggaagaggaaaaggaactggatggttaggcgagaatgggaagcttataagaagtcgaggagtaaaaaggtatgaaaagcacgggtgaaggaactctagctgtagacaaattattgcagtgaaatttgataaccccatgagggaagatgtttaaaaggagtaacaaaactctagccgtagacaaactgcagtgaaatttgataacctacatgcggggaagatgttcaagaagagacaaaacacagttttgccgttggttatgttcgtggtgaaggaaaaaaatttgttgtactagaagtgatcgtgtgtaattttaccccttttccgtcttggtttaatgtatcaataacttattttgtcatgacactaacgcaaactctcagagatgagtgttatgaacttacgaggggagagagagatgtgatttacttcatcgatcatgttgccttcgcgtgct

SEQ ID NO: 3642 - DNA, 3807 bp, Zea mays
gacgatcaatacgacagattatggacacctatgattattgacgccatcgactggctggtgctatccacgacggaaaaggtgcggaacatatatgatgacctcttcgaggtgccgtcgaaggtgatgcagacggcgatcacgccgcgtgacgctaccagcagcatcaacttctattggaactccaagggctcgtcgcttgggtacataccggtcttccacttctccgaggtgctgcaggcgggcgccggcgttgttcgccagttcaacatcaacatcaacggcaagcggttcacctcccatgattattacacaccacggcacctcgaaagtggctacgtatacggtaccagaccttacaccaaccagatccggtataacgtctccatcgttaagacagacacgtcaacgctcccgcctatcatcaacgccgacgagattttcatcgtcatctctacgaccaacgttggcacggactcggaggacggtacgtgggatggactgacgtgcagctatgccatttctgatcctccaaaaattactgccctaaacatgtccttcagtggtctgaccggtgacatatcatctgctttcgcaaatctcaaggctgtccaatccttctatgccgataatccagacctttgcaccaacgccggggattcatgtcagacggcgccgcaaggaaagagcaagctagtcatctactacgtcgctgttcctatggctctgatcgtggtggcgttggcagtactgctgtgttgtcttctgcggcggcgaaagacgcgagggctagcggacgtctctgtgaagccccgggacaagactccgacgagccttgcttcaatggcggccgacgaacacagacttagctcgctgcggcttgagaaccgccggttcacatacgaggacctagagatgatcaccgacagcttcaagcgtgtcattggccggggcggctttggatacgtctacgagggcttcttggaggatggcactcaggtggcggtgaagatgaggtctcagtcgtccaatcagggtgccaaggagttcctcacggaggcacagatcttgacacggatccatcacaagaaccttgtctccatggtcggctactgcaaagatggggtgtacatggcgcttgtctacgagtacatgtcagaaggatccctgcaggagcacattgcaggaaaacgcttgacttgggggcagaggcttcgaatcgcattggaatcagcgcaagggctagagtatctgcacaggggctgcaacccgcctctgattcacagggacgtgaagaccagcaacatcctactgaacgcgaaactggaggccaaggttgctgatttcggcatgtcaaaggctctagaccgcgacacctatgcgtccacgaacactcttgttggcacaccaggatacgtcgacccagagtaccacctggcgcgcggcgacatcgaggtcgtggtggacgcgtccatgggaggcaaccacgacgtcaacagcgtgtggaaagccgcggaggtcgcgctccagtgcaccgagcaggcgtcggcgcagcgccccaccatgggcgacgtggtggcgcagctcctggagtgcctcgacctcgagaagggccgctccgccaacgaaagtttctgcgacggagacgacagcggctccgcgaccgcgagcttgagccacagcagcgcatttgtgacggggcgtatttttgggacggtgccaatggtggagacaggccctgccacgagacgcgcgctcgtgtgtgtctcactgtctcccctgtcccctctcccgcgtgctcgtctaccttcggctcccccatgggatgagagcgccttcctcgccatggccgcctcccacctgccccccgcagccaccctcgtcaagaagtacccaactctcctccacccgttcggcgccaaaccacacgcccagaggctgatcttcaggtgccgcgcgaccagcagcgagggtgcggacgatggctgggcgtcctttgtggacgagctcaagaggtcgctgcaggtggacccgtccgacgcggtgattagcaacgccggcgcgggtctcacatcaaataacgacctcgtcaccgcgctgccactggaaccctccgctggtccggctgcgggagacgcgaccactgccgctgccggcgcggtgagcgagctcctgggcgtggacgcgtcaggcgcggtggccacccccgaccgcctcctgagctccctgctgcacctggacgcgtccaacccggtggcgagcgtggcgggcggcgcgctgtctcgcctggacgcgctcacgtcgggactgtcggacgcgcagcggtgggcgctgttcgggttcctggccgcgacgtggctgtacctgaccgcgcggcccggggtgctgagcggcgccgtggacatgtacgtgctggcgccgctgcagctggcgctggacagcgtgctgggccggcggagcctcaagatgagcgacttcgtcgtcggcgagcgcatcggggagggctccttcggggtggtgtatgccggcgccgtggtgccgaagaacggcgccgtcgtggaggagcggtccggcaaggccaagacgagcctccagaacgacgacaggtacaaggagaaggtcatactcaagaagatcaaggtcatgacggtgggggcgaaggagtgtggggactacgaggagtggttcaactaccgcgtgtcgagagcggcgccggagtcgtgcgccgacttcctcgggagcttcgtcgccgacaagaacaaggcggagttcgtcaagggcggcaagtggctcgtctggaagtttgagggcgacaggacgctggccaattacctgagcgagcgcggcttcccgtccaacctggagcgtctcatgttcgggcgcgtgctgcagggcctgggcccgctggagcgcgaggcgctggtggtgaagcaggtgatgcggcagctgatcacgtcgctgaagcgcatccacgccacgggcatcgtgcaccgcgacatcaagccgtccaacctcgtcgtgacccgccgcgggcaggtgaagctcatcgacttcggagccgccaccgacctccgcatcggcaagaactacgtgcccgaccgcgcgctgctcgacccggactactgcccgcccgagctctacgtcctccccgaggagacgcccgagcccccgccggagcccatcgccgccatcctctccccgatcctctggcagcagcagccatctttgcagctgaacagcccggacctgttcgacatgtactcggcggggatagtgctgatgcagatggccataccgacgctgcggacgcagtcggggctcaagaacttcaacgccgagctcaggtccgccggctacgacctcaacaggtggcggcagagcgcgcggcggaggcccgacctgcagatcctggacctcgactccggccgaggctgggacctcgccaccaagctcatctcggagaggggcgccaacggcggtggccgcctgtctgccgcggccgcgttgcgccacccgtattttctcctgggtggcgaccaggccgcggcggtgctgtccaagttctcgctcagtaaatagcatccatccatggcccatggctgggtacctacgacctacgggatatatacacatcggcttattggaatcctccgatcgattcaccatccttgtatattgcgcattattgaatccttgggcataccataccggcagtgggaggcatcccaaattcaaaagggagtcatctggtaactgatgttacaacttttctgtatgggaatgctgtgaacaatgtggtgcagagtttca

SEQ ID NO: 3643 - DNA, 1525 bp, Secale cereale
cccgcggcccgccgcgccgtctccaccgccacttcctcctccccgccgcgcgtcaagagagccgcgcggtacaggtgctgcgccgagcctccttccccggagcagcaggagacccccgcgccactgccctctccgccggaattgccttcgtccctgtggggcgtctccacgagcgcctggaccgcgggggtcgcggggctggggctcctggagaccggctacctcagctacctcaagctcacgggctccgaggccttctgccccgtcgccgggggaggctgcggcgacgtgctcgacagcgactactccgtcgtcttcgggatccctcttccattagttggtatgatgacatatggtgtggtgactgcactctctctgcaagaaaatcgagaggagttgctccctgtactcgatgacttggatatccgcctaaccttgcttctgcttgctacttcattggcgactgcgagcgcttattttctcttcatcctgaacacaaaatttgtcgggacgtcttgcttatactgcctgtcgtcagcgtttatctccttcacgttatttttcatcagactgaaggaattgttgcaggacattggcttggcacgcatccagaagtttgttggtcttcagttagctgtagctgtcattgttgctcttgctttaacaaactcatatagttcagctactactcagttaaagggtacaggtgatttcgtattagaaccgtacaaaacagaggtaacatcagaatcaaccccttttgctatttcactggcaagacatctacattctataggtgctaagatgtatggagcattctggtgtactcactgcaatgaccaaaaacaattgtttggtcgtgaagctatggaaattctggattatgtggaatgcttccctaatggagccggtaaggggaagaaaatggccgacgaatgtgtagccactggtttggaaggttttccaacatgggtcatcaacgggaagctcctgagcggcgaccaggaactctcggtcctcgcagaagaatccggttttgtctccgagagccccgagcaatcctgaggccatggagcgcgacgagcagaagcaccccgccgaatcaaatagcagaaaagagctctctagaggcaagaacctgaaacttgtggcagttaacagcaacagcacagaaatttcatccccgacgaggtgcattccaatggtgcatacttagattatactactaaatacaaccactaaccactgtataactatgtaaaaaaacctatgtttcccgcggtcgaatggcgcgggagaacatcgaacccgagggtgaatgtactacgacctttttgtagagcctgtagtttgtgctgtgaaacttgtagtccagggaaaccacagttttcatagtaatactttgcacttggacatttgcagtcctggggaagtacactgtctgtgccctccaccctttcagacaagagtttctgctgtctgggagcatatgggaatttctgagctccacagcgccaaaaaagtc

SEQ ID NO: 3644 - DNA, 1460 bp, Theobroma cacao
gaagttttcttcactttgtcactctctcactcctttccattttacttcccttccactccaaatgaaaccttcctttctctcctaaaccactttccacctcccccaatctccccaatcacagctatgccctcatctcccaaattcttcaatgcgcgcacttcgtcgctggccacgcgccccaccaggtcaacggtcctgatcttctccgccctcctcgtcttcgccattgtctctttcctcttagccctctcctctttcctttcctccggtggatccggttaccgatgccggagctccgacccgagatccgtccgggttctttgggacagagcagggaatgggaataatggtgtcgccggtggagatgacgataatgggacgaagaggcataaagttatgggctttgttgggatccaaaccgggttcggttcgaccggtcggagacggtccttgaggaaaacttggatgccttcggatcgtcaaggccttcaacggttggaagaagcaacaggattagcatttaggtttataatcggtagaacaaatgataagtcaaagatggcggagctgaaaaaagaagttgcagaatatgatgatttcctgctgttagatatcgaggaggagtacagtaagcttccatacaaaacgttagcattcttcaaagctgcgtatgcactctttgattctgagttttatgtcaaagctgatgatgatatatatttaaggccagatcgactatcacttctattagcaaaagaacgttctcactcgcagacttaccttggatgcatgaaaaaggggccggtatttactgatccaaaattgaaatggtatgagccactatcctatctacttggcaaggaatactttcttcatgcctatggtccaatatacgctctttcagctgatgttgttgcaagtttggttgccctgagaaacaacagttttcggatgtttagtaatgaggatgttacgattggtgcatggatgcttgcaatgaatgttaaccatgaggataaccgagcattgtgtgagccagactgtacgccatcatctattgctgtctgggatatccccaaatgttcaggattgtgtaatccagagacgaagctattggaactccatcagaaggatgcctgctcgaatagtccaactttgccatccgatgatgattagctttcttggccttgaacttgcacgggttttgtccaacttgagaaaatgtttcagagaattgctggctctaccaagttgatcttgctgccaccagacatatctaaacttccctctccttgttcaattacctcaagccatttttgtcgtccacaattttttttttttgtgtgtagtgtaacatacaaatctttttttcaccgacgatgtaagttgccaagagatttttacattaccattctttttaaagattaaaatgaaaactcacttacctgattccattacca

SEQ ID NO: 3645 - DNA, 1162 bp, Brachypodium distachyon
aaagccaccagcatttcttccaactgctcctcttgctcccccgctcgctctcgccgcctgctgatcctctcctcttcgggaggaccccgagcagcctccctccccgtccatctgctgctcgccccctcgtaacctcaaaatacttgaagatgtcagaacattctgagaatgtaactgaaaagatcatgggcagcatcatggataccattgctgacaacctccctaagcagaagtctgggcgttttgatccagctgcagtctctgataaagtgaacaagctgtttggtcgccagcagtcccttcatggagttttgggtggtggaaagtctgctgatgtattgctttggaggaacaagaagatatcttccagtgttttggctctcgcaacagctatttggattttcttcgagtggcttgattaccacttcttgacaatcatttcatttgcccttgttcttggaatggttgttcagtttgtttggtcgaacttcgcaagcagatcttctaatgtaccccgtgtcgagttaccgaaagagctctttgtgaacattgctgttgcggttggtgcccaagtaaacaagttcctgggtttccttcaagatgtgtcttgtgaaagaaacttgaagcattttgtactggcaattgtcggtttgtgggctgctgctgtagctgggagctggttcaatttcttaactgtcatttatattggatttgtctgcgctcatacccttcctgtgctgtacgagaagtacgaagaccaagtcgacagcttcctctacagccttcttgatctgctccgagatcagtacaagaaactcgacagcggtgtcttgagcaggatacccaaggggaacatgaagttcaagaagagcgagtagactagatgggcactcatgattacggagtgaaacccccgtatgtattattctgcttagtcgtgtgccagacctgtagtgtcaattgctgtttgagagctgtgtggtgtgcttcctggaccaggacaccggtttatcaccccaccagtttagattcaactgcaatgcattttcttctgttattctggatgctcctccacaaattagtgagaccataagttgtatccagaagttggatgttgagctgaaattcattgtgctgttccccaaacaaaatgttttcccca

SEQ ID NO: 3646 - DNA, 1169 bp, Brachypodium distachyon
cccaaagccaccagcatttcttccaactgctcctcttgctcccccgctcgctctcgccgcctgctgatcctctcctcttcgggaggaccccgagcagcctccctccccgtccatctgctgctcgccccctcgtaacctcaaaatacttgaagatgtcagaacattctgagaatgtaactgaaaagatcatgggcagcatcatggataccattgctgacaacctccctaagcagaagtctgggcgttttgatccagctgcagtctctgataaagtgaacaagctgtttggtcgccagcagtcccttcatggagttttgggtggtggaaagtctgctgatgtattgctttggaggaacaagaagatatcttccagtgttttggctctcgcaacagctatttggattttcttcgagtggcttgattaccacttcttgacaatcatttcatttgcccttgttcttggaatggttgttcagtttgtttggtcgaacttcgcaagcagatcttctaatgtaccccgtgtcgagttaccgaaagagctctttgtgaacattgctgttgcggttggtgcccaagtaaacaagttcctgggtttccttcaagatgtgtcttgtgaaagaaacttgaagcattttgtactggcaattgtcggtttgtgggctgctgctgtagctgggagctggttcaatttcttaactgtcatttatattggatttgtctgcgctcatacccttcctgtgctgtacgagaagtacgaagaccaagtcgacagcttcctctacagccttcttgatctgctccgagatcagtacaagaaactcgacagcggtgtcttgagcaggatacccaaggggaacatgaagttcaagaagagcgagtagactagatgggcactcatgattacggagtgaaacccccgtatgtattattctgcttagtcgtgtgccagacctgtagtgtcaattgctgtttgagagctgtgtggtgtgcttcctggaccaggacaccggtttatcaccccaccagtttagattcaactgcaatgcattttcttctgttattctggatgctcctccacaaattagtgagaccataagttgtatccagaagttggatgttgagctgaaattcattgtgctgttccccaaacaaaatgttttccccatgtg

SEQ ID NO: 3647 - DNA, 1959 bp, Zea mays
cctgttgagtgtgaaggaggcgcacgcgcttgagctgaagaaactgccgcgctgatctagcccgccgggatgggcgcctcggggcctgcggctccgccggcaacgcatcgccgccgctgcatccagctgctgctgctgctcgccctggccgtcgcgccgcttggcagccgtgggcttcgcgtccgtgccgcgggggcggacacgggagggctgagccgggacgcgttcccgaaggggttcgtcttcgggacggcgacgtccgcgtaccaggtcgagggcgcggcgacgtccggcggccgcgggccctgcatctgggatcccttcgtccacacccccggaaagattgctgaagacgccaacgcagatgttacaacagatgaatatcatcgctacaaggaagatgttgatctcatgaaaagcctaaattttgatgcataccggttttcaatctcctggtccaggatcttcccagatggcgaagggaaaattaatgaagaaggagtacagtattacaacaatcttatagactacatgattaagcaaggccttactccttacgccaaccttaaccactatgatcttccgcttgcgcttcagaagaagtaccaaggctggttaggcccaaaaattgtggacatatttgctgactatgctgatttttgtttcaagacttttggcaatcgagtcaagaactggttcacattaaatgagccaaggatagtagcattccttggttatgataaagggcttaacccccctaaccggtgcacacaatgcactgccggtgggaactcatcgacagaaccttacattgttgttcataacattctcctatctcatgctactgcagttgcaagataccgcaataaataccaggcaactcagaaaggcaaggtcgggatagttcttgacttcaactggtatgaaccttttacaaactcaactgaagatcaaaaagcagcgcaaagggccagggacttccatattggttggtttcttgatccattaataaatgggcaatatccaaagataatgcaagacattgtgaaagaccggctaccaagtttcacacctgaacaggccaagctagtcaagggctcatcagactatttcgggatcaatcaatatactacatactacattgcagatcaacaaactcctccgcagggaccaccgagctactcgtccgactggggcgtccaatattactttcaaaggaatggcgtgcaaattggacagatggcgcactcaatttggctttacatcgtcccatcgggcatgtatggagtcgtgaactacctaaaggaaaagtaccataatccaatcatcatcatatcggaaaacggaatggatcagcctggaaacctcacgcgcgaggagtacgtgcacgacgccgtgaggatcgacttctacaagaactacctgacggagctaaagagagggatcgacggcggcgcgaacgtgatcggctacttcgcgtggtctctcctggacaacttcgagtggctgtcgggctacacgtccaagttcggcatcgtctacgtcgacttcgcgacgctcaagcggtaccccaaggactcggcgtactggttcagagacatgctttcggggacgggctccaaggctgctaccccgcagactggttcaggcggccggccggctggttcggcttcagccacctcgaacggacctgccttgctggtctcccttttggtctccttgggtgttctgcttccatccatcttcatggtttcctcggtctaattagaaatgtattttcatagtacggatttgtagttgtgtggatgacaacatgttccttttaagaatcaggacatgttgcatcgatgcgggacctgttgtaggaatgagaccatgattcagggcttattgttcagagccagttttgttttgttttgtttgcggattttcagatacagatttgaacgtgtattcatg

SEQ ID NO: 3648 - DNA, 1722 bp, Saccharum officinarum
gggccctgcatctgggatcccttcgtccacacccccggaaagattgctgaagacgggaacgcagatgttgcaacagatgaatatcatcgttacaaggaagatgttgatctcatgaaaagcctaaattttgatgcataccggttttcaatctcctggtccaggatcttcccagatggcgaagggaaagttaatgaagaaggagtacagtattacaacaacctcatagactacatgattaagcaaggtcttactccttatgccaaccttaaccactatgatcttccgcttgcacttcagaaaaagtaccaaggctggttaggcccaaaaattgtggacatattcgctgactatgccgaattttgtttcaagagttttggcgatcgagtcaagaactggttcacattaaatgagccaaggatagtatcattccttggttatgataaagggattaacccccctaatcggtgcacacaatgcactgccggtgggaactcgtcgacagaaccttacattgttgttcataacatcctcttatctcatgctactgccgttgcaagataccgcaataaataccaggcaactcagaaaggcaaggttgggatagttctagacttcaactggtacgaacctcttaccaactcaactgaagatcaagcagcagcgcaaagggccagggacttccatattggttggtttcttgatccattaataaatggacaatatccaaagataatgcaggacattgtgaaagatcggctaccaagtttcacacctgaacaggctaagctagtcaagggctcatcagactatttcgggatcaatcaatatacgacatactacatttcaaatgaacaaactactcagcaaggaccaccaagctactcgtctgactggggcgttcaatataactttgaaagaaatggcgtgcaaattggacagctggcgcactcagtttggctttacatcgtcccatcgggcatgtatggagttgtgaactacttaaaggaaaagtaccagaatccaaccatcattatctccgaaaacgggatggatcaacccggaaacctcacgcgcgaggagtacctgcacgacaccattcggatcgacttctacaagaactacctgacggagctgaagaaagggatcgacgacggcgcaaatgtggtcggctacttcgcgtggtccctcctggacaacttcgagtggctgtcgggctacacgtccaagttcggcatcgtctatgttgacttcacgacgctcaagcggtaccccaaggactcggcgtactggttcaaggacatgctctcagggacgggctcgaaggctgccaccccgcagaccggctcaggcacccgcccggctggttcgccgtcagccacctcgaatggcgctgccctgctggtctctctgttcgtctccttgtgtgttctacttccatccgtcttcatggtttcctcggtttaattaggaataattttttttccttctagtgtgaattttgtagtggatggcagcgtgttgcttttaagacatgttgcatagatgagagacctgttgtaggaacgagactatgattgagggcttatttttcaggagccagctttgaacgtgtgtatctgcgttgattgagctgagctgcctcttttcgtgtatctgcctctgattagagtccgttgtcaattgtcatggtggccaccggtttagtggaggttctattttggc

SEQ ID NO: 3649 - DNA, 1448 bp, Brachypodium distachyon
cccttccctctttccgtccccaaattcgccccccaaaagcaccttccgaaccccaatggcgagctttaacgccgccggcgctggcgcggccaaccccaaccccaacaaatccctcgaggtgaactcgccgcccggagattcggtttccagcctgagctttagtcccaaggcgaaccacctcgtcgctacctcctgggacaaccaggttcggtgctgggaggtccagcctggtggccaatgccaagccaaggcgtcgatttcgcatgatcagccggtgctgtgctcagcctggaaggacgatggtactactgttttttcgggagggtgtgataaactggttaagatgtggccgttgctgtctaatgggcagcccacggtcttctcagggcatgatgcgccggttaaagaacttgcctggattccacaaatcaatcttcttgtcagtgggagctgggataagactttgaggtactgggaccctagacaacctcagccagtacatgttcagcaacttcccgagcgctgctatgctctctcacttagttatcctctaatggcggttggcactgctgatcgcaaagtagttatcttcaatctgcagaacccacaggctgaattcaagaggatcgactcacctctgaaattccagacaaggtgtcttgctgcattccctgatcaacaagggttcttggttggatcaatagagggacgcgttggtgttcatcatgtggatgactctcagcaaagcaaaaattttacattcaaatgtcaccgcgagggcaatgatatatactctgttaactcattgaacttccatcctgtgcaccatacatttgcaactgcaggttctgatggaggtttcaacttttgggacaaggacagtaaacaaagactcaaggcttttagcaagtgcccatcacccattacatgcagcacattcaatcaggatggttcaatctttgcttatgcggtatgctatgattggagcaagggtgctgagaagcataatccttctactgcaaagacaaatatctttctacatagcgtgcaggaatctgatgtcaaaggaaagccccgtgctggaaagaagtagacctgggaatgacaagttgcagatcggcgctcctaacctgataatccacacaatgacactatttgcgtgcatgtgttcagctcctgattctttagtgcatttcttcatctatgagactataaacacatcctttatgaaaaacagttgcctttcgccttatgtaaatggttgctcgtaatttgttgtgatagtgcattggcggtagttaactactagttataagtaacagtgatgctgggtcctcactgaatcttatccattctggtacagtggtactggcttaattgtttctccccatccatattttctggatctccaaaacatctgtgtgacgactgtcaaaatgccatgttac

SEQ ID NO: 3650 - DNA, 1566 bp, Brachypodium distachyon
cctggattgggcgtcgatcccacgcgggcaccgtctcttaaaaccaaaaaccctcccgagtatgcgagaacccccgaccccgcctcccttccctctttccgtccccaaattcgccccccaaaagcaccttccgaaccccaatggcgagctttaacgccgccggcgctggcgcggccaaccccaaccccaacaaatccctcgaggtgaactcgccgcccggagattcggtttccagcctgagctttagtcccaaggcgaaccacctcgtcgctacctcctgggacaaccaggttcggtgctgggaggtccagcctggtggccaatgccaagccaaggcgtcgatttcgcatgatcagccggtgctgtgctcagcctggaaggacgatggtactactgttttttcgggagggtgtgataaactggttaagatgtggccgttgctgtctaatgggcagcccacggtcttctcagggcatgatgcgccggttaaagaacttgcctggattccacaaatcaatcttcttgtcagtgggagctgggataagactttgaggtactgggaccctagacaacctcagccagtacatgttcagcaacttcccgagcgctgctatgctctctcacttagttatcctctaatggcggttggcactgctgatcgcaaagtagttatcttcaatctgcagaacccacaggctgaattcaagaggatcgactcacctctgaaattccagacaaggtgtcttgctgcattccctgatcaacaagggttcttggttggatcaatagagggacgcgttggtgttcatcatgtggatgactctcagcaaagcaaaaattttacattcaaatgtcaccgcgagggcaatgatatatactctgttaactcattgaacttccatcctgtgcaccatacatttgcaactgcaggttctgatggaggtttcaacttttgggacaaggacagtaaacaaagactcaaggcttttagcaagtgcccatcacccattacatgcagcacattcaatcaggatggttcaatctttgcttatgcggtatgctatgattggagcaagggtgctgagaagcataatccttctactgcaaagacaaatatctttctacatagcgtgcaggaatctgatgtcaaaggaaagccccgtgctggaaagaagtagacctgggaatgacaagttgcagatcggcgctcctaacctgataatccacacaatgacactatttgcgtgcatgtgttcagctcctgattctttagtgcatttcttcatctatgagactataaacacatcctttatgaaaaacagttgcctttcgccttatgtaaatggttgctcgtaatttgttgtgatagtgcattggcggtagttaactactagttataagtaacagtgatgctgggtcctcactgaatcttatccattctggtacagtggtactggcttaattgtttctccccatccatattttctggatctccaaaacatctgtgtgacgactgtcaaaatgccatgttacagaagcttcatattccctccattccataatata

SEQ ID NO: 3651 - protein, 698 aa, Secale cereale
RRRLRVPLRPALPRRRRPLPPLQVDFYKVLGAEPHFLGDGVRRAFEARAAKPPQYGYNTDTLVGRRQILQIAHDTLTNQSSRTEYDRALSEDRDAALTLDVAWDKVPGVLCALQEAGEAQAVLAIGEHLLEDRPPKRFKQDVVLAMALAYVDLSRDAMAASPPDVIRCCEVLERALKLLQEDGAINLAPDLLSQIDETLEEITPRCVLELLALPLDEKHHNRRQEGLRGVRNILWSVGRGGIATVGGGFSREAYMNEAFLQMTSAEQMDFFSKTPNSIPPEWFEIYSVALANVAQAIVSKRPELIMVADDLFEQLQKFNIGSQYAYDNEMDLALERALCSLLVGDISNCRNWLAIDNESSPHRDPKIVEFIVNNSSIDHQENDLLPGLCKLLETWLVSEVFPRSRDTRGMQFTLGDYYDDPKVLSYLEMMEGGGASHLAAAAAIAKLGAQATAALGSVKSSAVQAFNKIFPLIDRTAMENPNDGLEESVNKFDQKNIMGFDILDSKNAALKIVSATALFALLTVIGLKYLPRKRVLPAIRSEHESAAVANVVDSVDDDAVDEPIQIPRMDAKLAEDIVRKWQSIKSKALGSDHSVESLQEVLDGNMLKVWTDRAAEIERKGWFWDYTLSDVAVDSITVSLDGRRATVEATIEEAGQLTDATDPRNNDLYDTEYTARYEMAFTGAGGWKITEGAVLKSS

SEQ ID NO: 3652 - protein, 699 aa, Lolium multiflorum
APASASPFVPLFPDAADRSLPLQVDFYKVLGAEPHFLGDGVRRAFEARTAKPPQYGYSTDTLVGRRQILQIAHDTLTDQSSRTEYDRALSENRDAALTLDVAWDKVPGVLCALQEAGEAQAVLAIGEQLLEDRPPKRFKQDVVLAMALAYVDLSRDSMAASPPDVIFCCEVLERALKLLQEDGASNLAPDLLSQIDETLEEITPRCVLELLALPLDEKHRNKRQEGLRGVRNILWSVGRGGIATVGGGFSREAYMNEAFLQMTSAEQMDFFSKTPNSIPPEWFEIYSVALANVAQAIVSKRPELIMMADDLFEQLQKFNIGSQYAYDNEMDLALERALCSLLVGDITNCRIWLAIDNESSPHRDPKIVEFIVNNSSIDQENDLLPGLCKLLETWLVSEVFPRSRDTRGMQFRLGDYYDDPKVLSYLEMMEGGGASHLAAAAAIAKLGAQATAALGTVKSSALQAFSKIFPLIEQLDLSAMENPDNGLEGSLQKFDLKKVMGFDIHDSKNAALKIVSAGALSGLLAVIGLKYMPRKRVLPAIRSEHEAVAVTNVVDSVDDDAFDESIQIPRMDAKLAEDIVRKWQSIKSKALGSDHSVASLQEVLDGNMLKVWTDRAAEIEQHGWFWDYTLSDVTIDSITISLDGRRASVEATIEEAGRLTDITDSKNNDSYDTKYTTRYEMAFTKSGGWKITEGAVLKS

SEQ ID NO: 3653 - protein, 761 aa, Brachypodium distachyon
MEGFHNLLARPNTAPLAFSLPRPRRRPAEAVIVCRAASRWADRLFADFHLLPSATPAATDPPAAAPAGASTAPFVPLFPDAADRSLPLQVDFYKVLGAEPHFLGDGVKRAFEARVAKPLQFGYSTDALISRRQMLQIAHDTLTNQSSRTEYDRALSENRDAALTLDVAWDKVPGVLCALQEAGEAQAVLAIGEQLLEDRPPKRFKQDVVLAMALAYVDVSRDAMATSPPDVIRCCEVLERALKLLQEDGASNLAPDLLSQIDETLEEITPRCVLELLALPLDEKHQSKRQEGLRGVRNILWSVGRGGISTVGGGFSREAYMNEAFLQMTSAEQMDFFSKTPNSIPPEWFEIYSVALANVAQAIVSKRPELIMMADDLFEQLQKFNIGSQYAYDNEMDLALERALCSLLVGDISNCRIWLGIDNESSPHRDPKIVEFIVNNSSIDQENDLLPGLCKLLETWLVSEVFPRSRDTRGMQFRLGDYYDDPKVLSYLEMMEGGGASHLAAAAAIAKLGAQATAALGTVKSSALQAFSKVFPLIERLDLSAMENPDDGLEQSLEENGAGYDIYGSKNAALKIVSASAFFALLTVIGLKYMPRKRVLPAMRSEHESVAVADVVNSVDDHALDESIQIPRMDAKLAEDIVRKWQSIKSKALGSDHSVASLQEVLDGNMLKVWTDRAAEIERNGWFWDYKLSDVTIDSITVSMDGRRATVEATIEEAGQLTDVTNPKNNDSYDTKYTTRYEMTFAKSGGWKITEGAVLKS

SEQ ID NO: 3654 - protein, 762 aa, Sorghum bicolor
MEGVHSLLARPNSAPFAFSQPPLRRHHRPPPPGPSACRAASRWADRLFADFHLLPTATAAADPPAAAPSSSPFVPLFPDAADRALPLPVDFYKILGVEPHFLGDGIRRAFESRIAKPPQYGYSTEALVGRRQMLQIAHDTLTNQSSRTEYDRALSEDRDAALTMDVAWDKVPGVLCVLQEAGEAQLVLATGEQLLQDRPPKRFKQDLVLAMALAYVDLSRDAMAASPPDVICCCEVLERALKLLQEDGASNLAPELLAQIDETLEEITPRCVLELLALPTDEKHKNKRQEGLQGARNILWSVGQGGIATVGGGFSREAFMNEAFLQMTSAEQMDFFSKTPNSIPPEWFEIYSVALAHIAQAIASKRPQFIMMADDLFEQLQKFNIGSQYPYENEMNLALERALCSLLVGDISNCRMWLGIDNESSPYRDPKIIEFVVNNSSIDEENDLLPGLCKLLETWLVSEVFPRSRDTRGMQFRLGDYYDDPKVLSYLERMEGGGASHLAAAAAIAKLGAQATAALGTVKSSALQAFSKVFPLIEQLDRSGKDTPGDDLEKSLEKLAQESVAGDAIHDSKNAALKIISAGALFALFAVIGLKCLPRKKSLPALKSEYGSVAVADSVDGLGADEEPLEIPRMDAKLAEDIVRKWQSIKSKALGPEHTVTALQEILDGNMLKVWMDRATEIERHGWFWEYTLSDVTIDSITVSMDGRRATVEATIEEMGQLTDVADPKNNDAYDTKYTARYEMSYSKSGGWRITEGAVLKS

SEQ ID NO: 3655 - protein, 762 aa, Setaria italica
MEGVHSLLARPNSAPFAFSLPPAVPRSPRPPPAPFACRAASRWADRLFADFHLLPTAAAADPPAAASSSSSPFVPVFPDAADRALPLPVDFYKILGAEPHFLGDGIRRAFEARIAKPPQYGYSTEALVGRRQMLQLAHDTLTNQSSRTEYDRALSEDRDATLTMDVAWDKVPGVLCVLQEAGEAPLVLATGEQLLQDRPPKRFKQDVVLAMALAYVDLSRDAMAASPPDVIHCCEVLERALKLLQEDGASNLAPDLLSQIDETLEEITPRCVLELLALPIDEKHKNKRQEGLQGARNILWSVGRGGIATVGGGFSREAFMNEAFLRMTSAEQMDFFSKTPNSIPPEWFEIYSVALAHIAQAIASKRPQFIMMADDLFEQLQKFNIGSQYPYENEMDLALERALCSLLVGDISNCRLWLGIDNESSPYRDPKIIEFVVNNSSIDEENDLLPGLCKLLENWLVSEVFPRSRDTRGTQFRLGDYYDDPKVLSYLERMEGGGASHLAAAAAIAKLGAQATAALGSVKSSALQAFSKVFPLMEQLDRSDKDNPSDDIEKSLENLAQQNVTGDDIHDSKNTALKIISAGALFALFAVIGLKCLPRKKSLPAVRSEYESVAVADSVSGPAVDEEPLEFPRMDAKLAEDIVRKWQSIKSKALGPEHSVPALQEVLDGNMLKVWSDRATEIERHGWFWEYTLSDVTIDSVTVSVDGRRATVEVTIEEVGQLTDVADSKNNDSYDTKYTTRYEMAYSKSGGWMITEGAVLKS

SEQ ID NO: 3656 - protein, 723 aa, Panicum virgatum
ASRWADRLFADFHLLPTAAAADPPAAASPSSSPFVPIFPDTADRALPLPVDFYKILGAEPHFLGDGIRRAFEARIAKPPQYGYSTEALVGRRQMLQLAHDTLTNQSSRTEYDRSLSEDRDATLTMDVAWDKVPGVLCVLQEAGEAQLVLATGEQLLQDRPPKRFKQDVVLAMALAYVDLSRDAMAASPPDVIHCCEVLERALKLLQEDGASNLAPDLLSQIDETLEEITPRCVLELLALPIDEKHNNKRQEGLQGARNILWSVGRGGIATVGGGFSREAFMNEAFLRMTSAEQMDFFSKTPNSIPPEWFEIYSVALANIAQAIASKRPQFIMMADDLFEQLQKFNIGSQYPYENEMDLALERALCSLLVGDISNCRMWLGIDNESWPYRDPKIIEFVVNNSSIDEENDLLPGLCKLLESWLVSEVFPRSRDTRGMQFRLGDYYDDPKVLSYLERMEGGGASHLAAAAAIAKLGAQATAVLGTVTSSALQAFSNVFPLIEQLDRSDKENPSDDLEKSLEKLAPQHVTGDVINDSRNAALKIISAGALFALFAVIGLKCLPRKKSLPAIRSEHGSVAVAESVGGPAADEEPLEIPRMDAKLAEDIVRKWQSIKSKALGPEHSAVVLQEVLDGNMLKVWTDRATEIARHGWFWEYTLSDVTIDSVTVSVDGRRATVEATIEEVGQLTDVADPKNNDSYDTKYTTRYEMAYSKSGGWRITEGAVLKS

SEQ ID NO: 3657 - protein, 761 aa, Zea mays
MEGVHSLLARPNSAPFAFSPLPLRRSHRPPPPGPSTCRAASRWADRLFADFHLLPAAADPPAAASSSSSSPFVPIFPEAADRALPLPVDFYKILGAEPHFLGDGIRRAFESRIAKPPQYGYSTEALVGRRQMLQIAHDTLTNQSSRTEYDRALSEDRDAALTMDVAWDKVPGVLCVLQEAGEAQLVLATGEHLLQDRPPKRFKQDVVLAMALAYVDISRDAMAASPPDVICCCEVLERALKLLQEDGASNLAPELLAQIDETLEEITPRCVLELLALPTDEKHKNKRQEGLQGAKNILWSVGRGGIATVGGGFSREAFMNEAFLQMTSAEQMDFFSKTPNSIPPEWFEIYSVALAHIAQAIASKRPQFIMMADELFEQLQKFNIGSQYPYENEMDLALERALCSLLVGDICNCRMWLGIDNESSSYRDPKNIEFVVNNSSMNEENDLLPGLCKLLETWLVSEVFPRSRDTRGTQFRLGDYYDDPKVLSYLERMEGGGASHLAAAAAIAKLGAQATAALGTVKSSALQAFSKVFPLTEQLDMSGKDIPSDDLDKSLEKLAQGSVAGDAIHDSRNDALKIISAGTLLALFAVLGLKCLPRNKSLPALRGEYGSVAVVDSIDGPAADEEPLEIPRMDAKLAEDIVRRWQSIKSKALGPEHTVTALQEVLGGNMLKVWADRAAEIERHGWFWEYALSGVTIDSITVSVDGRRAAVEATIEEVGRLTDVTDPKNDDAYDTKYTARYEMTYSRPAGWRITEGAVLRS

SEQ ID NO: 3658 - protein, 464 aa, Triticum aestivum
MATQLPCFTQLTPPSPGWRNEAGSLGAASGRALVRSVPFSGHSRFRCRATPRSANSFQKKDSFLDLHPEVSLLRGEQNDEAINPRKASSDGSTLEGLGVPPSQDDYNAAKIKVVGVGGGGSNAVNRMIEYSMNGVEFWIVNTDVQAIRMSPVHSQNRLQIGQELTRGLGAGGNPDIGMNAAKESCESIEEALHGADMVFVTAGMGGGTGTGGAPVIAGIAKSMGILTVGIVTTPFSFEGRRRAVQAQEGISALRNSVDTLIVIPNDKLLSAVSPNTPVTEAFNLADDILWQGIRGISDIITVPGLVNVDFADVRAIMQNAGSSLMGIGTATGKSRARDAALNAIQSPLLDIGIERATGIVWNITGGNDLTLFEVNAAAEVIYDLVDPNANLIFGSVIDPSLNGQVSITLIATGFKRQDEAEGRTAKGGQQMQGDNGRHPSSTGGSKVEIPEFLRRRGPSRFPRI

SEQ ID NO: 3659 - protein, 464 aa, Secale cereale
MATQLPCFTQLTPPSPGWRNEAGSLGAASGRALVRSVPFSGHSRFRCRATLRSANSFQKKDSFLDLHPEVSLLGGEQNDEAINPRKTSSGGSTLEGLGVPPSQDDYNAAKIKVVGVGGGGSNAVNRMIEYSMNGVEFWIVNTDVQAIRMSPVHSQNRLQIGQELTRGLGAGGNPDIGMNAAKESCQSIEEALNGADMVFVTAGMGGGTGTGGAPVIAGIAKSMGILTVGIVTTPFSFEGRRRAVQAQEGISALRNSVDTLIVIPNDKLLSAVSPNTPVTEAFNLADDILWQGIRGISDIITVPGLVNVDFADVRAIMQNAGSSLMGIGTATGKSRARDAALNAIQSPLLDIGIERATGIVWNITGGNDLTLFEVNAAAEVIYDLVDPNANLIFGSVIDPSLNGQVSITLIATGFKRQDEAEGHTAKGGQQMQGDNGRHPSSTGGSKVEIPEFLRRRGPSRFPRI

SEQ ID NO: 3660 - protein, 116 aa, Avena sativa
TPPSPGWRGEAGSLGATSVKALVRSTPFSGHSHFRCCASPRSANSFQKKDSFLDLHPEVSLLRGEQNDEVINPRKDSSNRSTLEGLGAPPTVMITTLQRSRSLESGRGFKCCQQDD

SEQ ID NO: 3661 - protein, 460 aa, Brachypodium distachyon
MATQLPCFTQLTPPSPGWRSDGATSGRAFLRSTPFLGHSHFRCGATPRSANSFKKKDSFLDLHPEVTLLRGEQSNDVINSRNASSEVSTLEGLGVPPDRNDYNEAKIKVVGVGGGGSNAVNRMIEFSMNGVEFWIVNTDVQAIRMSPVHSQNRLQIGQELTRGLGAGGNPDIGMNAAKESCESIQEALYGADMVFVTAGMGGGTGTGGVPVIAGIAKSMGILTVGIVTTPFSFEGRRRAVQAQEGIAALRNSVDTLIVIPNDKLLSAVSPNTPVTEAFNLADDILRQGIRGISDIITVPGLVNVDFADVRAIMQNAGSSLMGIGTATGKSRARDAALNAIQSPLLDIGIERATGIVWNITGGTDLTLFEVNAAAEIIYDLVDPNANLIFGAVIDPSLSGQVSITLIATGFKRQDEPEGRTSKGAQQMHGDNGRHPSSTDASKVEIPEFLRRRGPSRFPRV

SEQ ID NO: 3662 - protein, 464 aa, Pennisetum glaucum
MATQLPCFTQLSPPSSSWGNEVASCKDTSGRAFVRSTRALGRCHFRCCASPRSANSFRKKDSFLDLHPEVSLLRGEKNVEVVDPLKGASDGSPLEGLGVPPDRSDYNEAKIKVVGVGGGGSNAVNRMIESSMNGVEFWIVNTDVQAIRMSPVLSHNRLQIGQELTRGLGAGGNPDIGMNAAKESSESIQEALYGADMVFVTAGMGGGTGTGGAPVIAGIAKSMGILTVGIVTTPFSFEGRRRAVQAQEGIAALRNSVDTLIVIPNDKLLSAVSPNTPVTEAFNLADDILRQGIRGISDIITVPGLVNVDFADVRAIMQNAGSSLMGIGTATGKSRARDAALNAIQSPLLDIGIERATGIVWNITGGMDLTLFEVNAAAEIIYDLVDPNANLIFGAVIDPSLSGQVSITLIATGFKRQDEPEGRTSKGGQQIQGENGRRPSSGEGSMVEIPEFLRRRGPSRFPRV

SEQ ID NO: 3663 - protein, 464 aa, Setaria italica
MATQLPCFTQLSPPSSSWGSEVPSCKDTSGRAFVRSTRTLGHCHFRCCASPRSANSFQKKDSFLDLHPEVSLLRGKKNVEVVDPLKGASDGSPLEGLGVPPDRSDYNEAKIKVVGVGGGGSNAVNRMIESSMNGVEFWIVNTDVQAIRMSPVLPHNRLQIGQELTRGLGAGGNPDIGMNAAKESSESIQEALYGADMVFVTAGMGGGTGTGGAPVIAGIAKSMGILTVGIVTTPFSFEGRRRAVQAQEGIAALRNSVDTLIVIPNDKLLSAVSPNTPVTEAFNLADDILRQGIRGISDIITVPGLVNVDFADVRAIMQNAGSSLMGIGTATGKSRARDAALNAIQSPLLDIGIERATGIVWNITGGMDLTLFEVNAAAEIIYDLVDPNANLIFGAVIDPSLSGQVSITLIATGFKRQDEPEGRTSKGGQQIQGENGRRPSSGEGSMVEIPEFLRRRGPSRFPRV

SEQ ID NO: 3664 - protein, 464 aa, Panicum virgatum
MATQLPCFTQLSPPSSSWGNEAASCKDTSGRAFVRSTRALGHCHFRCCARPRSGNSFQKKDSFLDLHPEVSLLHGEKNVEVVDPLKGASDGSPLEGLGVPPDRSDYNEAKIKVIGVGGGGSNAVNRMIESAMHGVEFWVVNTDVQAIRMSPVLPHNRLQIGQELTRGLGAGGNPDIGMNAAKESSESIQEALYGADMVFVTAGMGGGTGTGGAPVIAGIAKSMGILTVGIVTTPFSFEGRRRAVQAQEGIAALRNSVDTLIVIPNDKLLSAVSPNTPVTEAFNLADDILRQGIRGISDIITVPGLVNVDFADVRAIMQNAGSSLMGIGTATGKSRARDAALNAIQSPLLDIGIERATGIVWNITGGMDLTLFEVNAAAEIIYDLVDPNANLIFGAVIDPSLSGQVSITLIATGFKRQDEPEDRTPKGGQQIQGKNGRRPSSAEGSMVEIPEFLRRRGPSRFPRV

SEQ ID NO: 3665 - protein, 464 aa, Panicum virgatum
MATQLPCFTQLSPPSSNWGNEAAICKDTSGRAFVRSTRALSHFHFQCCARPRSANSFQKKDSFLDLHPEVSLLRGEKNVEVVDPLKGASDGSPLEGLGLPPDRSDYNEAKIKVVGVGGGGSNAVNRMIESSMHGVEFWVVNTDVQAIRMSPVLPHNRLQIGQELTRGLGAGGNPDIGMNAAKESSESIQEALHGADMVFVTAGMGGGTGTGGAPVIAGIAKSMGILTVGIVTTPFSFEGRRRAVQAQEGIAALRNSVDTLIVIPNDKLLSAVSPNTPVTEAFNLADDILRQGIRGISDIITVPGLVNVDFADVRAIMQNAGSSLMGIGTATGKSRARDAALNAIQSPLLDIGIERATGIVWNITGGMDLTLFEVNAAAEIIYDLVDPNANLIFGAVIDPSLSGQVSITLIATGFKRQDEPEDRSPKVGQQIQGENGRRPSSTEGSMVEIPEFLRRRGPSRFPRV

SEQ ID NO: 3666 - protein, 460 aa, Saccharum officinarum
MATQLPCFTQLSPPSSNWIKDAGNCKATPGRVVKSARALGHSHFRCCASPRSANSFKKKDSFLELHPEVSLLRGEKSVDVVPMKGSSDGSLLEGPGVPPDRNDYNEAKIKVVGVGGGGSNAVNRMIESSMNGVEFWIVNTDVQAIRMSPVLPHNKLQIGQELTRGLGAGGNPDIGMNAAKESNESIQEALFGADMVFVTAGMGGGTGTGGAPVIAGIAKSMGILTVGIVTTPFSFEGRRRAVQAQEGIAALRNSVDTLIVIPNDKLLSAVSPNTPVTEAFNLADDILRQGIRGISDIITVPGLVNVDFADVRAIMQNAGSSLMGIGTATGKSRARDAALNAIQSPLLDIGIERATGIVWNITGGTDLTLFEVNAAAEIIYDLVDPNANLIFGAVIDPSLSGQVSITLIATGFKRQDEPEGRASKGGQQGENGRRPSSAEGSMVEIPEFLRRRGPSRFPRV

SEQ ID NO: 3667 - protein, 461 aa, Sorghum bicolor
MATQLPCFTQLSPPSSSWVKDVGNCKAATPGRVVRSARALGHSHFRCCASPRSANSFKKKDSFLELHPEVSLLRGEKTVDVVPMKGSTDGSLLEGPGVPPDRNDYNEAKIKVVGVGGGGSNAVNRMIESSMNGVEFWIVNTDVQAIRMSPVLPHNRLQIGQELTRGLGAGGNPDIGMNAAKESSESIQEALFGADMVFVTAGMGGGTGTGGAPVIAGIAKSMGILTVGIVTTPFSFEGRRRAVQAQEGIAALRNSVDTLIVIPNDKLLSAVSPNTPVTEAFNLADDILRQGIRGISDIITVPGLVNVDFADVRAIMQNAGSSLMGIGTATGKSRARDAALNAIQSPLLDIGIERATGIVWNITGGTDLTLFEVNAAAEIIYDLVDPNANLIFGAVIDPSLSGQVSITLIATGFKRQDEPEGRASKGGQQGENGRRPSSAEGSMVEIPEFLRRRGPSRFPRV

SEQ ID NO: 3668 - protein, 464 aa, Echinochloa colona
MATQLPCFTQVSPPLSSWGNEVASSKAASVRALVRSTRALGHCHFRCCASPRRANSFQKKDSFLDLHPEVSLLRGEKNVEVVEPLNGASNGSPLEGPGVSPDRSDYNEAKIKVVGVGGGGSNAVNRMIESSMNGVEFWIVNTDVQAIRMSPVLPHNRLQIGLELTRGLGAGGNPDIGMNAAKESSESIHEALYGADMVFVTAGMGGGTGTGGAPVIAGIAKSMGILTVGIVTTPFSFEGRRRAVQAQEGIAALRDSVDTLIVIPNDKLLSAVSPNTPVTEAFNLADDILRQGIRGISDIITVPGLVNVDFADVRAIMQNAGSSLMGIGTATGKSRARDAALNAIQSPLLDIGIERATGIVWNITGGMDLTLFEVNAAAEIIYDLVDPNANLIFGAVIDPSLSGQVSITLIATGFKRQDEPEGRPSKGGQQIQGEDGRRQSSAEGSMVEIPEFLRRRGPSRFPRV

SEQ ID NO: 3669 - protein, 467 aa, Zea mays
MATQLPCFTQLSPPSCSWIKDVGNCKATPDRVARSARALGHCHFRCCAGPRSANSFKKKDSFEKKDSFLELHPEVSLLRGEKSAEVVPMKGSSDGGLLEGLGVPPDRNDYSEAKIKVVGVGGGGSNAVNRMIESSMNGVEFWIVNTDVQAIRMSPVLPHNRLQIGQELTRGLGAGGNPDIGMNAAKESSESIQEALFGADMVFVTAGMGGGTGTGGAPVIAGIAKSMGILTVGIVTTPFSFEGRRRAVQAQEGIAALRNSVDTLIVIPNDKLLSAVSPNTPVTEAFNLADDILRQGIRGISDIITVPGLVNVDFADVRAIMQNAGSSLMGIGTATGKSRARDAALNAIQSPLLDIGIERATGIVWNITGGTDLTLFEVNAAAEIIYDLVDPNANLIFGAVIDPSLSGQVSITLIATGFKRQDEPEGRVSKGGQQGENGRRPSPAEGSSTVEIPEFLRRRGPSRFPRV

SEQ ID NO: 3670 - protein, 452 aa, Oryza sativa
MMAAPQLPCCTRLAPPCPGKAAAEARTLARSRFRCCAGAARPRSFQKKDSFLDLHPEVTLLRGGDEAAVVATRKGSPNGSPLEGLGAPPDHCDYDGAKIKVVGVGGGGSNAVNRMIESSMNGVEFWIVNTDVQAIRMSPVLPQNRLQIGQELTRGLGAGGNPDIGMNAAKESVESIQEALYGADMVFVTAGMGGGTGTGGAPVIAGIAKSMGILTVGIVTTPFSFEGRRRAVQAQEGIAALRNSVDTLIVIPNDKLLSAVSPNTPVTEAFNLADDILRQGIRGISDIITVPGLVNVDFADVRAIMQNAGSSLMGIGTATGKSRARDAALNAIQSPLLDIGIERATGIVWNITGGADMTLFEVNSAAEIIYDLVDPNANLIFGAVIDPTLNGQVSITLIATGFKRQDEPEGRTTKGGQQTQGDNGRRPSSAEGSMIEIPEFLRRRGPSRFPRV

SEQ ID NO: 3671 - protein, 228 aa, Theobroma cacao
MGRGKIEIKRIENTTNRQVTFCKRRNGLLKKAYELSVLCDAEVALIVFSSRGRLYEYANNSVRTTIDRYKKACADASNPGSVAEANTQFYQQEASKLRRQIRDVQNMNRHILGEALSTLTFKELKNLEGRLEKGISRIRSKKNELLFAEIEFMQKREVELQNDNMYLRAKIAENERAQQQQQQQANLIQGSVFQAVTSQPYNRNFLPVNLLEPSNDYSSQDQTALQLV

SEQ ID NO: 3672 - protein, 143 aa, Heritiera littoralis
MSFRGGNASSGMGVAEHTKSTYLELQRKKVFRYVIFKIDEKKKEVMVEKTGGPAESYDDFTASLPENDCRYAVYDFDFVTSENCQKSKIFFIAWSPSVSRIRAKMLYATSKDRFRRELEGIHYEIQATDPTEMDLDVIRERAH

SEQ ID NO: 3673 - protein, 147 aa, Gossypium hirsutum
FLSGYVFRGTNASSGMGVADHSKSTYLELQRKKVFRYVVFKINEKKKEVVVEKTGGPSENYDDLTASLPENDCRYAVYDFDFVTSENCQKSKIFFITWSPSVSRIRAKMLYATSKERFISELEGIHYEIQATDPTGMDLEVIRERAS

SEQ ID NO: 3674 - protein, 143 aa, Citrus clementina
  Sequence also found in Organisms: Citrus sinensis
MSFRGTNASSGMGVADHSKSTYLELQRKKVHRYVIFKIDEKKKEVVVEKTGGPAESYDDFTASLPDNDCRYAVYDFDFVTSENCQKSKIFFIAWSPDVSRIRAKMLYATSKDRFRRELDGIHYEIQATDPSEMDLEVIRDRAR

SEQ ID NO: 3675 - protein, 143 aa, Gossypium hirsutum
  Sequence also found in Organisms: Gossypium raimondii
MSFRGGNASSGMGVAEHSKSTYLELQRKKVFRYVIFKIDEKKKEVIVEKTGGPTESYDDFAASLPESDCRYAVYDFDFVTSENCQKSKIFFIAWSPSVSRIRSKMLYATSKDRFRRELEGIHYEIQATDPTEMDLEVIRERAH

SEQ ID NO: 3676 - protein, 143 aa, Vitis vinifera
MSFRGSNASSGMGVADHCKATYLELQRKKVHRYVIFKIDEKKKEVVVEKTGGPAESYDDFTASLPENDCRYAIYDFDFVTSENCQKSKIFFIAWSPSVSRIRAKMLYATSKDRFRRELEGIHYEIQATDPTEMDLEVLRERAN

SEQ ID NO: 3677 - protein, 143 aa, Actinidia deliciosa
MSFRGTNASSGMGVADHSKSTYLELQRKKVHRYVIFKIDEKKKEVVVEKTGGPAESYDDFTASLPESDCRYAVYDFDFVTSENCQKSKIFFIAWSPSVSRIRSKMLYATSKDSFRRELQGIHYEIQATDPTEMDLEVLRERAN

SEQ ID NO: 3678 - protein, 143 aa, Camellia sinensis
MSFRGANASSGMGVADHSKSTYLELQRKKVYRYVIFKIDEKKKEVVVEKTGGPAESYDDFTASLPENDCRYAVYDYDFVTSENCQKSKIFFIAWSPAVSRIRAKMLYATSKDRFRRELEGIHYEIQATDPTEMDLEVIQDRAN

SEQ ID NO: 3679 - protein, 150 aa, Fagus grandifolia
MSFRGTNASSGMGVAEHSKTTYLELQRKKVHRYVIFKIDEKKKEVVVEKTGGPAESYDDFTASLPENDCRYAIYDFDFVTSENCQKSKIIFMHGLLLYPGSVPRCCMQHQRIGSEGSWRASIMRSRQLTQLRWILKSSGTVQTEHKGLPY

SEQ ID NO: 3680 - protein, 143 aa, Castanea mollissima
  Sequence also found in Organisms: Quercus alba
MSLRGTNASSGMGVAEQSKTTFLELQRKKVHRYVIFKIDEKKKEVVVEKTGGPAESYDDFTASLPENDCRYAVYDFDFVTSENCQKSKIFFIAWSPSVSRIRAKMLYATSKDRFRRELEGIHYEIQATDPTEMDLEVLRDRAN

SEQ ID NO: 3681 - protein, 143 aa, Theobroma cacao
MAFRRANASSGMGVAEHSKSTYMELQRKKVFRYVIFKIDEKKNEVVVEKTGGPAESYDDFTASMPENDCRYAVYDFDFVTSENCQKSKIFFIAWSPSVSRIRSKMLYATSKDRFRRELEGIHYEIQATDPTEMDLEVIRERAR

SEQ ID NO: 3682 - protein, 143 aa, Gossypium hirsutum
MSFRGGNASSGMGVAEHSKSTYLELQRKKVFRYVIFKIDEKKKEVIVEKIGGPTESYDDFAASLPESDCRYAVYDFDFVTSENCQKSKIFFIAWSPSVSRIRSKMLYATSKDRFRRELEGIHYEIQATDPTEMDLEVIRERAH

SEQ ID NO: 3683 - protein, 143 aa, Gossypium raimondii
MSFRGGNASSGMGVAEHSKSTYLELQRKKVFRYVIFKIDEKKKEVIVEKTGGPTESYDDFAASLPESDCRYAVYDFDFVTSENCQKSKIFFIAWSPSGSRIRSKMLYATSKDRFRRELEGIHYEIQATDPTEMDLEVIRERAH

SEQ ID NO: 3684 - protein, 143 aa, Actinidia deliciosa
MSFRGTNASSGMGVADHSKSTYLELQRKKVHRYVIFKIDEKKKEVVVEKTGCPAESYDDFTASLPESDCRYAVYDFDYVTSENCQKSKIFFIAWSPSVSRIRAKMLYATSKDRFRRELQGIHYEIQATDPTEMDLEVLQERAN

SEQ ID NO: 3685 - protein, 143 aa, Carica papaya
MSFRGTNASSGMGVAEHSKSTFLELQRKKVHRYVIFRIDEKKKEVVVEKTGGPAESYDDFTASLPDNDCRYAVYDFDFVTSENCQKSKIFFIAWSPSVSRIRAKMLYATSKDRFRRELDGIHYEIQATDPTEMDLEVLRERAH

SEQ ID NO: 3686 - protein, 78 aa, Sarracenia psittacina
MSFRGANASSGMGVDNHSKSTYLELQRKKVHRYVIFKIDEKKKRLLLKRLEAQLRVMMILLHHCLKMIVDMLSMTLIL

SEQ ID NO: 3687 - protein, 143 aa, Eucalyptus grandis
MSFRGSNASSGMGVAEHSKTTYLELQRKKVHRYVIFKIDEKKKEVVVEKTGGPAESYEDFTSALPENDCRYAVYDFDFVTAENCQKSKIFFIAWSPSVSRIRAKMLYATSKDRFRRELEGIHYEIQATDPTEMDLEVIRERAN

SEQ ID NO: 3688 - protein, 143 aa, Panax ginseng
MSFRGTNASSGMGVADQSKSTYLELQRKKVHRYLIFKIDEKKKEVVVEKTGGPAESYDDFTASLPENDCRYAVYDYDFVTSENCQKSKIFFIAWSPSVSRIRAKMLYATSKDRFRRELQGIHYEIQATDPTEMELEVLQERAN

SEQ ID NO: 3689 - protein, 74 aa, Tripterygium wilfordii
MSFRGANASSGMGVAEDSKSTYLELQRKKVHRYVIFKIDEKKNEVVVEKTGGPAETYDDFTASMPENDCRYASL

SEQ ID NO: 3690 - protein, 138 aa, Aquilegia formosa
SNASSGMGVSDQSKSTFLELKRKKVHRYVIFKIDEKKKEVVVEKTGGPAENYDDFTASLPENDCRYAVYDFDFVTSENCQKSKIFFIAWSPSVSRIRAKMLYATSKERFRRELDGIHYEIQATDPTEMDLEVIRDRAH

SEQ ID NO: 3691 - protein, 143 aa, Manihot esculenta
MAFRGANASSGMGVAEHSKATFLELQRKKVHRYVIFKIDEKKKEVVVEKTGGPAESYDDFTASLPENDCRYAVYDFDFVTSENCQKSKIFFIAWSPAVSRIRAKMLYATSKDRFRRELEGIHYAIQATDPTEMDLEVLRDRAH

SEQ ID NO: 3692 - protein, 143 aa, Panax ginseng
MSFRGTNASSGMGVTDQSKSTYLELQRKKVHRYLIFKIDEKKKEVVVEKTGGPAESYDDFTASLPENDCRYAVYDYDFVTSENCQKSKIFFIAWSPSVSRIRAKMLYATSKDRFRRELQGIHYEIQATDPTEMELEVLQERAN

SEQ ID NO: 3693 - protein, 143 aa, Platanus occidentalis
MSFRGTNASSGMGVADHSKSTFLELKRKKVHRYVIFKIDEKKKEVVVEKTGGPAESYDDFTAALPENDCRYAVYDFDFVTSENCQKSKIFFIAWSPSVSRIRSKMLYATSKDRIRRELDGIHYEIQATDPTEMDMEVIRDRAH

SEQ ID NO: 3694 - protein, 143 aa, Primula obconica
MSFRGTNASSGMGVADLCKSTYLELQRKKVHRYVIFKIDEKKKEVVVDKTGTPAESYDDFTASLPENDCRFAVYDYDFVTSENCQKSKIFFIAWSPSVSRIRAKMLYATSKQRFRRELEGIHYEIQATDPSEMDLEVIQERAN

SEQ ID NO: 3695 - protein, 143 aa, Tabernaemontana elegans
MSFRGTNASSGMGVAEHSKSTYMELQRKKVHRYVIFKIDEKKKEVVVEKTGSPSESYEDFTASLPENDCRYAVYDYDFVTSENCQKSKIFFIAWSPSVSRIRAKMLYATSKDRFRRELNGIHYEIQATDPTEMELDVLRERAN

SEQ ID NO: 3696 - protein, 146 aa, Vaccinium corymbosum
MSFRGIGQTNASSGMGVADHCKSTYLELQRKKVHRYVIFKIDEKKKEVVVEKTGGPAESYDDFTASLPENDCRYAVYDYDFVTSENCQKSKIFFFAWSPSVSRIRAKMLYATSKERFRREFEGIHYEIQATDPTEMDLEVLQDRAN

SEQ ID NO: 3697 - protein, 83 aa, Platanus occidentalis
MSFRGTNASSGMGVADHSKNTFLELKRKKVHRYVIFKIDEKKKEVVVEKTGGPAESYDDFTAALPENDCRYAIYDFDFVTSEN

SEQ ID NO: 3698 - protein, 143 aa, Amsonia hubrichtii
MSFRGTNASSGMGVAEHSRSAYMELQRKKVHRYVIFKIDEKKKEVVVEKTGSPSESYEDFTASLPENDCRYAVYDYDFVTSENCQKSKIFFIAWSPSVSRIRAKMLYATSKDRFRRELEGIHYEIQATDPTEMELDVLRERAN

SEQ ID NO: 3699 - protein, 138 aa, Olea europaea
ANASSGMGVADHSKSTYMELQRKKVYRYVIFKIDEKKKEVIVEKTGSPAEGYDDFTASLPGNDCRYAVYDFDYVTSENCQKSKIFFIAWSPSVSRIRAKMLYATSKERFRRELQGIHYEIQATDPTEMDLEVIRERAT

SEQ ID NO: 3700 - protein, 146 aa, Manihot esculenta
MATTAFRGANASSGMGVADHSKATYLELQRKKVHRYVVFKIDEKKKEVVVEKTGGPAESYDDFTASLPENDCRYAVYDFDFVTSENCQKSKIFFIAWSPSVSRIRAKMLYATSKDRFRRELEGIHYEIQATDPTEMDLEVLKDRAN

SEQ ID NO: 3701 - protein, 145 aa, Actinidia deliciosa
MSLRIRGTNASSGMGVADHSKNTFLELQRKKVYRYVIFKIDEKKKEVVVEKTGGPAESYDDFAAALPENDCRYAVYDFDFVTSENCQKSKIFFIAWSPAVSRIRAKMLYATSKDRFRRELDGIHYEIQATDPTEMDLEVIRDRAH

SEQ ID NO: 3702 - protein, 143 aa, Euphorbia peplus
  Sequence also found in Organisms: Euphorbia esula
MAFRGGNASSGMGVAEHCKSTFLELQRKKVHRYVIFKIDEKKKEVVVEKTGGAAESYDDFTAAMPESDCRYAVYDFDFVTSENCQKSKIFFIAWSPSVSRIRAKMLYATSKDRFRRELEGIHYEIQATDPTEMDLEVLRDRAH

SEQ ID NO: 3703 - protein, 146 aa, Populus trichocarpa
MSFRGASRPNASSGMGVADHSKIAFVELQRKKVHRYVIFKIDEKKKEVVVEKTGGPAESYEDFTASLPENDCRYAVYDFDFVTSENCQKSKIFFIAWSPSTSRIRAKMLYATSKDRFRRELDGIHYEIQATDPTEMDLEVIRERAN

SEQ ID NO: 3704 - protein, 145 aa, Acacia harpophylla
MAFRVGGGNASSGMGVAEHSVSTYLELQRKKVHRYIIFKIDEKKKEVVVEKTGGPAESYDDFAASLPENDCRYAIYDFDFVTAENCQKSKIFFIAWSPSVSRIRAKMLYATSKDRFRRELEGIHYEIQATDPTEMDLEVLRDRAN

SEQ ID NO: 3705 - protein, 144 aa, Tropaeolum majus
MSFIRGTNASSGMGVADHSKSTYMELQRKKAHRYVIFKIDEKKKEVVVEKTGSPAESYEDFTAALPENDCRYAIYDYDFVTSENCQKSKIFFVAWSPSVSRIRAKMLYATSKDRFRRELHGIHYEIQATDPTEMDLEVIQERAH

SEQ ID NO: 3706 - protein, 144 aa, Vaccinium corymbosum
MSFRIRGPNASSGMGVADHSKNTFLELQRKKVHRYVIFKIDEKKKEVVVEKTGDPAESYDDFTAALPENDCRYAVYDFDFVTPENCQKSKDILHRVVTCSLSNSCQDALRHIKDRQRELDGIHYEIQATDPTEMDLEVIRDRAH

SEQ ID NO: 3707 - protein, 143 aa, Cannabis sativa
MAFRGGNASSGMGVDEHSKSTFLELQRKKVYRYVIFKIDEKKKEVVVEKTGGPAESYSDFVASMPENDCRYAVYDFDFVTSENCQKSKIFFIAWSPSVSRIRAKMLYATSKDRFRRELEGIHYEIQATDRSEMDLDVLRERAN

SEQ ID NO: 3708 - protein, 143 aa, Ipomoea batatas
MSSRGANASSGMGVAEHSKSTYMELQRKKVHRYVIFKIDEKKKEVVVEKTGGPAESYDDFTASLPETDCRYAVYDFDFVTSENWQKSKIFFIAWSPSVSRIRSKMLYATSKDRFRRELQGIHYEIQATEATEVDLEVLQERAN

SEQ ID NO: 3709 - protein, 145 aa, Vaccinium corymbosum
MSFRIRGPNASSGMGVADHSKNTFLELQRKKVHRYVIFKIDEKKKEVVVEKTGDPAESYDDFTAALPENDCRYAVYDFDFVTPENCQKSKIFFIAWSPAVSRIRAKMLYATSKDRFKRELDGIHYEIQATDPTEMDIEVIRDRAH

SEQ ID NO: 3710 - protein, 143 aa, Amorphophallus konjac
MSFRTSNASSGMGVADHSKSTFQELKRKKVHRYVIFKIDEKKKEVVVEKTGGPGESYDDFTAALPENDCRYAVYDFDFVTVENCQKSKIFFIAWSPSISRIRAKMLYATSKDRFRRELDGIHYEIQATDPTEMDLDVLRDRAH

SEQ ID NO: 3711 - protein, 143 aa, Cannabis sativa
MAFRGGNASSGMGVDEHSKSTFLELQRKKFYRYVIFKIDEKKKEVVVEKTGGPAESYSDFVASMPENDCRYAVYDFDFVTSENCQKSKIFFIAWSPSVSRIRAKMLYATSKDRFRRELEGIHYEIQATDRSEMDLDVLRERAN

SEQ ID NO: 3712 - protein, 143 aa, Vitis vinifera
MSFRGLNASSGMGVADHSKNTFLELKRKKVHRYVIFKIDEKKKEVVVEKTGGPAESFDEFAAALPENDCRYAVYDFDFVTSENCQKSKIFFIAWSPDSSRIRAKMLYATSKERFRRELDGVHYEIQATDPTEMDLEVLRERAH

SEQ ID NO: 3713 - protein, 143 aa, Prunus persica
  Sequence also found in Organisms: Prunus mume
MAFRGGNASSGMGVAEHCKNTFLELQRKKAYRYVIFKIDEKKKEVVVEKTGGPAESYDDFTASMPENDCRYAIYDFDFVTSENCQKSKIFFIAWSPSVSRIRAKMLYATSKDRFRRELDGIHYEIQATDPTEMELEVLRDRAH

SEQ ID NO: 3714 - protein, 146 aa, Ipomoea batatas
MAFRTARGPNASSGMGVADHSRSAFLELQRKKMHRYVIFKIDEKKKEVVVEKTGGPAESYDDFAASLPENDCRYAVYDFDFVTSENCQKSKIFFIAWSPSTSRIRAKMLYATSKDRFKRELDGFHYEIQATDPTEMDLEVIRDRAS

SEQ ID NO: 3715 - protein, 146 aa, Mimulus guttatus
MSFRGGGGTNASSGMGVADQSNITYTELQRKKVHRYVIFKIDEKKKEVVVEKTGGPAESYEDFTASLPESDCRYAVYDFDYVTSENCQKSKIFFIAWSPSISRIRAKMLYATSKERFRRELQGIHYEIQATDPTEMDLEVIRERAN

SEQ ID NO: 3716 - protein, 145 aa, Arachis hypogaea
MAFRMGGGNASSGMGVAEHSVSTFLELQRKKVHRYVIFKIDENKKEVVVEKTGGPAESYDDFTASLPENDCRYAVYDFDFVTAENCQKSKIFFIAWSPSVARIRAKMLYATSKDRFRRELKGVHYEIQATDPTEMDLEILRERAN

SEQ ID NO: 3717 - protein, 145 aa, Valeriana officinalis
MSFRGGATNASSGMGVADQSKNTYLELQRKKVHRYVIFKIDEKKKEVVVEKTGGPAESYEDFTSALPENDCRYAVYDFDFVTAENCQKSKIFFIAWSPSVSRIRSKMLYATSKDRFRRELQGIHYEIQATDSTEMDLDVIKERAN

SEQ ID NO: 3718 - protein, 143 aa, Rosa hybrid cultivar
MAFRGGNASSGMGVAEDCRNTFLELQRKKAFRYVIFKIDEKKKEVVVEKTGGPAESYADFTGSLPENDCRYAIYDFDFVTSENCQKSKIFFIAWSPSVSRIRAKMLYATSKDRFRRELEGIHYEIQATDPTEMELEVLQERAH

SEQ ID NO: 3719 - protein, 145 aa, Arachis hypogaea
MAFRMGGGNASSGMGVAEHSVSTFLELQRKKVHRYVIFKIDENKKEVVVEKTGGPAESYDDFTASLPENDCRYAVYDFDFVTAENCQKSKIFFIAWSPSVARIRPKMLYATSKDRFRRELKGVHYEIQATDPTEMDLEILRERAN

SEQ ID NO: 3720 - protein, 171 aa, Amborella trichopoda
MSFRSSNASSGMGVADHCMHTFLELKRKKVHRYVIFKIDEKKKEVVVEKTGGPAESYDDFTAALPENDCRYAIYDFDFVTSENCQKSKIFFIAWSPSISRIRAKMLYATSKDRFRRELDGIHMRFRPLIPLRWTWKCSGTVHTKLKALFLSRNRAIYNTFGVGATQILIII

SEQ ID NO: 3721 - protein, 83 aa, Amorphophallus konjac
AVPISPHFPHSRSPPPLRGAAAAAGGVPGVGRGSEAAAMSFRSANASSGMGVADHSKSTFLELKRKKVHRYVIFKIDGKKRRL

SEQ ID NO: 3722 - protein, 81 aa, Catharanthus roseus
MSFRGTNASSGMGVAEHSKSTYMELQRKKVHRYVIFKIDEKKKEVVVEKTGSPSESYEDFTSSLPENDCRYAVYDYVFCNF

SEQ ID NO: 3723 - protein, 132 aa, Cicer arietinum
MGVAEHSVSTFQELQRKKVHRYVIFKIDEKKQEVVVEKTGGPAESYDDFTASLPENDCRYAVFDFDFVTAENCQKSKIFFIAWSPSVARIRPKMLYATSKDRFRRELQGIHYEIQATDPTEMDLEVLRDRAN

SEQ ID NO: 3724 - protein, 80 aa, Glycine max
MTCWSWVRIRKQPLCIYKGKVAYNFPPPYLRIAWSLWTMGYEVFIYFFKSQGKFYSNRLSLEHKLAVTKTKPKFFIQLAW

SEQ ID NO: 3725 - protein, 143 aa, Fragaria vesca
MAFRGGNASSGMGVAEDCRSTFLELQRKKAFRYVVFKIDEKKKEVVVEKTGSPAESYDDFTASLPENDCRYAIYDFDFVTSENCQKSKIFFIAWSPSVSRIRAKMLYATSKDRFRRELDGIHYEIQATDSTEMELEVLQERAH

SEQ ID NO: 3726 - protein, 146 aa, Cleome gynandra
MSFRGLSRPNASSGMGVADHSKSTFQELQRKKVHRYVIFKIDENKKEVVVEKTGGPAESYDDFLASLPENDCRYAVYDFDFVTSENCQKSKIFFVAWSPSTSRIRAKMLYATSKDRFRRELQGIHYEIQATDPTEVDLDVLRDRAN

SEQ ID NO: 3727 - protein, 156 aa, Amborella trichopoda
MADHCMHTFLELKRKKVHRYVIFKIDEKKKEVVVEKTGGPAESYDDFTAALPENDCRYAIYDFDFVTSENCQKSKIFFIAWSPSISRIRAKMLYATSKDRFRRELDGIHYEIQATDPTEMDLECSGTVHTKLKAYALRTGPFIIHLIGLAIYTNNI

SEQ ID NO: 3728 - protein, 151 aa, Cicer arietinum
MAFRVGSGVGVGGGNASSGMGVAEHSVSTFQELQRKKVHRYVIFKIDEKKQEVVVEKTGGPAESYDDFTASLPENDCRYAVFDFDFVTAENCQKSKIFFIAWSPSVARIRPKMLYATSKDRFRRELQGIHYEIQATDPTEMDLEVLRDRAN

SEQ ID NO: 3729 - protein, 94 aa, Arachis hypogaea
GGGNASSGMGVAEHSVSTFLELQRKKVHRYVIFKIDENKKEVVVEKTGGPAESYDDFTASLPENDCRYAVYDFDFVTAENCQKSKIFFIAWSPW

SEQ ID NO: 3730 - protein, 143 aa, Musa acuminata
MSFRTSNASSGMGVDEHSKSTFLELQRKKVHRYVIFKIDEKKKEVVVEKTGAPGESYDDFTAALPENDCRYAIYDFDYVTEDNCQKSKIFFIAWSPSISRIRAKMLYATSKDRFRRELDGIHYEIQATDPTEMELEVLRDRAS

SEQ ID NO: 3731 - protein, 143 aa, Mesembryanthemum crystallinum
MAFRGGNASSGMGVAEHSKNTYMELQRKKVHRYVVFKIDEKKKEVVVEKTGGPAESYDDFLASLPENDCRYAIYDYDFVTSENCQKSKIFFFAWSPSVARIRSKMLYATSKDRFRRELNGIHYEIQATDPTEVDLEVLQERAN

SEQ ID NO: 3732 - protein, 146 aa, Cleome spinosa
MSFRGLSRPNASSGMGVADNSKSTFRELQRKKVHRYVVFKIDENKKEVVVEKTGGPAENYDDFLASLPENDCRYAVYDYDFVTPENCQKSKIFFVAWSPSTSRIRAKMLYATSKDRFRRELEGIHYEIQATDPTEVDLDVLRERAN

SEQ ID NO: 3733 - protein, 145 aa, Catharanthus roseus
MSFRITGPNASSGMGVADQSKDTFLELKRKKVHRYIIFKIDEKKKEVVVEKTGSPAETYDDFTASLPEDDCRYAVYDFDFVTSENCQKSKIFFIAWSPSISRIRARMLYATSKDRFRRELDGIHYEIQATDPTEMDLEVLQDRAH

SEQ ID NO: 3734 - protein, 145 aa, Triphysaria pusilla
MSFRGGGANASSGMGVADHSKDTYMELQRKKVYRYVIFKIDEKKKEIVVEKTGGPAESYEDFAGSLPENDCRYAVYDFDYVTSENCQKSKIFFVSWSPSTSRIRSKMLYATSKGRFSRELVGIHYEIQATDPTEMDLDVIRERAN

SEQ ID NO: 3735 - protein, 115 aa, Cannabis sativa
MVICSVCSGLSFSHDPKTVMTTLCFFRFWLGFGIGGIGARGAFIAAVFAIVLSTLFEIKFKAPTYEVDPIGSTVPQADYLWRIVLMAGALPAAITFYWRLKMPKTARYTALVGCF

SEQ ID NO: 3736 - protein, 143 aa, Cocos nucifera
MSFRMSSASSGMGVADHSKNTFLELKRKKVHRYVIFKIDEKKKEVVVEKTGAPGESYDDFAAALPENDCRYAVYDFDFVTDENCQKSKIFFIAWSPSISRIRAKMLYATSKDRFRQELDGIHYEIQATDPTEMDLDVLRDRAN

SEQ ID NO: 3737 - protein, 143 aa, Chelidonium majus
MSFRMSNASSGMGVADHSKDTFLELKRKKIHRYVIFKIDEKKKEVVVEKTGGPAESYDDFTASLPENDCRYAVYDFDYVTSENCQKSKIFFIAWSPSISRIRAKMLYATSKDSIRRELDGVQYEIQATDPTEMEFEVLRERAH

SEQ ID NO: 3738 - protein, 143 aa, Trifolium pratense
MGVGGGNASSGMGVAEHSVTTFQELQRKKVHRYVIFKIDEKKKEVVVEKTGGPAESYDDFTASLPENDCRYAVFDFDFVTAENCQKSKIFFIAWSPSVARIRPKMLYATSKDRFRRELQGIHYEIQATDPTEMELEVLIDRAN

SEQ ID NO: 3739 - protein, 143 aa, Eschscholzia californica
MSFRMSNASSGMGVADHSKNTFMELKRKKVHRYVVFKIDEKKKEVVVEKTGGAAESYDDFTAALPENDCRYAIYDFDYVTSENCQKSKIFFIAWSPSVSRIRSKMLYATSKDRFRRELDGIHYEIQATDPTEMELDVLRERAH

SEQ ID NO: 3740 - protein, 143 aa, Euonymus alatus
MSFRGTNASSGMGVAEDSKSTYHELQRKKVHRFVIFKIDEKKNKVMVEKTGGPAETYDNFTASLPENDCRYAVYDFDFVTSENCKKSKIFFIAWSPSVSGIRSKMLYASSRNSFRRELEGIHYEIQATDPTEMELEVLRERAN

SEQ ID NO: 3741 - protein, 143 aa, Nuphar advena
MSFRMSSASSGMGVSDHCKTTFLELKRKKVHRYIIFKIDEKKKEVVVEKTGGPAESYADFAASLPENDCRYAVYDFDFVTAENCQKSKIFFIAWSPSVSRIRAKMLYATSKDRFRRELDGIHYELQATDATEMDLEVIRDRAN

SEQ ID NO: 3742 - protein, 143 aa, Silene vulgaris
MAFRGGNASSGMGVAEHCKNTYMELQRKKVHRYVVFKIDEKKKEVVVEKTGGPAESYDDFLESLPDNDCRYAVYDYDFVTAENCQKSKIFFIAWSPSVSRIRSKMLYATSKDRFRRELQGIHYEIQATDPTEVDLEVLQERAN

SEQ ID NO: 3743 - protein, 146 aa, Cyclamen graecum
MAFRGIFQRNASSGMGVADHSKITYTELQRKKVHRYVIFKIDETKKEVVVEKTGTPAESYDDFTASLPENDCRFAVYDYDFVTSENCQKSKIFFIAWSPSASRIRAKMLYATSKVRFRRELEGIHYEIQATDPTEMGLDVIQERAN

SEQ ID NO: 3744 - protein, 147 aa, Cajanus cajan
MAFRVGEGRGNASSGMGVAEHSVNTFLELQRKKVHRYVIFKIDEKKKEVVVEKTGGPAESYDDFTASLPENDCRYAVFDFDFVTSENCQKSKIFFIAWSPSVARIRPKMLYATSKDRFRRELQGIHYEIQATDPTEMDLEVLRDRAN

SEQ ID NO: 3745 - protein, 148 aa, Glycine max
MAFRVGGAGGGNASSGMGVAEHSVSTFLELQRKKVHRYVIFKIDEKKKEVVVEKTGGPAESYDDFTASLPENDCRYAIFDFDFVTSENCQKSKIFFIAWSPSVARIRPKMLYATSKDRFRRELQGIHYEIQATDPTEMDLEVLRERAN

SEQ ID NO: 3746 - protein, 147 aa, Glycyrrhiza uralensis
MAFRMGVGGGNASSGMGVAEHSVSTFLELQRKKVHRYVIFKIDEKKKEVVVEKTGGPAESYDDFAASLPENDCRYAVFDFDFVTSENCQKSKIFFIAWSPSVARIRPKMLYATSKDRFRRELQGIHYEIQATDPTEMDLDVLRDRAN

SEQ ID NO: 3747 - protein, 146 aa, Nicotiana benthamiana
MSFRIRGGTNASSGMGVADQSKATYMELQRKKVHRYVIFKIDEKKNEVVVEKTGGPAESYDDFTAALPENDCRYAVYDYDFVTSENCQKSKIFFFAWSPSVSRIRSKMLYATSKDRFRRELEGIHYEIQATDPTEVELEVLKERAN

SEQ ID NO: 3748 - protein, 145 aa, Amsonia hubrichtii
MSFRIRGPNASSGMGVADHSKEAFMELKRKKVYRYVIFKIDEKKQEIVVEKTGNPAESYDDFTAALPENDCRFAVYDFDFVTSENCQKSKIFFIAWSPSISRIRAKMLYATSKDRFRRELDGIHYEIQATDPTEMDLEVLRDRAH

SEQ ID NO: 3749 - protein, 145 aa, Panax ginseng
MSFRIRGPNASSGMGVADHCKDTFLALQRKKVHRYVIFKIDEKKNEVVVEKTGGPAESYDDFTSSLPENDCRYAVYDFDYVTSENCQKSKIFFMAWSPATSRIRAKMLYATSKDRFRREMDGIHYEIQATDPTEMDLEVLRDRAH

SEQ ID NO: 3750 - protein, 145 aa, Solanum tuberosum
  Sequence also found in Organisms: Solanum phureja
MSFRIRGTNASSGMGVADQSKATYMELQRKKVHRYVIFMIDEKKNEVVVEKTGGPAESYDDFTAALPENDCRYAVYDYDFVTPDNCQKSKIFFFAWSPSVSRIRSKMLYATSKDRFRRELEGIHYEIQATDPTEVELEVLKERAY

SEQ ID NO: 3751 - protein, 145 aa, Sarracenia psittacina
MSFRIRGQNASSGMGVADHSKETFLELKRKKVYRYVIFKIDEAKKEVIVEKTGSPAESYDDFAAALPEDDCRYALYDFDFVTSENCQKSKIFFIAWSPAVSRIRAKMLYATSKDRFRRELDGIHYEIQATDPTEMDLEVLRDRAR

SEQ ID NO: 3752 - protein, 145 aa, Sarracenia psittacina
MSFRIRGPNASSGMGVADHSKETFLELKRKKVYRYVIFKIDEAKKEVIVEKTGSPAESYDDFAAALPEDDCRYALYDFDFVTSENCQKSKIFFIAWSPAVSRIRAKMLYATSKDRFRRELDGIHYEIQATDPTEMDLEVLRDRAR

SEQ ID NO: 3753 - protein, 150 aa, Coffea canephora
MSFSRATSFSRGPNASSGMGVAEHCKSTYLELQRKKVHRYVIFKIDEMKKEVVVEKTGSPSESYEDFTASLPENDCRYAVYDFDYVTAENCQKSKIFFIAWSPSVSRIRPKMLYATSKDRFRRELQGIHYEIQATDPTEMELDVLRERAN

SEQ ID NO: 3754 - protein, 157 aa, Elaeis guineensis
MSFRMSSASSGMGVADHSKNTFLELKRKKVHRYVIFKIDEKKRRWLLRRQELQGRAMMILRLHCRRMIADMLSMILILSLMRTARRARYFLLHGLLPSPASVLRCCMPHLRIDSDRSLMASITRFRPLTPQRWIWMCSETVQTKSIQLRKLLLRQTV

SEQ ID NO: 3755 - protein, 143 aa, Amorphophallus konjac
MAFRTSTASSGMGVADHCKHTYLELQRKKVHRYVIFKIDEKRKEVIVEKTGGAAEIYDDFLASLPENDCRYAIYDFDFVTEENCQKSKIFFIAWSPSTSRIRAKMLYATSKDRFRRELDGIHYEIQATDPSELDIEVLRERAN

SEQ ID NO: 3756 - protein, 143 aa, Euonymus alatus
MSFRRTNASSGMGVAEDSKSTYHELQRKKVHRFVIFKIDEKKNKVMVEKTGGLAETYDNFTASLPENDCRYAVYDFDFVTSENCKKSKIFFIAWSPSVSRIRSKMLYASSRNSFRRELEGIHYEIQATDPTEMELEVLRERAN

SEQ ID NO: 3757 - protein, 143 aa, Papaver somniferum
MSIRMSNASSGMGVSDHSKDIFMELKRKKVHRYVVFKIDEKKKEVVVEKTGGPAESYDDFTASLPENDCRYAVYDFDYVTSENCQKSKIFFIAWSPSVARIRSKMLYATSKDRFRRELDGIHYEIQATDPDEMELEALRERAH

SEQ ID NO: 3758 - protein, 143 aa, Papaver somniferum
MSTRMSNASSGMGVSDHSKDIFMELKRKKVHRYVVFKIDEKKKEVVVEKTGGPAESYDDFTASLPENDCRYAVYDFDYVTSENCQKSKIFFIAWSPSVARIRSKMLYATSKDRFRRELDGIHYEIQATDPDEMELEALRERAH

SEQ ID NO: 3759 - protein, 148 aa, Glycine max
MAFRVGGAGGGNASSGMGVAEHSVNTFLELQRKKVHRYVIFKIDEKKKEVIVEKTGGPAESYDDFTASLPENDCRYAVFDFDFVTSENCQKSKIFFIAWSPSVARIRPKMLYATSKDRFRRELQGIHYEIQATDPTEMDLEVLRERAN

SEQ ID NO: 3760 - protein, 147 aa, Vigna unguiculata
MAFRVGGGGGNASSGMGVAEHSVNTFLELQRKKVHRYVVFKIDEKKQEVVVEKTGGPAESYDDFTASLPESDCRYAVYDFDFVTSENCQKSKIFFVAWSPSVSRIRSKMLYATSKDRFRRELQGIHYEIQATDPTEMDLEVLRERAN

SEQ ID NO: 3761 - protein, 147 aa, Medicago truncatula
MAFRMGVGGGNASSGMGVAEQSVSTFQELQRKKVYRYVIFKIDEKKKEVVVEKTGGPSESYDDFTASLPENDCRYAVFDFDFVTAENCQKSKIFFIAWSPSVARIRPKMLYATSKDRFRRELQGIHYEIQATDPTEMELEVLQERAN

SEQ ID NO: 3762 - protein, 146 aa, Euonymus alatus
MAFRGFGRPNASSGMGVADHSKNAFTELQRKKVYRYVIFKIDEKKREVVVEKTGGPAESYEDFTAALPENDCRYAVYDFDFVTSENCQKSKIFFIAWSPSSSGIRAKMLYATTKDTFRRELDGIHYEIQATDPTEMDLDVIRDRAN

SEQ ID NO: 3763 - protein, 146 aa, Glycyrrhiza uralensis
MSFRGLNRPNASSGMGVAEHSKNTFMELKQKKVHRYVIFKVDEKKREVVVEKTGGPAESYDDFTASLPENDCRYAVFDFDFVTSENCQKSKIFFIAWSPSTSRIRAKMLYATTKDRFRRELDGVHYEIQATDPTEMDLEVIRDRAH

SEQ ID NO: 3764 - protein, 146 aa, Lotus japonicus
MSFRGFGRANASSGMGVADHSKNTFMELKQKKVHRYVIFKVDEKKREVVVEKTGGPAESYDDFAASLPENDCRYAVFDFDFVTSENCQKSKIFFIAWSPSTSRIRAKMLYATTKERFRRELDGVHYEIQATDPTEMDLEVIKDRAH

SEQ ID NO: 3765 - protein, 146 aa, Cajanus cajan
MSFRGLTRPNASSGMGVADHSKNTFMELKQKKVHRYVIFKVDEKKREVVVEKTGGPAESYDDFTASLPENDCRYAVFDFDFVTSENCQKSKIFFIAWSPSTSRIRAKMLYATTKDRFRRELDGVHYEIQATDPTEMDLEVLRDRAH

SEQ ID NO: 3766 - protein, 146 aa, Populus trichocarpa
MNFRGASRANASSGMGVADHSKNTFIELQRKKAHRYVIFKIEEKKMEVVVEKTGEPAESYEDFAASLPDNDCRYAVYDFDFVTSENCQKSKIFFIAWSPSTSRIRAKVLYATSKERFRRELNGIHYDIQATDPTEMDLEVIRDRAN

SEQ ID NO: 3767 - protein, 146 aa, Tripterygium wilfordii
MSFRGFGRPNASSGMGVADHSKNAFTELQRKKVYRYVIFKIDEKKREVVVEKTGGPAESYEDFAAALPENDCRYAVYDFDFVTSENCQKSKIFFVAWSPSSSRIRAKMLYATSKDRFRRELDGIHYEIQATDPTEMDLDVIKDRAN

SEQ ID NO: 3768 - protein, 145 aa, Olea europaea
MSFRIRGQNASSGMGVADHSKHTFLELKRKKVYRYVIFMIDEKKSEVVVEKTGGPAESYSDFTASLPENDCRYAVYDFDFVTSENCQKSKIFFISWSPETSRIRAKMLYSTSKDRLRRELDGVHYEIQATDPTEMDLEVIKDRAH

SEQ ID NO: 3769 - protein, 145 aa, Solanum lycopersicum
MSFRIRGTNASSGMGVADQSKATYMELQRKKVHRYVIFMIDEKKNEVVVEKTGGPAESYDDFTAALPENDCRYAVYDYDFVTPDNCQKSKIFFFAWSPSVSRIRSKMLYATSKDRFRRELQGIHYEIQATDPTEVELEVLKERAY

SEQ ID NO: 3770 - protein, 132 aa, Cannabis sativa
MGVADHSKNAFMELQRKKVHRYVIFKVDEKKREILVDKTGGPAENYDDFTAALPENDCRYAVYDYDFVTSDNCQKSKIFFIAWSPSTARIRSKMLYATSKDRFRRELEGIHYEIQATDPTEMDLEVIKERAN

SEQ ID NO: 3771 - protein, 146 aa, Quercus alba
MSYRWLSRPNASSGMGVADHTKNTFLELKRKKVHRYVIFKVDEGKKEVVVEKTGGPAESYDDFTAALPENDCRYAVYDYDFVTSDNCQKSKIFFIAWAPSSSRIRAKMLYATSRDRFRRELDGVHYEIQATDPTEMDLEVIKDRAH

SEQ ID NO: 3772 - protein, 148 aa, Elaeis guineensis
MSFRSLSLRSSNASSGMGVADDSKSTFLELKRKKVHRYVIFMIDEKKKEVVVEKTGGPGESYDDFTAALPVNDCRYAVYDFDFVTEDNCQKSKIFFISWSPSVSRIRSKMLYATSKDRFRHELDGVHYEIQATDPTEMDLEVLRDRAN

SEQ ID NO: 3773 - protein, 147 aa, Trigonella foenum-graecum
MAFRLGVGGGNASSGMGVAEHSVSTFQELQRKKVYRYVIFKIDEKKKEVVVEKTGGPAESYDDLTASLPENDCRYAVFDFDFVTAENCQKSKIFFIAWSPSVARIRPKMLYATSKDRFRRELQGVHYEIQATDPTEMELEVLQERVN

SEQ ID NO: 3774 - protein, 66 aa, Valeriana officinalis
MSFRFRGQNASSGMGVADDSLKTFMELKRKKVHRYVIFKVMRRKMRLSSKKPAVQLKATMIFLSIT

SEQ ID NO: 3775 - protein, 139 aa, Aquilegia formosa
SSNASSGMGVSDHSTTTFMELQRKKVHRYVIFKIDEKKKEVVVDKTGGPAESYDDFTSSLPENDCRYAVYDFDYVTSDNCQKSKIFFIAWSPATSRIRAKMLYATSKDRFRRVLDGIHYEIQATDPTEMDLEVIRDRAN

SEQ ID NO: 3776 - protein, 146 aa, Vigna unguiculata
MSFRGLSRPNASSGMGVADHSKNTFMELKQKKVHRYVIFKVDEKKREVVVEKTGGPAESYDDFAASLPENDCRYAVFDFDFVTSENCQKSKIFFIAWSPSTSRIRAKMLYATTKDRFRRELDGVHYEIQATDPTEMDLEVLRDRAH

SEQ ID NO: 3777 - protein, 146 aa, Cyamopsis tetragonoloba
MSFRGLTRPNASSGMGVADHSKNTFLELKQKKVYRYVIFKVDEKKREVVVEKTGGPAESYDDFTASLPENDCRYAVFDFDFVTAENCQKSKIFFIAWSPSTSRIRAKMLYATTKDTIKRELDGIHYEIQATDPTEMDLEVLRDRAH

SEQ ID NO: 3778 - protein, 146 aa, Euonymus alatus
MAFRGFGRPNASSGMGVADHSKNAFMELQRKKVYRYVIFKIDEKKREVVVEKTGRPAESYEDFTAALPENDCRYAVYDFDFVTSENCQKSKIFFIAWSPSSSMIRAKMLYATTKDTFRRELDGIHYEIQATDPTEMDLDVIRDRAN

SEQ ID NO: 3779 - protein, 145 aa, Elaeis guineensis
MALLRSYSNASSGMGVADHCKDTFLDLQRKKTHRYVIFKINEKQKEVVVEKTGGPAESYDDFMASLPENDCRYAVYDFDFVTDENCQKSKIFFIAWSPSVSRIRAKMLYATSKDRFRRELDGIHYEIQATDPSEMDLEVLRDRAH

SEQ ID NO: 3780 - protein, 146 aa, Ambrosia trifida
MSFRFRGGKNASSGMGVADHCKGTFLELQRKKAHRYVIFKIDEKKNEVVVEKTGNPAESYDDFTSALPENDCRYAVFDFDFVTSENCQKSKIFFIAWSPATSRIRAKMLYATSKDRLRHELDGVHYEIQATDPTEMDLEVLRERVY

SEQ ID NO: 3781 - protein, 147 aa, Trifolium pratense
MAFRMGVGGGNASSGMGVAEHSVTTFQELQRKKVHRYVIFKIDEKKKEVVVEKTGGPAESYDDFTASLPENDCRYAVFDFDFVTAENCQKSKIFFIAWSPSVARIRPKMLYATSKDRFRRELQGIHYEIQATDPTEMELEVLIDRAN

SEQ ID NO: 3782 - protein, 147 aa, Trifolium pratense
MAFRVGVGGGNASSGMGVAEHSVSTFQELQRKKVHRYVIFKIDEKKKEVVVEKTGGPAESYDDFTASLPENDCRYAVFDFDFVTAENCQKSKIFFISWSPSVARIRPKMLYATSKDRFRRELQGIHYEIQATDPTEMELEVLIERAN

SEQ ID NO: 3783 - protein, 147 aa, Phaseolus vulgaris
MAFRVGGGGGNASSGMGVDEHSVNTFLELQRKKVHRYVVFKIDEKKQEVVVEKTGGPAESYDDFTASLPESDCRYAVYDFDFVTSENCQKSKIFFVAWSPSVARIRSKMLYATSKDRFRRELQGIHYEIQATDPTEMDLEVLRERAN

SEQ ID NO: 3784 - protein, 146 aa, Phaseolus vulgaris
MSFRGLSRPNASSGMGVADDSKNTFMELKQKKVHRYVIFKVDEKKREVVVEKIGGPAESYDDFAASLPENDCRYAVFDFDFVTSENCQKSKIFFIAWSPSTSRIRAKMLYATTKERFRRELDGVHYEIQATDPTEMDLEVLRDRAH

SEQ ID NO: 3785 - protein, 146 aa, Lupinus angustifolius
MSFRGITRPNASSGMGVADHSKNVFMELKQKKVYRYVIFKVDEKKKEIVVEKTGGVAESYDDFTASLPENDCRYAVYDFDFVTSENCQKSKIFFIAWSPSTSRIRAKMLYATSKDRIKHELDGFHYEIQATDPTEMDLEVLRDRAH

SEQ ID NO: 3786 - protein, 146 aa, Trigonella foenum-graecum
MSFRGLSRPNASSGMGVDENSKNTFMELKQKKVHRYVIFKVDEKKREVVVEKTGGPAESYDDFVASLPENDCRYAVFDFDFVTSENCQKSKIFFIAWSPSTSRIRAKMLYATSKERFRRELDGVHYEIQATDPTEMDLEVLRDRAH

SEQ ID NO: 3787 - protein, 148 aa, Cocos nucifera
MSFRSLSLRSSNASSGMGVAEDSKSTFLELKRKKVHRYVIFMIDEKKKEVVVEKTGGPGESYDDFTAALPVNDCRYAVYDFDFVTEDNCQKSKIFFISWSPSVSRIRSKMLYATSKDRFRHELDGVHYEIQATDPSEMDLEVLRDRAN

SEQ ID NO: 3788 - protein, 145 aa, Nicotiana benthamiana
MSFRFRGPNASSGMGVADHGKNAFLELKRKKVHRYVIFKIDEKKKEVIVEKTGSPAENFDDFTASLPENDCRYAVYDFDFVTSENCQKSKIFFVHWSPATSRIRAKMLYATSKDAFRRELDGFHYEIQATDPTEVDLEVLKDRAH

SEQ ID NO: 3789 - protein, 145 aa, Elaeis guineensis
MALLRSSSSASSGMGVADHCKDTFLELQRKKTHRYVIFKIDEKRKEVVVDKTGGAAESYDDFMASLPENDCRYAIYDFDFVTDENCQKSKIFLIAWSPSVSRIRAKMLYATSKDRFRRELDGIHYEIQATDPTELDLEVLRDRAH

SEQ ID NO: 3790 - protein, 72 aa, Papaver somniferum
MGVADHFKDTFLELKRKKVHRYVVFKIDEKKKEVVVEKTGGPAESYDDFTEALPENDCRYAVYDFDYVTSEN

SEQ ID NO: 3791 - protein, 146 aa, Trifolium pratense
MSFRGLSRPNASSGMGVDENSKNTFMELKQKKVHRYVIFKVDEKKREVVVEKTGGPAESYDDFAASLPENDCRYAVFDFDFVTSENCQKSKIFFIAWSPSTSRIRAKMLYATTKERFRRELDGVHYEIQATDPTEMDLEVLRDRAH

SEQ ID NO: 3792 - protein, 146 aa, Prunus mume
MSFRGLSRPNASCAMGVSDDSKKTFMELQRKKVHRYVIFKVDEKKREVVVEKIGGPAESYDDFVAALPENDCRYAVYDFDFVTSENCQKSKIFFIAWSPSTSRIRAKMLYATSKDRFRRELDGIHYEIQATDPSEMDLEVLRDRAH

SEQ ID NO: 3793 - protein, 146 aa, Prunus persica
MSFRGLSRPNASCAMGVSDDSKNTFMELQRKKVHRYVIFKVDEKKREVVVEKIGGPAESYDDFAAALPENDCRYAVYDFDFVTSENCQKSKIFFIAWSPSTSRIRAKMLYATSKDRFRRELDGIHYEIQATDPSEMDLEVLRDRAH

SEQ ID NO: 3794 - protein, 145 aa, Solanum lycopersicum
MSFKFRGPNASSGMGVADHGKNAFLELKRKKVHRYVIFKIDEKKKEVVVEKTGSPAETFDDFTASLPENDCRYAVYDFDFVTSENCQKSKIFFVHWSPATSRIRAKMLYATSKDAFKRELDGFHYEIQATDPTEVDLEVLKDRAH

SEQ ID NO: 3795 - protein, 830 aa, Oryza sativa
MEAFGGFFVDEKAARVENIFLEFLRRFKEADAAEAFYETELEAMRSRESTTMYVDFAHVMRFNDVLQKAISEEYLRFEPYLRNACKRFVMEQRTGENRAPIISDDSPNKDINIAFYNIPMLKRLRELGTAEIGKLTAVMGVVTRTSEVRPELLQGTFKCLDCGNVVKNVEQQFKYTEPIICVNATCQNRSKWALLRQESKFTDWQRVRMQETSKEIPAGSLPRSLDVILRHEIVEKARAGDTVIFTGTVAAVPDVMALTSPGERAECRREAPQRKNGSGVQEGVKGLKSLGVRDLSYRLAFVANSVQVADGRREVDIRDRDIDGDDSERQKFTEEEEDEVVRMRNVPDFFNKIVDSICPTVFGHQEIKRAILLMLLGGVHKITHEGINLRGDINVCIVGDPSCAKSQFLKYTAGIVPRSVYTSGKSSSAAGLTATVAKEPETGEFCIEAGALMLADNGICCIDEFDKMDIKDQVAIHEAMEQQTISITKAGIQATLNARTSILAAANPTGGRYDKSKPLKYNVALPPAILSRFDLVYIMIDEPDENTDYHIAHHIVRVHQKREEALAPAFSTAELKRYIAFAKSLKPQLSSEAKKVLVESYVTLRRGDSTPGTRVAYRMTVRQLEALIRLSEAIARSHLERVVLPAHVRMAVKLLKTSIISVESSEVDLSDFQDADDGTNVPADNDAGQPTEMDAAPQQDGPENEQAADTGKKKLVITEEHFQRVTQALVMRLRQHEESVTKDGDGLAGMKQGDLIIWYVEQQNAQGAYSSTAEVKEEVKCIKAIIERLIQRDGHLIVIDEGAAPAADDGAARRTSESRILAVNPNYVID

SEQ ID NO: 3796 - protein, 826 aa, Brachypodium distachyon
MEAFGGFFVDEKAARVENIFLEFLKRFKEPDAAEPFYDMEMEQMRSRESTTMYVDFAHVMRFNDVLQKAISEEYLRFEPYLRNACKRFVMEQRAGENRAPIISDDSPNKDINISFYNIPMLKRLRELGTAEIGKLTAVMGVVTRTSEVRPELLQGTFKCLDCGNVVKNVDQQFKYTEPIICVNATCQNRTKWALLRQDSKFTDWQRVRMQETSKEIPAGSLPRSLDVILRHEIVEKARAGDTVIFTGTVVAVPDVMALTSPGERAECRREGPQRKNGSGVQEGVKGLKSLGVRDLSYRLAFVANSVQVADGRREVDIRDRDIDGDDSERQKFTEEEEDEVVRMRNTPDFFNKIVDSICPTVFGHQEIKRALLLMLLGGVHKITHEGINLRGDINVCIVGDPSCAKSQFLKYTAGIVPRSVYTSGKSSSAAGLTATVAKEPETGEFCIEAGALMLADNGICCIDEFDKMDIKDQVAIHEAMEQQTISITKAGIQATLNARTSILAAANPTGGRYDKSKPLKYNVALPPAILSRFDLVYIMIDEPDENTDYHIAHHIVRVHQKREEALSPAFSTAELKRYFAFAKSLKPQLSSEAKKVLVESYVVLRRGDSTPGTRVAYRMTVRQLEALIRLSEAIARSHLERIVLPAHVRMAVKLLKTSIISVESSEVDLSDFQDAEDGTNVPADNDPEQPEEPHQPEEPQQMDAADAGKKKLVITEEHFQRVTQALVMRLRQHEESIMKDGDGLAGMKQGDLIIWYVEQQNAQGAYSSTEEVKEEVKCIKAIIERLIQREGHLIVIDEGAAGDGVAAQRRPSENRILAVNPNYVID

SEQ ID NO: 3797 - protein, 818 aa, Hordeum vulgare
MEAFGGFFVDEKAARVENIFVEFLKRFKEPDAAEPFYDVEMEAMRSRESTTMYVDFAHVMRFNDVLQKAISEEYLRFEPYLRNACKRFVMEHRAGENRAPIISDDSPNKDINIAFYNIPMLKRLRELGTAEIGKLTAVTGVVTRTSEVRPELLQGTFKCLDCGNVVKNVDQQFKYTEPIICVNATCQNRSRWALLRQDSKFTDWQRVRMQETSKEIPAGSLPRSLDVILRHEIVEKARAGDTVIFTGTVVAVPDVMALTSPGERAECRREGPQRKNGSGVQEGVKGLKSLGVRDLSYRLAFVANSVQVADGRRDVDIRDRDIDGDGSERQKFTEEEEDEVVRMRNTPDFFNKIVDSICPTVFGHQEIKRALLLMLLGGVHKITHEGINLRGDINVCIVGDPSCAKSQFLKYTAGIVPRSVYTSGKSSSAAGLTATVAKEPETGEFCIEAGALMLADNGICCIDEFDKMDIKDQVAIHEAMEQQTISITKAGIQATLNARTSILAAANPTGGRYDKSKPLKYNVALPPAILSRFDLVYIMIDEPDENTDYHIAHHIVRVHQKREEALSPAFSTAELKRYFAFAKSLKPQLSSEAKKVLVESYVVLRRGDSTPGTRVAYRMTVRQLEALIRLSEAIARSHLERIVLPAHVRMAVKLLKTSIISVESSEVDLSDFQDAPLDNDDEQPVQGDATAQDGPDEPAEVIKKKLVITEEHFQRVTQALVMRLRQHEESVKKDGDGLAGMKQGDLIIWYVEQQNAQGAYSSTEEVKEEVKCIKAIIERLIQREGHLVVIDEGTAAEGAAARSSEHRILAVNPNYVID

SEQ ID NO: 3798 - protein, 352 aa, Secale cereale
MEAFGGFFVDEKAARVENIFLEFLKRFKEADAAEPFYDVEMEAMRSRESTTMYVDFAHVMRFNDVLQKAISEEYLRFEPYLRNACKRFVMEHRAGENRAPIISDDSPNKDINIAFYNIPMLKRLRELGTAEIGKLTAVTGVVTRTSEVRPELLQGTFKCLDCGNVVKNVDQQFKYTEPIICVNATCQNRSRWALLRQDSKFTDWQRVRMQETSKEIPAGSLPRSLDVILRHEIVEKARAGDTVIFTGTVVAVPDVMALTSPGERAECRREGPQRKNGSGVQEGVKGLKSLGVRDLSYRLAFVANSVQVADGRRDLDIRDRDIDGDGSERQKFTEEEEDEVVRMRNTPDFSIR

SEQ ID NO: 3799 - protein, 833 aa, Cocos nucifera
MDAFGGFFVDEKAVRVENIFLEFLKRFKLDPNAVEPFYESEIEAMRSKESTTMYVDFSHVMRFNDVLQKAIAEEYLRFEPYLRNACKRFVMEHKSSENRPAIISDDSPNRDINVAFYNIPLLKRLRDLTTSEIGKLTSVMGVVTRTSEVRPELLQGTFKCLECGGVVKNVEQQYKYTEPIICMNATCANRTNWALLRQESKFTDWQRVRMQETSKEIPAGSLPRSLDVILRHEIVEKARAGDTVIFTGTLVAVPDVMALTSPGERAECRREAPQRRNASAGEGVRGLRALGVRDLSYRLAFIANSVQLADGRRDGDIRDRRMDGDENDKQEFTQEEEDEVMRMRNTPDFFNKLVDSICPTVFGHQEIKRAVLLMLLGGVHKLTHEGINLRGDVNVCIVGDPSCAKSQFLKYTASLVPRSVYTSGKSSSAAGLTATVAKEPETGEFCIEAGALMLADNGICCIDEFDKMDIRDQVAIHEAMEQQTISITKAGIQATLNARTSILAAANPTGGRYDKSKPLKYNVALPPAILSRFDLVYVMIDEPDENTDYHIAHHIVRVHQKREDALAPAFTTAELKRYITYAKSLKPQLSSEAKKVLVESYVTLRRGDSTPGTRVAYRMTVRQLEALIRLSEAIARCHLEKVVLPAHVRMAVRLLKTSIISVESSEIDLSDFQDHEDGDGNRASDQAAAEPAPANVDQVPENEGNEQGADSRQKKKLVITEDHFQRVTQALVMRLRQHEEAVMQDGSGLAGMKQGDLIVWYVEQQNAQGAYSSTDEVREEVKCIKAIIERLIQREGHLIVIDDGTGSAAVDGGEARRSSENRILAVAPNYVID

SEQ ID NO: 3800 - protein, 715 aa, Ananas comosus
MEGFSGFFVDEKAVRVENIFLEFLKRFKLDPNATEPLYEAEIEAMRSKESTTMYVDFSHVMRFNDVLQKAISEEYLRFEPYLRNACKRFVMEQKSGPSIIPDDSPNKDINVAFYNIPLLKRLRDLKTSEIGKLTSVMGVVTRTSEVRPELLQGNFKCLECGNVAKNVEQQFKYTEPIICTNATCQNRAKWALLRQESKFTDWQRMRMQETSKEIPAGSLPRSLDVILRHEMVEKARAGDTVIFTGMVVAVPDVMALTSPGERAEVRREASQRRNGGSGHEGVRGLKSLGVRDLSYRIAFIANSVQVTDGRRDGDLRDRKLDGDDTDRQEFTQEEEEEVFRMRDTPDFFNKLVDSICPTVFGHQEIKRAILLMLLGGVHKITHEGTNLRGDINVCIVGDPSCAKSQFLKYVAGLVPRSVYTSGKSSSAAGLTATVAKEPETGEFCIEAGALMLADNGICCIDEFDKMDIRDQVAIHEAMEQQTISITKAGIQATLNARTAILAAANPTGGRYDKTKPLKYNVALPPAILSRFDLVYIMIDEPDDNTDYHIAHHIVRVHQKREDALAPPFTTAELKRYFAYAKSLKPQLSSEARKVLVESYVALRRGDTTPGTRVAYRMTVRQLEALIRLSEAIARSHLYKVVLPAHVRMAVRLLKTSIISVESSEIDLSDFQDNEDAGGNRVADQEIAAPTENAHPAPENEGDAQGSEGQQKKKWL

SEQ ID NO: 3801 - protein, 860 aa, Musa acuminata
MDAFGGFFVDEKAIRVENIFLEFLKRFKHDPNAVEPFYEAEIEAMRHKESTTMYVDFSHVMRFNDVLQKAISEEYLRFEPYLRNACMRFVMEQKSSENRQPIIADDNPNRDINVAFYNIPLLKRLRDLTTSEIGKLTSVMGVVTRTSEVRPELLQGTFKCLECGGVIKNVEQQYKYTEPIICMNATCANRNKWALLRQESKFTDWQRVRMQETSKEIPAGSLPRSLDVILRHEIVEKARAGDTVIFTGTLVAVPDIMALTSPGERAECRREAPQRQNVSGGHGGVSGLKALGVRDLSYRLAFIANSVQIADGRGDGDIRDRKIDVDDSDKQEFTQEEEDEVMRMRNTPDFFNKLVDSICPTVFGHQEIKRAVLLMLLGGVHKLTHEGINLRGDINVCIVGDPSCAKSQFLKYTSNLVPRSVYTSGKSSSAAGLTATVAKEPETGEFCIEAGALMLADNGICCIDEFDKMDIRDQVAIHEAMEQQTISITKAGIQATLNARTSILAAANPTGGRYDKSKPLKYNVALPPAILSRFDLVYIMIDEPDENTDYHIAHHIVRVHQKREDALAPAFTTAELKRYIAYAKSLKPQLSSEAKNVLVESYVALRRGDSTPGTRVAYRMTVRQLEALIRLSEAIARSHLENVVLPAHVRVAVKLLKTSIIRQEDFFRYQQKFKVVSSGFLKSFVYTYSVESSEIDLSDFQDHEDGVAVNVPDQDAAELASDGISPATENGGNEQGSESHQKKKLVITEEHFQRVTQALVMRLRQHEEAVAQDGSGLAGMKQGDLIIWYVEQQNAVGAYSNTDEVREEVKCIKAIIERLIQREGHLIVIDDGTSSAASDGQARRSSENRILAVAPNYIVE

SEQ ID NO: 3802 - protein, 860 aa, Musa acuminata
MDAFGGFFVDEKAIRVENIFLEFLKRFKHDPNAVEPFYEAEIEAMRHKESTTMYVDFSHVMRFNDVLQKAVSEEYLRFEPYLRNACMRFVMEQKSSENRQPIIADDNPNRDINVAFYNIPLLKRLRDLTTSEIGKLTSVMGVVTRTSEVRPELLQGTFKCLECGGVIKNVEQQYKYTEPIICMNATCANRNKWALLRQESKFTDWQRVRMQETSKEIPAGSLPRSLDVILRHEIVEKARAGDTVIFTGTLVAVPDIMALTSPGERAECRREAPQRQNVSGGHGGVSGLKALGVRDLSYRLAFIANSVQIADGRGDGDIRDRKIDVDDTDKQEFTQEEEDEVMRMRNTPDFFNKLVDSICPTVFGHQEIKRAVLLMLLGGVHKLTHEGINLRGDINVCIVGDPSCAKSQFLKYTSNLVPRSVYTSGKSSSAAGLTATVAKEPETGEFCIEAGALMLADNGICCIDEFDKMDIRDQVAIHEAMEQQTISITKAGIQATLNARTSILAAANPTGGRYDKSKPLKYNVALPPAILSRFDLVYIMIDEPDENTDYHIAHHIVRVHQKREDALAPAFTTAELKRYIAYAKSLKPQLSSEAKNVLVESYVALRRGDSTPGTRVAYRMTVRQLEALIRLSEAIARSHLENVVLPAHVRVAVKLLKTSIIRQEDFFRYQQKFKVVSSGFLKSFVYTYSVESSEIDLSDFQDHEDGVAVNVPDQDAAELASDGISPAAENGGNEQGSESHQKKKLVITEEHFQRVTQALVMRLRQHEEAVAQDGSGLAGMKQGDLIIWYVEQQNAVGAYSNTDEVREEVKCIKAIIERLIQREGHLIVIDDGTSSAASDGQARRSSENRILAVAPNYIVE

SEQ ID NO: 3803 - protein, 525 aa, Gossypium raimondii
MKRTATKKKRRPRAAKTSAVNDSSRHALSQRDQRREGEGEGEDDEEQKRLLGSLMEAFGSISLEEATSAYNQADGDLDKAAEILSNLIDNGSNSEDPDPSTSSISSGSSSSGSSGFGFSETSCVQNLNSGRGRSRGGKQQKRVVASTGTVSTVLGKDYVRSSPWRDPAAVAPAKSVLATEEAEQFLCSMLGEECELSMAVVRDVLCLCGYNVEKALDALLDLSASSYEKSKSFNDNLNSRQDTGFVIECADNLTDRTSDRISKLLESELQDSIWSAGYGHRNYSKVLASSEAMQPPCPRSNVSNLPQEVLDSLFKIPKSSEHEPSTMSWRNVVKKMQLLGPPIDFCPSTDAEPQQDIYAKGDEYHKFRESAKEHWDSMRSYYQKAATAYSKGELEYAAYLSDQGKIQTKLAREADERASQNIFKARNKAFENVITIDLHGQHVKQAMKLLKLHLLFGIHVPSVQTLRVITGCGTHGMGKSKLKQSVTKLLEKEGIQWQEENRGTVLIKLDGYRELSFLESNSDTE

SEQ ID NO: 3804 - protein, 523 aa, Gossypium hirsutum
MKRTATKKKRRPRAAKTSAVNDSSRHALSQRDQRREGEGEDDEEQKRLLGSLMETFGSISLEEATSAYNQADGDLDKAAEILSNLIDNGSNSEDPDPSTSSISSGSSSSGSSGFGFSETSCVQNLNSGRGRSRGGKQQKRVVASTGTVSTVLGKDYVRSSPWRDPAAVAPAKSVLATEEAEQFLCSMLGEECELSMAVVRDVLCQCGYNVEKALDALLDLSASSYEKSKSFNDKLNSRQDTGFVIECADNLTDRTSDRISKLLESELQDSIWSAGYGHRNYSKVLASSEAMQPPCPRSNVSNLPQEVLDSLFKIPKSSEHEPSTMSWRNVVKKMQLLGPPIDFCPSTDAEPQQDLYAKGDEYHKFRESAREHWDSMRSYYQKAATAYSKGELEYAAYLSDQGKIQTKLAREADERASQNIFKARNKAFENVITIDLHGQHVKQAMKLLKLHLLFGIHVPSVQTLRVITGCGTHGMGKSKLKQSVTKLLEKEGIQWQEENRGTVLIKLDGYRELSFLESNSDTE

SEQ ID NO: 3805 - protein, 310 aa, Pennisetum glaucum
MKVTVVSRSGREVVKGGIDLKDFAKVADLQEAIHARTKKYYPARQRLTLPLQPGKGGKPVVLNPKASLSEYCEKGSGSLTVVFKDLGPQVYYSTLFFFEYLGPLIIYPMFYYLPVYKFFGYEGERVIHPVQTYAMYYWCFHYFKRIMETFFVHRFSHATSPLSNVFRNCAYYWTFGAYIAYYCNHPLYTPVSDLQMKIGFGFGIICQIANFYCHILLRNLRSPSGNGGYQIPRGFLFNIVTCANYTTEIYQWVGFNIATQTVAGYIFLVVAASIMTNWALGKHSRLKKLFDGKDGRPKYPRRWVILPPFL

SEQ ID NO: 3806 - protein, 310 aa, Saccharum officinarum
MKVTVVSRSGREVVKGGIDLKDSAKVADLQEAIHARTKKYYPSRQRLTLPIQPGKGGKPVVLNPKASLSEYCEKGSGSLTVVFKDLGPQVYYSTLFFFEYLGPLIIYPMFYYLPVYKYFGYEGERVIHPVQTYAMYYWCFHYFKRIMETFFVHRFSHATSPLSNVFRNCAYYWTFGAYIAYYCNHPLYTPVSDLQMKIGFGFGIVCQIANFYCHILLRNLRSPSGSGGYQIPRGFLFNIVTCANYTTEIYQWVGFNIATQTVAGYIFLVVAAAIMTNWALGKHSRLKKLFDGKDGRPKYPRRWVILPPFL

SEQ ID NO: 3807 - protein, 310 aa, Echinochloa colona
MKVTVVSRSGREVVKGGIDLKDSAKVADLQEAIHARTKKYYPSRQRLTLPLQPGKSGKPVVLSPKASLSEYCEKGSGSLTVVFKDLGPQVYYSTLFFFEYLGPLFIYPMFYYLPVYKFFGYDGERVIHPVQTYAMYYWCFHYFKRIMETFFVHRFSHATSPLSNVFRNCAYYWTFGAYIAYYCNHPLYTPVSDLQMKIGFGFGIICQIANFYCHILLRNLRSPSGSGGYQIPRGFLFNIVTCANYTTEIYQWVGFNIATQTVAGYIFLVVAASIMTNWALGKHSRLKKLFDGKDGRPRYPRRWVILPPFL

SEQ ID NO: 3808 - protein, 310 aa, Sorghum bicolor
  Sequence also found in Organisms: Triticum aestivum
MKVTVVSRSGREVVKGGIDLKDSAKVADLQEAIHARTKKYYPSRQRLTLPLQPGKGGKPVVLNPKASLSEYCEKGSGSLTVVFKDLGTQVYYSTLFFFEYLGPLIIYPMFYYLPVYKYFGYEGERIIHPVQTYAMYYWCFHYFKRIMETFFVHRFSHATSPLSNVFRNCAYYWTFGAYIAYYCNHPLYTPVSDLQMKIGFGFGIICQIANFYCHILLRNLRSPSGSGGYQIPRGFLFNIVTCANYTTEIYQWVGFNIATQTVAGYIFLIVAAAIMTNWALGKHSRLKKLFDGKDGRPKYPRRWVILPPFL

SEQ ID NO: 3809 - protein, 310 aa, Panicum virgatum
MKVTVVSRSGREVVKGGIDLKESAKVADLQEAIHARTKKYYPSRQRLTLPLQPGKSGKPVVLSPKASLSEYCEKGSGSLTVVFKDLGPQVYYSTLFFFEYLGPLIIYPMFYYLPVYKFFGYEGERVIHPVQTYAMYYWCFHYFKRIMETFFVHRFSHATSPLSNVFRNCAYYWTFGAYIAYYCNHPLYTPVSDLQMKIGFGIGIICQIANFYCHILLRNLRSPSGSGGYQIPRGFLFNIVTCANYTTEIYQWVGFNIATQTVAGYIFLVVAASIMTNWALGKHNRLKKLFDGKDGRPKYPRRWVILPPFL

SEQ ID NO: 3810 - protein, 310 aa, Echinochloa colona
MKVAVVSRSGREVVKGGIDLKDSAKVADLQEAIHARTKKYYPSRQRLTLPLQPGKSGKPVVLSPKASLSEYCEKGSGSLTVVFKDLGPQVYYSTLFFFEYLGPLFIYPMFYYLPVYKFFGYDGERVIHPVQTYAMYYWCFHYFKRIMETFFVHRFSHATSPLSNVFRNCAYYWTFGAYIAYYCNHPLYTPVSDLQMKIGFGFGIICQIANFYCHILLRNLRSPSGSGGYQIPRGFLFNIVTCANYTTEIYQWVGFNIATQTVAGYIFLVVAASIMTNWALGKHSRLKKLFDGKDGRPRYPRRWVILPPFL

SEQ ID NO: 3811 - protein, 310 aa, Zea mays
MKVTVVSRSGREVVKGGIDLKDSAKVADLQEAIHARTKKYYPSRQRLTLPLQPGKGGKPVVLSPKASLLEYCEKGSGSLTVVFKDLGPQVYYSTLFFFEYLGPLIIYPMFYYLPVYKYFGHEGERAMHPVQTYAMYYWCFHYFKRIMETFFVHRFSHATSPLSNVFRNCAYYWTFGAYIAYYCNHPLYTPVSDLQMKIGFGFGVVCQVANFYCHILLRNLRSPSGSGGYQIPRGFLFNIVTCANYTTEIYQWVGFNIATQTVAGYVFLVVAAGIMTNWALGKHSRLKKLFDGKDGRPKYPRRWVILPPFL

SEQ ID NO: 3812 - protein, 310 aa, Oryza sativa
MKVSVVSRSGREVVRGGVELKDSAKVADLQDAIYAKTKKYYPARQRLTLPIQPGKSGKPVVLSAKASLSEYCEKGSGSLTVVFKDLGPQVFYSTLFFFEYLGPLLIYPMFYYLPVYKYFGYEGERVMHPVQTYAMYYWCFHYFKRIMETFFVHRFSHATSPVSNVFRNCAYYWTFGAYIAYYCNHPLYTPVSELQMKIGFGFGILCQIANFYCHILLRNLRSPSGNGGYQIPRGFLFNIVTCANYTTEIYQWLGFNIATQTVAGYIFLVVAASIMTNWALGKHRRLKKLFDGKEGRPKYPRRWVILPPFL

SEQ ID NO: 3813 - protein, 310 aa, Brachypodium distachyon
MKVSVVSRSGREVVRGGIDLPDSAKVADLQEAIHAKTKKYYPARQRLTLPLQPGKSGKPVVLSPKSSLSEYCEKGSGSLKVVFKDLGPQVYYSTLFFWEYVGPLIIYPIFYYLPVYKYFGYEGERVIHPVQTYAMYYFCFHYFKRIMETFFVHRFSHATSPVSNVFRNCAYYWTFGAYIAYYCNHPLYTPVSDLQMKIGFGFGIVCQIANFYCHILLRNLRSPTGSGGYQIPRGFLFNIVTCANYTTEIYQWLGFNIATQTVAGYVFLAVAAAIMTNWALGKHSRLRKLFDGKDGRPKYPRRWVILPPFL

SEQ ID NO: 3814 - protein, 310 aa, Triticum aestivum
MKVSVVSRSGREVVKGGIELKDSAKVADLQEAIHAKTKKYYPARQRLTLPAQPGKSGKPVVLNQKASLSEYCEKGSGSLTVVFKDLGPQVYYSTLFFWEYVGPLIIYPIFYYLPVYKYFGYEGERVIHPVQTYAMYYFCFHYFKRIMETFFVHRFSHATSPVSNVFRNCAYYWTFGAYIAYYCNHPLYTPVSDLQMKIGFGIGVVCQIANFYCHILLRNLRSPTGSGGYQIPRGFLFNIVTCANYTTEIYQWLGFNIATQTVAGYVFLAVAAAIMTNWALGKHSRLRKLFDGKDGRPKYPRRWVILPPFL

SEQ ID NO: 3815 - protein, 310 aa, Triticum aestivum
MKVSVVSRSGREVVKGGIELKDSAKVADLQEAIHAKTKKYYPARQRLTLPAQPGKSGKPVVLSQKASLSEYCEKGSGSLTVVFKDLGPQVYYSTLFFWEYVGPLIIYPIFYYLPVYKYFGYEGERVIHPVQTYAMYYFCFHYFKRIMETFFVHRFSHATSPVSNVFRNCAYYWTFGAYIAYYCNHPLYTPVSDLQMKIGFGIGVVCQIANFYCHILLRNLRSPTGSGGYQIPRGFLFNIVTCANYTTEIYQWLGFNIATQTVAGYVFLAVAAAIMTNWALGKHSRLRKLFDGKDGRPKYPRRWVILPPFL

SEQ ID NO: 3816 - protein, 310 aa, Avena sativa
MKVAVVSRSGREVVKGGIQLTDSAKVADLQEAIHAKTKKYYPARQRLTLPVQPGKSGKPVVLSQKASLSDYCEKGSDSLTVVFKDLGPQIYYSTLFFWEYVGPLLIYPMFYYLPVYKYFGYEGERVIHPVQTYAMYYFCFHYFKRIMETFFVHRFSHATSPVSNVFRNCAYYWTFGAYIAYYCNHPLYTPVSDLQMKIGFAIGIVCQIANFYCHILLRNLRSPSGSGGYQIPRGFLFNIVTCANYTTEIYQWLGFNIATQTVAGYVFLAVAASIMTNWALGKHSRLRKLFDGKDGRPKYPRRWVILPPFL

SEQ ID NO: 3817 - protein, 310 aa, Avena sativa
MKVSVVSRSGREVVKGGIQLSDSAKVADLQEAIHAKTKKYYPARQRLTLPVQPGKSGKPVVLNQKASLSDYCEKGSGSLTVVFKDLGPQVYYSTLFFWEYVGPLFIYPMFYYLPVYKYFGYEGERVVHPVQTYAMYYFCFHYFKRIMETFFIHRFSHATSPVSNVFRNCAYYWTFGAYIAYYCNHPLYTPVSDLQMKIGFGIGVVCQIANFYCHILLRNLRSPTGSGGYQIPRGFLFNIVTCANYTTEIYQWLGFNIATQTVAGYVFLAVAAAIMTNWALGKHSRLRKLFDGKDGRPKYPRRWVILPPFL

SEQ ID NO: 3818 - protein, 310 aa, Avena sativa
MKVSVVSRSGREVVKGGIQLDDSAKVADLQEAIHAKTKKYYPARQRLTLPVQPGKSGKPVVLNQKASLSDYCEKGSGSLTVVFKDLGPQVYYSTLFFWEYVGPLFIYPMFYYLPVYKYFGYEGERVVHPVQTYAMYYFCFHYFKRIMETFFIHRFSHATSPVSNVFRNCAYYWTFGAYIAYYCNHPLYTPVSDLQMKIGFGIGVVCQIANFYCHILLRNLRSPTGSGGYQIPRGFLFNIVTCANYTTEIYQWLGFNIATQTVAGYVFLAVAAAIMTNWALGKHSRLRKLFDGKDGRPKYPRRWVILPPFL

SEQ ID NO: 3819 - protein, 310 aa, Lolium multiflorum
MKVSVVSRSGREVVKGGIQLSDDAKVADLQDAIHAKTKKYYPARQRLTLPVQPGKSGKPVVLNQKASLSDYCEKGSGSLTVVFKDLGPQVYYSTLFFWEYVGPLFIYPIFYYLPVYKYFGYEGERVIHPVQTYAMYYFCFHYFKRIMETFFVHRFSHATSPVSNVFRNCAYYWTFGAYIAYYCNHPLYTPVSDLQMKIGFGIGIVCQIANFYCHILLRNLRSPTGSGGYQIPRGFLFNIVTCANYTTEIYQWLGFNIATQTVAGYVFLAVAAAIMTNWALGKHSRLRKLFDGKDGRPKYPRRWVILPPFL

SEQ ID NO: 3820 - protein, 310 aa, Avena sativa
MKVAVVSRSGREVVKGGIQLHDSAKVADLQQAIHAKTKKYYPARQRLTLPAQPGKSGKPVVLNQKASLSDYCEKGSGSLTVVFKDLGPQVYYSTLFFWEYVGPLFIYPIFYYLPVYKYFGYEGERVVHPVQTYAMYYFCFHYFKRIMETFFVHRFSHATSPVSNVFRNCAYYWTFGAYIAYYCNHPLYTPVSDLQMKIGFGIGVVCQIANFYCHILLRNLRSPTGSGGYQIPRGFLFNIVTCANYTTEIYQWLGFNIATQTVAGYVFLAVAAAIMTNWALGKHSRLRKLFDGKDGRPKYPRRWVILPPFL

SEQ ID NO: 3821 - protein, 310 aa, Avena sativa
MKVSVVSRSGREVVKGGIQLADSAKVTDLQEAIHAKTKKYYPARQRLTLPVQPGKSGKPVVLSQKASLSDYCEKGSDSLTVVFKDLGPQVYYSTLFFWEYVGPLFIYPMFYYLPVYKYFGYEGERVVHPVQTYAMYYFCFHYFKRIMETFFVHRFSHATSPVSNVFRNCAYYWTFGAYIAYYCNHPLYTPVSDLQMKIGFGIGIVCQIANFYCHILLRNLRSPSGSGGYQIPRGFLFNIVTCANYTTEIYQWLGFNIATQTVAGYVFLAVAAAIMTNWALGKHSRLRKLFDGKDGKPKYPRRWVILPPFL

SEQ ID NO: 3822 - protein, 310 aa, Festuca arundinacea
MKVSVVSRTGRELVKGGIQLSDEAKVADLQEAIHANTKKYYPARQRLTLPVQPGKSGKPVVLNQKASLSDYCEKGSGSLTVVFKDLGPQVYYSTLFFWEYVGPLFIYPIFYYLPVYKYFGYEGERVIHPVQTYAMYYFCFHYFKRIMETFFVHRFSHATSPVSNVFRNCAYYWTFGAYIAYYCNHPLYTPVSDLQMKIGFGIGIVCQIANFYCHILLRNLRSPTGSGGYQIPRGFLFNIVTCANYTTEIYQWLGFNIATQTVAGYVFLAVAAAIMTNWALGKHSRLRKLFDGKDGRPKYPRRWVILPPFL

SEQ ID NO: 3823 - protein, 299 aa, Pseudoroegneria spicata
EVVKGGIELKDSAKVADLQEAIHAKTKKYYPARQRLTLPAQPGKSGKPVVLNQKASLSEYCEKGSGSLTVVFKDLGPQVYYSTLFFWEYVGPLIIYPIFYYLPVYKYFGYEGERVIHPVQTYAMYYFCFHYFKRIMETFFLHRFSHATSPVSNVFRNCAYYWTFGAYIAYYCNHPLYTPVSDLQMKIGFGIGVVCQIANFYCHILLRNLRSPTGSGGYQIPRGFLFNIVTCANYTTEIYQWLGFNIATQTVAGYVFLAVAAAIMTNWALGKHSRLRKLFDGKDGRPKYPRRWVILPPFL

SEQ ID NO: 3824 - protein, 202 aa, Panicum virgatum
MFYYLPVYKFFGYEGERVIHPVQTYAMYYWCFHYFKRIMETFFVHRFSHATSPLSNVFRNCAYYWTFGAYIAYYCNHPLYTPVSDLQMKIGFGFGIICQIANFYCHILLRNLRSPSGNGGYQIPRGFLFNIVTCANYTTEIYQWVGFNIATQTVAGYIFLVVAASIMTNWALGKHSRLKKLFDGKDGRPKYPRRWVILPPFL

SEQ ID NO: 3825 - protein, 310 aa, Ricinus communis
MKVTVVSRSGREVIKGGLDLNDSATVADLQEAIHKRTKKFYPSRQRLTLPLPPGSKDRPTVLNYKKSLKDYCDGNSDNITVVFKDLGPQVSYRTLFFFEYLGPLILYPVFYFFPVYKYFGYKEERVIHPVQTYAMYYWCFHYFKRIMETFFVHRFSHATSPLSNVFRNCAYYWTFGSYIAYYVNHPLYTPVGDLQMKIGFGFGLICQIANFYCHILLKNLRSPDGSGGYQIPHGFLFNIVTCANYTTEIYQWLGFNIATQTVAGYIFLVVAASIMTNWALAKHRRLRKLFDGKDGRPKYPRRWVILPPFL

SEQ ID NO: 3826 - protein, 310 aa, Allium cepa
MKVIVVSRSGREVVKGGIELDDSATVSDLQEAIHAKTKKYYPSRQRLTLPLQSGTQGKPVVLSPKKSLKDYCDGNSNTLTVVFKDLGIQVYYSTLFFFEYLGPLFIYPMFYYLPVYKYFGYKEDRVIHPVQTYAMYYWCFHYFKRIMETFFVHRFSHATSPLSNVFRNCAYYWSFGAYIAYYVNHPYYTPVSDLQMKIGFGFGIVCQISNFYCHLILRNLRSPDGNGGYQIPRGFLFNIVTCANYTTEIYQWLGFNIATQTVAGYVFLVVAASIMTNWAFAKHRRLRKLFDGKEGRPKYPRRFVILPPFV

SEQ ID NO: 3827 - protein, 310 aa, Allium cepa
MKVIVVSRSGKEVVKGGIELDDSATVSDLQQAIHAKTKKYYPSRQRLTLPLQPGTQGKPVVLSPKKSLKDYCDGNSNTLTVVFKDLGIQVYYSTLFFFEYLGPLFIYPMFYYLPVYKYFGYKEDRVIHPVQTYAMYYWCFHYFKRIMETFFVHRFSHATSPLSNVFRNCAYYWSFGAYIAYYVNHPYYTPVSDLQMKIGFGFGIVCQISNFYCHLILRNLRSPDGNGGYQIPRGFLFNIVTCANYTTEIYQWLGFNIATQTVAGYVFLVVAASIMTNWAFAKHRRLRKLFDGKEGRPKYPRRFVILPPFV

SEQ ID NO: 3828 - protein, 310 aa, Ananas comosus
MKVTVVSRSGKEIIKGGIELNDAATVAELQEAIYSRTKKYYPSRQRLTLPVQPGTSTKPVVLNPKANLSEYCEKNSTNLTVVFKDLGPQVSYRTLFFFEYLGPLVIYPIFYYFPVYKYFGYGTERTIHPVQTYALYYWCFHYAKRILETFFVHRFSHATSPLSNVFRNCAYYWTFGAYIAYYVNHPLYTPVSDLQMKIGFAFGLICQLCNFYCHIILRNLRSPSGNGGYQIPRGFLFNIVTCANYTTEIYQWLGFNIATQTAAGYVFLVVAALIMTNWALAKHRRLKKLFDGKDGRPKYPRRWVILPPFL

SEQ ID NO: 3829 - protein, 308 aa, Castanea mollissima
MKVSVVSRSGKDVVKGGLELSDSATVADLQEAIHQRTKKFYPSRQRLTLPLKPGSKEKPVVLNYKKSLKDYCDGNHLTVVFKDLGTQVSYRTLFFFEYLGPLLLYPIFYYFPVYQFFGYKGERVIHPVQTYALYYWCFHYFKRIMETFFVHRFSHATSPLSNVFRNCAYYWTFGSYIAYYVNHPLYTPVSDLQMKIGFGFGVLCQICNFYCHILLRNLRSPDGNGGYQIPRGFLFNIVTCANYTTEIYQWLGFNIATQTVAGYIFLLVATIIMTNWALAKHRRLKKLFDGKDGRPKYPRRWVILPPFL

SEQ ID NO: 3830 - protein, 310 aa, Citrus clementina
MKVTVISRSGREVIKGGLELNDSATVADLQEAIHKRTKKIYPSRQRLTLPLPPGSKQRATVLDYKKSLKEYSDGNSGNLTVMFKDLGPQVSYRTLFFFEYLGPLILYPIFYYFPVYQFFGYKGERVIHPVQTYALYYWCFHYFKRIMETFFVHRFSHATSPISNVFRNCAYYWSFGSYIAYYVNHPRYTPVSDLQMKIGFAFGIICQIANFYCHILLKNLRSADGSGGYQIPRGFLFNIVTCANYTTEIYQWLGFNIATQTVAGYIFLVVAALIMTNWALAKHRRLKKLFDGKDGRPKYPRRWVILPPFL

SEQ ID NO: 3831 - protein, 308 aa, Quercus alba
MKVSVVSRSGKDVVKGGLELSDSATVADLQEAIHQRTKKFYPSRQRLTLPLKPGSKEKPVVLNYKKSLKDYCDGNHLTVVFKDLGTQVSYRTLFFFEYLGPLLLYPIFYYFPVYQFFGYKGERVIHPVQTYALYYWCFHYFKRIMETFFVHRFSHATSPLSNVFRNCAYYWTFGSYIAYYVNHPLYTPVSDLQMKIGFGFGVLCQICNFYCHILLRNLRSPDGNGGYQIPRGFLFNIVTCANYTTEIYQWLGFNIATQTVAGYVFLVVATLIMTNWALAKHRRLKKLFDGKDGRPKYPRRWVIFPPFL

SEQ ID NO: 3832 - protein, 310 aa, Persea americana
MKVLVVSRSGREVVKGGLDLKASAKVRDLQEAIHHRTKKYYPSRQRLTLPLQPGSRAKPVVLDPKKNLGEYCDGNADNLTVVFKDLGMQVSYSTLFFFEYLGPLIIYPIFYYYDVYQYFGYKGGRVIHPVQTYAMYYWCFHYFKRIMETFFVHRFSHATSPLSNVFRNCFYYWSFGMYIAYYVNHPLYTPVGDLQMKIGFSFGLVCQFANFYCHLLLRNLRSPDGNGGYQIPRGFLFNIVTCANYTTEIYQWAGFNIATQTVAGYAFVVVAAYIMTNWAIAKHHRLKKLFDGKDGRPKYPRRWVILPPFF

SEQ ID NO: 3833 - protein, 310 aa, Vaccinium corymbosum
MKVSVVTRSGRELVKGGLDLNDSATVADLQEAIHRRTKKYYPSRQRLTLPLQPGSKEKPNVLHYRKSLKEYYIENSDKLTVVFKDLGPQVSYQTLFFFEYLGPLLIYPIFYYFPVYQYFGYEGERVIHPVQTYALYYWCFHYFKRIMETFFVHRFSHATSPLSNVFRNCAYYWTFGAYIAYYMNHPFYTPVGDLQMKIGFAFGVLCQISNFYCHILLRNLRRPDGNGGYQIPRGFLFNIVTCANYTTEIYQWLGFNIATQTIAGYVFLVVAALIMTNWALAKHRRLKKLFDGKEGRPKYPRRWVILPPFL

SEQ ID NO: 3834 - protein, 310 aa, Cucumis sativus
MKVSVVSRSGREVVKGGIQLSDSASVADLQDAIHKRTKKFYPARQRLTLPVQPGSKERPTVLNSKKSLREYCSDNSDSITVVFKDLGPQVSYRTLFFFEYLGPLILYPIFYYFPVYQFFGYKAERVIHPVQTYAMYYWCFHYFKRIMETFFVHRFSHATSPLSNVFRNCAYYWSFGSYIAYYVNHPLYTPVGDLQMKIGFAFGLLCQVSNFYCHILLRKLRSPEGNGGYQIPKGFLFNIVTCANYTTEIYQWVGFNIATQTFAGYVFLVVAALIMTNWALAKHRRLKKLFDGKEGRPKYPRRWVILPPFL

SEQ ID NO: 3835 - protein, 310 aa, Cucumis melo
MKVSVVSRSGREVVKGGIQLSDSASVADLQDAIHKRTKKFYPARQRLTLPVQPGSKERPTVLNSKKSLREYCSDNSDSITVVFKDLGPQVSYRTLFFFEYLGPLILYPIFYYFPVYQFFGYQAERVIHPVQTYAMYYWCFHYFKRIMETFFVHRFSHATSPLSNVFRNCAYYWSFGSYIAYYVNHPLYTPVGDLQMKIGFAFGLLCQVSNFYCHILLRKLRSPEGNGGYQIPKGFLFNIVTCANYTTEIYQWVGFNIATQTFAGYVFLVVAALIMTNWALAKHRRLKKLFDGKEGRPKYPRRWVILPPFL

SEQ ID NO: 3836 - protein, 310 aa, Elaeis guineensis
MKVTVVSRSGREIIKGGIELKDSATVSDLQDAIYARTKKYYPSRQRLTLPMPPRTQGKPVVLNPKKRLTEYCDGDASSLTVVFKDLGMQVSYSTLFFWEYLGPLIIYPIFYYFPVYKYFGYEGERVTHPHQTYALYYWCFHYFKRIMETFFVHRFSHATSPLSNVFRNCAYYWTFGSYVAYYVNHPLYTPVGDLQMKIGFGLGLICQVLNFYCHLLLRNLRSADGSGGYQIPRGFLFNIVTCANYTTEIYQWLGFNIATQTVAGYVFLVVAALIMTNWALAKHRRLKKIFDGKEGRPKYPRRWVILPPFL

SEQ ID NO: 3837 - protein, 310 aa, Gossypium hirsutum
  Sequence also found in Organisms: Gossypium raimondii
MKVTLVSRSGREFIKGGLELNDSATVADLQEAIHKRTKKFYPSRQRLTLPVPSGSRERPVVLNYKKSLKDYCDGNENSLTIVFKDLGPQVSYRTLFFFEYLGPLILYPVFYYFPVYKYFGYEEKRVIHPVQTYALYYWCFHYFKRIMETFFIHRFSHATSPLSNVFRNCAYYWTFGSYIAYYVNHPLYTPVSDLQMKIGFGFGIVCQLANFYCHIILKNLRSPDGSGGYQIPRGFLFNIVTCANYTTEIYQWLGFNIATQTVAGYVFLVVATSIMTNWALAKHRRLKKLFDGKDGRPKYPRRWVILPPFL

SEQ ID NO: 3838 - protein, 78 aa, Platanus occidentalis
MKVTVVSRSGREIIKGGIELNGSATVRDLQEAIHRRPKNTILLDNVSPFPSNLDQRRNLLFSTPRKIFKIIVMEMQIT

SEQ ID NO: 3839 - protein, 310 aa, Brassica oleracea
MKVTVVSRSGREVLKAPLDLPDSATVADLQEAFHKRAKKFYPSRQRLTLPVSPGSKDKPVVLNSKKSLKEYCDGNTDSLTVVFKDLGAQVSYRTLFFFEYLGPLLIYPVFYYFPVYKYLGYGEDRVIHPVQTYAMYYWCFHYFKRIMETFFVHRFSHATSPIGNVFRNCAYYWTFGAYIAYYVNHPLYTPVSDLQMKIGFGFGLVCQVANFYCHILLKNLRDPSGSGGYQIPRGFLFNIVTCANYTTEIYQWLGFNIATQTVAGYVFLAVAALIMTNWALGKHSRLRKIFDGKDGKPKYPRRWVILPPFL

SEQ ID NO: 3840 - protein, 310 aa, Brassica napus
  Sequence also found in Organisms: Brassica juncea
MKVTVVSRSGREVLKAPLDLPDSATVADLQEAFHKRAKKFYPSRQRLTLPVSPGSKDKPVVLNSKKSLKEYCDGNTDSLTVVFKDLGAQVSYRTLFFFEYLGPLLIYPVFYYFPVYKYLGYGQDRVIHPVQTYAMYYWCFHYFKRIMETFFVHRFSHATSPIGNVFRNCAYYWTFGAYIAYYVNHPLYTPVSDLQMKIGFGFGLVCQVANFYCHILLKNLRDPSGSGGYQIPRGFLFNIVTCANYTTEIYQWLGFNIATQTVAGYVFLAVAALIMTNWALGKHSRLRKIFDGKDGKPKYPRRWVILPPFL

SEQ ID NO: 3841 - protein, 310 aa, Brassica napus
  Sequence also found in Organisms: Brassica juncea
MKVTVVSRSGREVLKAPLDLPDSATVADLQEAFHKRAKKFYPSRQRLTLPVAPGSKDKPVVLNSKKSLKEYCDGNTDSLTVVFKDLGAQVSYRTLFFFEYLGPLLIYPVFYYFPVYKYLGYGEDRVIHPVQTYAMYYWCFHYFKRIMETFFVHRFSHATSPIGNVFRNCAYYWTFGAYIAYYVNHPLYTPVSDLQMKIGFGFGLVCQVANFYCHILLKNLRDPSGSGGYQIPRGFLFNIVTCANYTTEIYQWLGFNIATQTVAGYVFLAVAALIMTNWALGKHSRLRKIFDGKDGKPKYPRRWVILPPFL

SEQ ID NO: 3842 - protein, 310 aa, Brassica oleracea
MKVTVVSRSGREVLKAPLDLPDSATVADLQEAFHKRAKKFYPSRQRLTLPVPPGSKDKPVVLNSKKSLKEYCDGNTDSLTVVFKDLGAQVSYRTLFFFEYLGPLLIYPVFYYFPVYKYLGYGEDRVIHPVQTYAMYYWCFHYFKRIMETFFVHRFSHATSPIGNVFRNCAYYWTFGAYIAYYVNHPLYTPVSDLQMKIGFGFGLVCQVANFYCHILLKNLRDPSGSGGYQIPRGFLFNIVTCANYTTEIYQWLGFNIATQTVAGYVFLAVAALIMTNWALGKHSRLRKIFDGKDGKPKYPRRWVILPPFL

SEQ ID NO: 3843 - protein, 310 aa, Theobroma cacao
MKVTLVSRSGREVIKGGLELHDSATVADLQEAIHKRTKKFYPSRQRLTLPVPPGSKERPVVLNYKKGLKDYCDGNQNNITVVFKDLGPQVSYPTLFFFEYLGPLILYPTFYYFPVYQFFGYKVERVIHPVQTYALYYWCFHYFKRIMETFFIHRFSHATSPLSNVFRNCAYYWTFGAYIAYYVNHPLYTPVSDLQMKIGFGFGLICQLANFYCHIILKNLRSPDGSGGYQIPSGFLFNIVTCANYTTEIYQWLGFNIATQTVAGYVFLVVATSIMTNWALAKHRRLKKLFDGKEGRPKYPRRWVILPPFL

SEQ ID NO: 3844 - protein, 310 aa, Eschscholzia californica
MKVTVVSRSGREIVKGGIELNDSATVSDLQEAIHERTKKYYPSRQRLTLPLEPGSKARPVVLAPKKTLHDYCDGNSGNLTVVFKDLGPQVLYSTLFFWEYFGPLVIYPIFYYFDVYKYLGYKGERVIHPVQTYATYVWCFHYFKRIMETFFVHRFSHATSPLSNVFRNCLYYWSFGAFIAYYVNHPLYTPVSDLQMKIGFGFGVICQISNFYCHILLRNLRSPDGNGGYQIPRGFLFNLVTCANYTTEIYQWVGFNIATQTVAGYVFAAVAAFIMTNWALAKHRRLKKLFDGKEGRPKYPRRWVILPPFI

SEQ ID NO: 3845 - protein, 309 aa, Glycine max
MKVTVVSRSGREVVKGGIELSDSATVADLQEAIHKRTKKYPSRQRLTLPVQPGSKERPVVLNYKKSLKDYTIGNSETLTVVFKDLGPQVSYRTLFFCEYLGPLLLYPVFYYLPVYQYFGYKGERVIHPVQTYALYYWCFHYAKRILETFFVHCFSHATSPLSNVFRNCAYYWTFGSYIAYYVNHPLYTPVNDLQMKIGFGFGILCQISNFYCHIILKNLRSPGGEGGYQIPRGFLFNIVTCANYTTEIYQWLGFNIATQTVAGYIFLVVATFIMTNWALAKHRRLKKLFDGKEGRPRYPRRWVILPPFL

SEQ ID NO: 3846 - protein, 164 aa, Chelidonium majus
METFFVHRFSHATSPLSNVFRNCAYYWSFGSFIAYYVNHPLYTPVSDLQMKIGFGIGLICQIANFYCHILLRNLRSPDGNGGYQIPRGFLFNIVTCANYTTEIYQWLGFNIATQTVAGYIFAAVAAFIMSNWALAKHRRLKKLFDGKDGKPKYPRRWVILPPFL

SEQ ID NO: 3847 - protein, 310 aa, Brassica rapa
MKVTVVSRSGREVLKAPLDLPDSATVADLQEAFHKRAKKFYPSRQRLTLPVSPGSKDKPVVLNSKKSLKEYCDGNTDSLTVVFKDLGAQVSYRTLFFFEYLGPLLIYPVFYYFPVYKYLGYGQDRVIHPVQTYAMYYWCFHYFKRIMETFFVHRFSHATSPIGNVFRNCAYYWTFGAYIAYYVNHPLYTPVSDLQMKIGFGFGLVCQVANFYCHILLKNLRDPSGSGGYQIPRGFHFNIVTCANYTTEIYQWLGFNIATQTVAGYVFLAVAALIMTNWALGKHSRLRKIFDGKDGKPKYPRRWVILPPFL

SEQ ID NO: 3848 - protein, 310 aa, Manihot esculenta
MKVTIVSRSGREIVKGGLEINDSATVADLQEAIYKRTKKFYPSRQRLTLPLPPGSRERPVVLHYKKSLKEYCDGNSDNITVVFKDLGPQVSYRTLFFWEYLGPLIIYPIFYFFPVYEYFGYKRERVIHPVQTYALYYWCFHYFKRIMETFFVHRFSHATSPLSNVFRNCAYYWTFGSYIAYYVNHPLYTPVSDLQMKIGFGFGLVCQVANFYCHILLKNLRTPEGSGGYQIPRGFLFNIVTCANYTTEIYQWLGFNIATQTVAGYVFLVVATVIMTNWALAKHRRLKKLFDGKDGRPKYPRRWVILPPFL

SEQ ID NO: 3849 - protein, 310 aa, Gossypium hirsutum
MKVTLVSRSGREFIKGGLELNDSATVADLQEAIHKRTKKFYPSRQRLTLPVPSGSRERPVILNYKKSLKDYCDGNENTLTIVFKDLGPQVSYRTLFFFEYLGPLILYPVFYYFPVYKYFGYEEKRVIHPVQTYALYYWCFHYFKRIMETFFIHRFSHATSPLSNVFRNCAYYWTFGSYIAYYVNHPLYTPVSDLQMKIGFGFGIVCQLANFYCHIILKNLRSPDGSGGYQIPRGFLFNIVTCANYTTEIYQWLGFNIATQTVAGYVFLVVATSIMTNWALAKHRRLKKLFDGKDGRPKYPRRWVILPPFL

SEQ ID NO: 3850 - protein, 310 aa, Echinacea purpurea
MQVTVTTRSGRELINGGLVLDSSATVADLQEAIHQRIKKYYPSRQRLTLPLQPGSKEKAVVLQSKKSLKEYTDGNSDTLTVVFKDLGPQVSYRTLFFFEYLGPLILYPVFYYFPVYQFFGYKGERVIHPVQTYALYYWCFHYFKRIMETFFVHRFSHATSPLSNVFRNCAYYWTFGCYIAYYVNHPHYTPVSDLQMKIGFGFGLIMQFANLYCHIILRNLRSPSGNGGYQIPRGFLFNIVTCANYTTEIYQWLGFNIATQTVAGYIFLVVAASIMTNWALAKHRRLRRLFDGKEGRPKYPRRWVILPPFL

SEQ ID NO: 3851 - protein, 310 aa, Solanum melongena
MKVLVVTRSGKELIKGGLELADSATVADLQEAIHKRTKKYYPSRQRLTLPVQPGSKERPTVLHYQKSLSEYTKGSTGELTVVFKDLGPQVKYSTLFFFEYLGPLLLYPIFYYFPVYKYFGYKEERVIHPVQTYALYYWCFHYFKRIMETFFVHRFSHATSPISNVFRNCAYYWSFGALIAYFVNHPRFTPVSDLQMKIGFGFGIVCQVANFYCHLLLRNLRSPSGNGGYQIPRGFLFNIVTCANYTTEIYQWLGFNIATQTVAGYIFMVVAASIMTNWALGKHRRLKKLFDGKEGRPKYPRRWVILPPFL

SEQ ID NO: 3852 - protein, 310 aa, Euonymus alatus
MKITVVSRSGREVVKGGLELNDSATVADLQEAIHRRTKKFYPSRQRLTLPQKPGLKERPVALNYKKSLKEYCDGNSENLTVVFKDLGPQVSYRILFFWEYLGPLILYPVFYYFPVYQFFGYKGERVIHPVQTYAMYYWCFHYFKRIMETFFVHRFSHATSPLSNVFRNCAYYWSFGSFIAYYVNHPLYTPVDDLQMKIGFGIGLVCQLANFYCHILLKNLRSPDGNGGYQIPRGFLFNIVTCANYTTEIYQWLGFNIATQTIAGYIFMVVAALIMTNWALAKHRRLKKLFDGKEGRPKYPRRWVILPPFL

SEQ ID NO: 3853 - protein, 310 aa, Raphanus sativus
MKVTVVSRSGREVLKAPLDLPDSATVADLQEAFHKRAKKFYPSRQRLTLPVAPGSKDKPVVLNSKKSLKEYCDGNTDSLTVVFKDLGAQVSYRTLFFFEYLGPLLIYPVFYYFPVYKYLGYGEDRVIHPVQTYAMYYWCFHYFKRIMETFFVHRFSHATSPIGNVFRNCAYYWTFGAYIAYYVNHPLYTPVSDLQMKIGFGFGLVCQVANFYCHILLKNLRDPSGAGGYQIPRGFLFNIVTCANYTTEIYQWLGFNIATQTVAGYVFLAVAALIMTNWALGKHSRLRKIFDGKDGKPKYPRRWVILPPFL

SEQ ID NO: 3854 - protein, 310 aa, Raphanus sativus
MKVTVVSRSGREVLKAPLDLPDSATVADLQEAFHKRAKKFYPSRQRLTLPVAPGSKDKPVVLNSKKSLKEYCDGNTDSLTVVFKDLGAQVSYRTLFFFEYLGPLLIYPVFYYFPVYKYLGYGQDRVIHPVQTYAMYYWCFHYFKRIMETFFVHRFSHATSPIGNVFRNCAYYWTFGAYIAYYVNHPLYTPVSDLQMKIGFGFGLVCQVANFYCHILLKNLRDPSGAGGYQIPRGFLFNIVTCANYTTEIYQWLGFNIATQTVAGYVFLAVAALIMTNWALGKHSRLRKIFDGKDGKPKYPRRWVILPPFL

SEQ ID NO: 3855 - protein, 309 aa, Sesamum indicum
MKVIVTTRSGRELVKGGLELSDSATVADLQGAIHKRTKKYYPSRQRLTLPLPPGLKERPTVLNYKKSLKDYTNGNTAELTVVFKDLGPQVKYSTLFFWEYLGPLIIYPIFYYYPVYKFFGYKGERVIHPVQTYALYYWCFHYFKRIMETFFVHRFSHATSPLSNVFRNCAYYWTFGAWIAYYVNHPLYTPVSDLQMKVGFGFGLLCQISNFYCHILLRNLRSSEGGGYQIPRGFLFNFVTCANYTTEIYQWLGFNIATQTVAGYVFMVVAAAIMTNWALAKHRRLKKLFDGKEGRPKYPRRWVILPPFL

SEQ ID NO: 3856 - protein, 310 aa, Plantago ovata
MKVTVTTRSGRELVKGGLDLADSATVADLQEAIHKKTRKYYPARQRLTLPLPAGSKERPTVLASKKSLKEYADGNKELTVVFKDLGPQVKYSTLFFFEYLGPLVLYPIFYYYFPIYQFFGYKGERVIHPVQTYAMYYWCFHYFKRIMETFFVHRFSHATSPVSNVFRNCAYYWTFGAWIAYYVNHPLYTPVSDLQMKIGFGFGVLCQISNFYCHILLRNLRGSGTGGGYQIPRGFLFNIVTCANYTTEIYQWLGFNIATQTVAGIVFMVVAASIMTNWALAKHRRLKKLFDGKDGRPKYPRRWVILPPFL

SEQ ID NO: 3857 - protein, 310 aa, Musa acuminata
MKVTVVSRSGREVIKGGIELHDEATVSDLQEAIHARTKKYYPSRQRLTLPMQAGIQGKPIVLSPKKKLVDYCDGNVKNLTVVFKDLGVQVLYRTLFFWEYLGPLVIYPIFYYFPVYKYFGYEGERVVYPVQTYAMYYWCLHYSKRIMETFFVHRFSHATSPLSNVFRNCAYYWTFGAYIAYYVNHPLYTPVSDLQMKIGFGFGLICQVSNFYCHILLRNLRNPNGNGGYQIPHGFLFNIVTCANYTTEIYQWLGFNIATQTIAGYVFLVVAALIMTNWALAKHRRLKKLFDGKEGRPRYPRRWVILPPFI

SEQ ID NO: 3858 - protein, 310 aa, Arabidopsis lyrata
MKVTVVSRSGREVLKAPLDLPDSATVADLQEAFHKRAKKFYPSRQRLTLPVAPGSKEKPVVLNSKKSLKEYCDGNTNSLTVVFKDLGAQVSYRTLFFFEYLGPLLIYPVFYYFPVYKFLGYGEDRVIHPVQTYAMYYWCFHYFKRILETFFVHRFSHATSPIANVFRNCAYYWSFGAYIAYYVNHPLYTPVSDLQMKIGFGFGLVCQVANFYCHILLQNLRDPNGSGGYQIPRGFLFNIVTCANYTTEIYQWLGFNIATQTVAGYVFLAVAALIMTNWALGKHSRLRKIFDGKDGKPKYPRRWVILPPFL

SEQ ID NO: 3859 - protein, 145 aa, Euonymus alatus
MKITVVSRSGREVVKGGLELNDSATVADLQEAINRRTKKFYPSRQRLTLPQKPGLKERPVALNYKKSLKEYCDGNSEKLTVVFKDLGPQVSYRILFSGSILVLSSSIRSFISSLCINSLATRESVSSTQCRHMLCTTGVSTISNV

SEQ ID NO: 3860 - protein, 309 aa, Fagopyrum esculentum
MKVTVVTRSGRELVKGGLELDDSATVADLQDAIYKRTKKYYPSRQRLTLPLPSGSKGKPVVLNSQKSIKDYSDGNSSEFSVVFKDLGPQVSYRTLFFFEYLGPLFIYPIFYYFPVYEFFGYKGERVIHPVQTYAMYYWCFHYFKRIMETFFVHRFSHATSPLSNVFRNCAYYWTFGAYIAYYVNHPLYTPVSDLQMKIGFGFGVLCQVSNFYCHILLKNLRSSDGGGYQIPTGFLFNIVTCANYTTEIYQWLGFNIATQTVAGYVFLIVATSIMTNWALAKHRRLKRLFDGKDGRPKYPRRWVILPPFL

SEQ ID NO: 3861 - protein, 310 aa, Flaveria ramosissima
MKVTVTTRSGRELIDGGLVLDSSATVADLQKAIHQRIKKYYPSRQRLTLPLEPGSKKKPVVLQYKKSLKEYTSGNSDDITVVFKDLGPQVSYRTLFFFEYLGPLILYPVFYYFPVYQFFGYKGERVIHPVQTYAMYYWCLHYFKRIMETFFVHRFSHATSPLSNVFRNCAYYWTFGCYIAYYVNHPLYTPVSDLQMKIGFGFGLIMQVANLYCHIILRNLRSPSGDGGYQIPRGFLFNIVTCANYTTEIYQWLGFNIATQTVAGYVFLVVAASIMTNWALAKHRRLRRLFDGKEGRPKYPRRWVILPPFL

SEQ ID NO: 3862 - protein, 310 aa, Humulus lupulus
MKVSVISRSGREVIRGGLELNDSATVSDLQEAIHKRTKKFYPARQRLTLPVQPGSKERPVVLSSKKGLKEYTSGNSNDLTVVFKDLGAQVSYRTLFFFEYLGPLIIYPLFYYFPVYRYFGFKGERVIHPVQTYAMYYWCFHYFKRIMETFFVHRFSHATSPLSNVFRNCLYYWSFGSYIAYYVNHPLYTPVSDLQMKIGFGFGILCQISNFYCHILLSNLRGADGSGGYQIPRGFLFNIVTCANYTTEIYQWLGFNIATQTVAGYLFLVVAAFIMTNWALAKHRRLKKLFDGKDGRPKYPRRWIILPPFL

SEQ ID NO: 3863 - protein, 310 aa, Actinidia deliciosa
MKVVVVTRSGRELIKGGLELDDSATVADLQEAIHRRTRKYYPSRQRLTLSLQPGSKEKPTVLHYRKSLKEYCSGNSDNLTVVFKDLGPQVSYRTLFFFEYLGPLLIYPIFYYLPVYQYFGYKGERVVHPVQTYATYYWCFHYFKRIMETFFVHRFSHATSPLSNVFRNCAYYWTFGAYVAYYVNHPFYTPVCDLQMKIGFGFGLLCQISNFYCHILLRNLRRPDGNGGYQIPCGFLFNIVTCANYTTEIYQWLGFNIATQTVAGYVFLVVAASIMTNWALAKHRRLRRLFDGKDGRPKYPRRWVILPPFL

SEQ ID NO: 3864 - protein, 310 aa, Populus trichocarpa
MKVTVVSRSGREVIKGGLELSDSATVADLQEAIHKRTKKFYPARQRLTLPLPPGSKERPTVLNYKKNLKEYQDGNLDSLTILFKDLGPQVSYRTLFFFEYLGPLVLYPFFYYFPVYQFLGYKGEHIMHPVQTYALYYWCFHYFKRIMETFFVHRFSHATSPLSNVFRNCAYYWTFGSYIAYYVNHPLYTPVGDLQMKIGFGFGLVCQLANFYCHILLRNLRRPDGNGGYQIPSGFLFNIVTCANYTTEIYQWLGFNIATQTVAGYIFLVVAASIMTNWALAKHRRLKKLFDGKDGRPKYPRRWVILPPVL

SEQ ID NO: 3865 - protein, 310 aa, Papaver somniferum
MKVTVVSRSGREIIKGGIQLNDSATVSDLQEAIHARTKKYYPSRQRLTLPLNPGSKDKPTVLNSKTSLCDYCDAKKDNLTVVFKDLGPQVSYQILFFWEYVGPLVIYPLFYYLPVYKFLGYKEERVIRPVQTYAMYYWCFHYFKRIMETFFIHRFSHATSPISNVFRNCAYYWSFGAFIAYYVNHPLYTPVSDLQMKIGFGFGIICQVSNLYCHLLLRNLRSPSGNGGYQIPYGFLFNIVTCANYTTEIYQWLGFNIATQTVAGYVFLVVAASIMSNWALAKHRRLRRLFDGKEGRPKYPRRWVILPPFL

SEQ ID NO: 3866 - protein, 290 aa, Papaver somniferum
MKVTVVSRSGREIIKGGIQLNDSATVNDLQEAIHARTKKYYPSRQRLTLPLSPGSKDKPTVLNSKTNLCDYCDAKKDNLTVVFKDLGPQVSYQILFFWEYVGPLVIYPLFYYLPVYKFLGYKEERVIHPVQTYAMYYWCFHYFKRIMETFFIHRFSHATSPISNVFRNCAYYWSFGAFIAYYVNHPLYTPVSDLQMKIGFGFGILCQVSNLYCHLLLRNLRSPSGNGGYQIPYGFLFNIVTCANYTTEIYQWLGFNIATQTVAGYVFLVVAASIMSNWALDKAPTSKKVI

SEQ ID NO: 3867 - protein, 310 aa, Raphanus sativus
MKVTVVSRSGRDVLKAPLDLPDSATVADLQEAFHKRAKKFYPSRQRLTLPVAPGSKDKPVVLNSKKSLKEYCDGNTDSLTVVFKDLGAQVSYRTLFFFEYLGPLLIYPVFYYFPVYKYLGYGQDRVIHPVQTYAMYYWCFHYFKRIMETFFVHRFSHATSPIGNVFRNCAYYWTFGAYIAYYVNHPLYTPVSDLQMKIGFGFGLVCQVANFYCHILLKNLRDPSGAGGYQIPRGFLFNIVTCANYTTEIYQWLGFNIATQTVAGYVFLAVAALIMTNWALGKHSRLRKIFDGKDGKPKYPRRWVILPPFL

SEQ ID NO: 3868 - protein, 310 aa, Tripterygium wilfordii
MKVTVVSRSGREVIKGGLEVNDSATVADLQEAIHRRTKKFYPSRQRLTLPQKPGMKERPVVLNYKKSLKEYCDGNAENLTVVFKDLGPQVSYRTLFFCEYFGPLFLYPVFYYFPVYQFFGYQGERVIHPVQTYAVYYWCFHYFKRIMETFFVHRFSHATSPLANVFRNCAYYWSFGSYIAYYVNHPLYTPVGDLQMKIGFGIGLVCQLANFYCHILLRNLRSPDGNGGYQIPRGFLFNIVTCANYTTEIYQWLGFNIATQTVAGYIFMVVAALIMTNWALAKHRRLKKLFDGKEGRPKYPRRWVILPPFL

SEQ ID NO: 3869 - protein, 310 aa, Citrullus lanatus
MKVSVVSRSGREVVKGGIQLSDSASVADLQDAIYKRTKKFYPARQRLTLPVQPGSKERPTVLNYKKSLQEYCSDNSDNLTVVFKDLGPQVSYRTLFFWEYLGPLILYPIFYYFPVYQFFGYKAERVIHPVQTYAMYYWCFHYSKRIMETFFVHRFSHATSPLSNVFRNCAYYWSFGSYIAYYVNHPLYTPVGDLQMKIGFAFGLLCQVSNFYCHILLRKLRSPEGNGGYQIPKGFLFNIVTCANYTTEIYQWVGFNLATQTVAGYVFLVVATLIMTNWALAKHHRLKKLFDGKEGRPKYPRRWVILPPFL

SEQ ID NO: 3870 - protein, 309 aa, Phaseolus vulgaris
MKVTVVSRSGREVVKGGIHLSDSATVADLQEAIHKQTKKYPSRQRLTLPVQPGSKERPVVLNYKKSLQDYTSGNSDSLTVVFKDLGPQVSYRTLFFCEYLGPLLLYPVFYYFPVYKYFGYKGERVIHPVQTYALYYWCFHYAKRILETFFVHRFSHATSPLSNVFRNCAYYWTFGSYIAYYVNHPLYTPVNDLQMKIGFGFGILCQISNFYCHIILKNLRSPGGEGGYQIPKGFLFNIVTCANYTTEIYQWLGFNIATQTVAGYIFLAVATFIMANWALAKHRRLKKLFDGKEGRPRYPRRWIILPPFL

SEQ ID NO: 3871 - protein, 310 aa, Catharanthus roseus
MKVSVVTRSGRELVKGGLELNDSATVADLQEAIHKRTKKYYPSRQRLTLPLQPGSREKPTVLQYKKSLKEYSSGSENQLTVVFKDLGPQVKYSTLFFFEYLGPLVLYPVFYFFNVYQYLGFKGERVIHPVQTYALYYWCFHYSKRIIETFFVHRFSHATSPLSNVFRNCAYYWSFGSLIAYYVNHPLYTPVSNLQMKIGFGFGLACQIANFYCHILLRNLRSTDGSGGYQIPRGFLFNIVTCANYTTEIYQWLGFNIATQTVAGYVFMVVAASIMTNWALGKHRRLRKIFDGKDGRPKYPRRWVILPPFL

SEQ ID NO: 3872 - protein, 310 aa, Cleome gynandra
MKVTVVSRTGRDVIKGGLDLPDSATVADLQEAIHKRTKKFYPSRQRLTLAVAPGSKEKPVVLSSRKSLKDYYGGNTDSLTVVFKDLGPQVSYRTLFFFEYLGPLFIYPIFYYLPVYKYFGYGEERMIHPVQKYAMYYWCFHYFKRILETFFIHRFSHATSPLSNVFRNCAYYWTFGAYIAYYVNHPLYTPVSDLQWKIGFGFGLVCQVANFYCHIILKNLRSPDGSGGYQIPRGFLFNVVTCANYTTEIYQWLGFNIATQTVAGYIFLVVASLIMTNWALGKHRRLRKLFDGRDGRPKYPRRWVILPPFL

SEQ ID NO: 3873 - protein, 311 aa, Echinacea purpurea
MQVTVTTRSGRELINGGLVLDSSATVADLQEAIHQRIKKYYPSRQRLTLPLQPGSKEKAVVLQSKKSLKEYTDGNSDTLTVVFKDLGPQVSYRTLFFFEYLGPLILYPVFYYFFPVYQFFGYKGERVIHPVQTYALYYWCFHYFKRIMETFFVHRFSHATSPLSNVFRNCAYYWTFGCYIAYYVNHPHYTPVSDLQMKIGFGFGLIMQFANLYCHIILRNLRSPSGNGGYQIPRGFLFNIVTCANYTTEIYQWLGFNIATQTVAGYIFLVVAASIMTNWALAKHRRLRRLFDGKEGRPKYPRRWIILPPFL

SEQ ID NO: 3874 - protein, 310 aa, Flaveria ramosissima
MKITVTTRSGRELIDGGLVLDSSATVADLQKAIHQRIKKYYPSRQRLTLPLEPGSKKKPVVLQYKKSLKEYTSGNSDDITVVFKDLGPQVSYRTLFFFEYLGPLILYPVFYYFPVYQFFGYKGERVIHPVQTYAMYYWCLHYFKRIMETFFVHRFSHATSPLSNVFRNCAYYWTFGCYIAYYVNHPLYTPVSDLQMKIGFGFGLIMQVANLYCHIILRNLRSPSGDGGYQIPRGFLFNIVTCANYTTEIYQWLGFNIATQTVAGYVFLVVAASIMTNWALAKHRRLRRLFDGKEGRPKYPRRWVILPPFL

SEQ ID NO: 3875 - protein, 310 aa, Ipomoea nil
MKVVVNSRSGRELIKGGLDLADTATVADLQEQIHKQTKKYYPSRQRLTLPLPPGSTQRPTVLHYKKSLKEYTDGNKNELTVIFKDLGPQVSYRTLFFFEYLGPLIIYPLFYYLPVYKFFGYEGKRVIHPAQTYAMYYWCFHYFKRILETFFVHRFSHATSPLSNVFRNCAYYWSFGAFIAYFVNHPLYTPVSDLQMKIGFGFGLICQVSNFYCHLLLRKLRSPDGSGGYQIPRGFLFNIVTCANYTTEIYQWLGYNIATQTVAGYIFMVVAAGIMTNWALAKHRRLKKLFDGKEGRPKYPRRWVILPPFL

SEQ ID NO: 3876 - protein, 310 aa, Prunus mume
MKVTVVSRSGREVVKGGLELSDSATVTDLQEAIHKRTKKFYPARQRLTLPVQPGSKERPVVLNYKKSLKDYISENSDNLTVVFKDLGPQVSYKTLFFFEYLGPLVLYPIFYYFNVYQYLGFKGDRVIRPVQTYALYYWCFHYFKRIMETFFVHRFSHATSPLLNVFRNCAYYWSFGSYIAYYMNHPLYTPVSDLQMKIGFAVGIIFQISNFYCHILLRNLRSPDGNGGYQIPHGFLFNIVTCANYTTEIYQWLGFNIATQTVAGYVFLVVAASIMTNWALAKHHRLKKIFDGKDGRPKYPRRWVILPPFL

SEQ ID NO: 3877 - protein, 309 aa, Glycine max
MKVTVVSRSGREVVKGGIELSDSATIADLQEAIHKRTKKYPSRQRLTLPVQPGSKERPVVLNYKKSLKDYTSGNSETLTVVFKDLGPQVSYRTLFFCEYLGPLLLYPVFYYLPVYQYFGYKGERVIHPVQTYALYYWCFHYAKRILETFFVHRFSHATSPLSNVFRNCAYYWTFGSYIAYYVNHPLYTPVNDLQMKIGFAIGILCQISNFYCHIILKNLRSPGGEGGYQIPRGFLFNIVTCANYTTEIYQWLGFNIATQTVAGYIFLVVATFIMTNWALAKHRRLKKLFDGKEGRPRYPRRWVTLPPFL

SEQ ID NO: 3878 - protein, 310 aa, Solanum lycopersicum
MKVLVVTRSGKELIKGGLELNESATVADLQEAIHKRTRKYYPSRQRLTLPIQPGSKERPTVLHYQKSLNEYTKGSTGELTVVFKDLGPQVKYSTLFFFEYLGPLLLYPIFYYFPVYKFFGYKEERVIHPVQTYALYYWCFHYFKRIMETFFVHRFSHATSPISNVFRNCAYYWSFGAFIAYFVNHPLYTPVSDLQMKIGFGFGIVCQVANLYCHLLLRNLRSPSGNGGYQIPRGFLFNIVTCANYTTEIYQWLGFNIATQTVAGYIFMIVAASIMTNWALGKHRRLKKLFDGKEGRPKYPRRWVILPPFL

SEQ ID NO: 3879 - protein, 310 aa, Trifolium pratense
MKVTVVSRSGREIVKGGIELNDSATVADLQEAIHKRTKKHPSRQRLTLPVQPGSKEKPVVLNYKKSLNDYTSGNSETLTVTFKDLGPQVSYRTLFFFEYLGPLLLYPVFYYFPVVYQYFGYKGERVIHPVQTYALYYWCFHYAKRILETFFVHRFSHATSPLSNVFRNCAYYWTFGAYIAYYVNHPLYTPVSDLQIKIGFGFGVLCQISNFYCHIILRNLRGPAGEGGYQIPRGFLFNIVTCANYTTEIYQWLGFNIATQTIAGYIFLAVATFIMTNWALAKHRRLKKLFDGKEGRPRYPRRWVILPPFL

SEQ ID NO: 3880 - protein, 310 aa, Arabidopsis thaliana
MKVTVVSRSGREVLKAPLDLPDSATVADLQEAFHKRAKKFYPSRQRLTLPVTPGSKDKPVVLNSKKSLKEYCDGNNNSLTVVFKDLGAQVSYRTLFFFEYLGPLLIYPVFYYFPVYKFLGYGEDCVIHPVQTYAMYYWCFHYFKRILETFFVHRFSHATSPIGNVFRNCAYYWSFGAYIAYYVNHPLYTPVSDLQMKIGFGFGLVCQVANFYCHILLKNLRDPSGAGGYQIPRGFLFNIVTCANYTTEIYQWLGFNIATQTIAGYVFLAVAALIMTNWALGKHSRLRKIFDGKDGKPKYPRRWVILPPFL

SEQ ID NO: 3881 - protein, 310 aa, Musa acuminata
MKVTVVSRSGREVIKGGIELHDEATVSDLQEAIHARTKKYYPSRQRLTLPMQAGIQGKPIVLSPKKKLVDYCDGNVKNLTVVFKDLGVQVLYRTLFFWEYLGPLVIYPIFYYFPVYKYFGYEGERVVYPVQTYAMYYWCLHYSKRIMETFFVHRFSHATSPLSNVFRNCAYYWTFGAYIAYYVNHPMYTPVNDLQMKIGFGFGLICQVSNFYCHILLRNLRNPNGNGGYQIPHGFLFNIVTCANYTTEIYQWLGFNIATQTIAGYVFLVVAALIMTNWALAKHRRLKKLFDGKEGRPRYPRRWVILPPFI

SEQ ID NO: 3882 - protein, 311 aa, Cleome spinosa
MKVTVVSRSGREVIKGGLDLPDSQGTVADLQEAIHKRTKKFYPSRQRLTLPVAPRSKEKPVVLNSRKPLKDYFGGNTDSLTVVFKDLGPQVSYRTLFFFEYLGPLFIYPIFYYFPVYKYFGYGEERVINPVQTYAMYYWCFHYFKRILETFFIHRFSHATSPLSNVFRNCAYYWTFGAYIAYYVNHPLYTPVSDLQWKIGFGFGLVCQVANFYCHIILKNLRSPDGSGGYQIPRGFLFNVVTCANYTTEIYQWLGFNIATQTVAGYVFLVVAALIMTNWALGKHRRLRKIFDGKDGRPKYPRRWVILPPFI

SEQ ID NO: 3883 - protein, 310 aa, Eucalyptus grandis
MKVSVVSRSGREVVKGGVELNDSATVADLQKEIHRRTKKFYPSRQRLTLPLQPGSKEKPIALNYKKSLESYTEGNSANLTVVFKDLGPQVSYRTLFFWEYLGPLILYPIFYFFPVYRYFGYAGERIIHPVQTYALYYWCFHYFKRIMETFFVHRFSHATSPLSNVFRNCAYYWSFGSYIAYYVNHPLYTPVSDLQMKIGFAFGVLCQVSNFYCHILLRNLRSPDGNGGYQIPRGFLFNIVTCANYTTEIYQWLGFNIATQTIAGYVFLVVAAFIMTNWALAKHRRLKKLFDGKEGRPRYPRRWVILPPFL

SEQ ID NO: 3884 - protein, 310 aa, Flaveria ramosissima
MKITVTTRSGRELIDGGLVLDSSATVADLQKAIHQRIKKYYPSRQRLTLPLEPGSKKKPVVLQYKKSLKEYTSGNSDDITVVFKDLGPQVSYRTLFFFEYLGPLILYPVFYYFPVYQFFGYKGERVIHPVQTYAMYYWCLHYFKRIMETFFVHRFSHATSPLSNVFRNCAYYWTFGCYIAYYVNHPLYTPVSDLQMKIGFGFGLIMQVANLYCHIILRNLRSPSGDGGYQIPQGFLFNIVTCANYTTEIYQWLGFNIATQTVAGYVFLVVAASIMTNWALAKHRRLRRLFDGKEGRPKYPRRWVILPPFL

SEQ ID NO: 3885 - protein, 310 aa, Flaveria ramosissima
MKITVTTRSGRELIDGGLVLDSSATVADLQKAIHQRIKKYYPSRQRLTLPLEPGSKKKPVVLQYKKNLKEYTSGNSDDITVVFKDLGPQVSYRTLFFFEYLGPLILYPVFYYFPVYQFFGYKGERVIHPVQTYAMYYWCLHYFKRIMETFFVHRFSHATSPLSNVFRNCAYYWTFGCYIAYYVNHPLYTPVSDLQMKIGFGFGLIMQVANLYCHIILRNLRSPSGDGGYQIPRGFLFNIVTCANYTTEIYQWLGFNIATQTVAGYVFLVVAASIMTNWALAKHRRLRRLFDGKEGRPKYPRRWVILPPFL

SEQ ID NO: 3886 - protein, 310 aa, Vitis vinifera
MKVTVVTRSGRELIKGGLELDESATVVDLQEAIHRRTKKYYPSRQRLTLPLQPGSKERPVALNYKKSVKDYCDGNSSNLTVVFKDLGPQISYRTLFFWEYLGPLLIYPIFYFFPVYQYFGYKGERLIHPVQTYALYYWCFHYFKRIMETFFVHRFSHATSPLSNVFRNCAYYWTFGSYIAYYVNHPLYTPVSDLQMKIGFGFGLVCQVTNFYCHILLRNLRSPDGNGGYQIPHGFLFNIVTCANYTTEIYQWVGFNIATQTVAGYVFLVVAAAIMTNWALAKHRRLRKLFDGKEGRPKYPRRWVILPPFL

SEQ ID NO: 3887 - protein, 310 aa, Medicago truncatula
MKVTVVSRSGREIVKGGIELNDSATVADLQEAIHKQTKKHPSRQRLTLPVQPGSKEKPVVLNYKKSLNDYTSGNSKTLTVTFKDLGPQVSYRTLFFFEYLGPLLLYPVFYYFPVVYQYFGYKGEHVIHPVQTYAMYYWCFHYAKRILETFFVHRFSHATSPLSNVFRNCAYYWTFGCYIAYYVNHPLYTPVSDLQMKIGFGFGILCQVSNFYCHIILRNLRGPAGEGGYQIPRGFLFNIVTCANYTTEIYQWLGFNIATQTIAGYIFLAVAAFIMTNWALAKHRRLKKLFDGKEGRPRYPRRWVILPPFL

SEQ ID NO: 3888 - protein, 310 aa, Parthenium argentatum
MKVTVTTRSGRELINGGLVLDSSATVADLQEAIHQRVKKYYPSRQRLTLPLQPGSKEKAVVLQSKKSLKEYTSGNSDTLTVVFKDLGPQVSYRTLFFFEYLGPLILYPVFYYFPVYQIFGYKGERVIYPVQTYALYYWCFHYFKRIMETFFVHRFSHATSPLSNVFRNCAYYWTFGCYIAYYVNHPQYTPVSDLQMKIGFGFGLVMQVANLYCHIILRNLRSPSGNGGYQIPQGFLFNIVTCANYTTEIYQWLGFNIATQTVAGYIFLVVAASIMTNWALAKHRRLRRLFDGKEGRPKYPRRWVILPPFL

SEQ ID NO: 3889 - protein, 310 aa, Prunus persica
MKVTVVSRSGREVVKGGLELSDSATVTDLQEAIHKRTKKFYPARQRLTLPVQPGSKERPVVLNYKKSLKDYISENSDNLTVVFKDLGPQVSYKTLFFFEYLGPLVLYPIFYYFNVYQYLGFKGDRVIRPVQTYALYYWCFHYFKRIMETFFVHRFSHATSPLLNVFRNCAYYWSFGSYIAYYVNHPLYTPVSDLQMKIGFAVGIIFQISNFYCHILLRNLRRPDGNGGYQIPRGFLFNFVTCANYTTEIYQWLGFNIATQTVAGYVFLVVAASIMTNWALAKHRRLKKIFDGKDGRPKYPRRWVILPPFL

SEQ ID NO: 3890 - protein, 310 aa, Chenopodium quinoa
MKVLVVTRSGKELLKGGIELNDSATVSDLQEAIHKRTKKYYPSRQRLTLPVQSGSKERPTVLNSKKSLKEYSDGNSNTLTVVFKDLGPQVSYRTLFFFEYLGPLVIYPIFHYLPVYRYFGYKEERVIHPVQTYACYYWCFHYFKRIMETFFVHRFSHATSPLSNVFRNCLYYWTFGAFIAYYVNHPLYTPVSELQWKIGFGFGLLCQLSNFYCHILLKNLRRPDGNGGYQIPRGFLFNIVTCANYTTEIYQWVGFNIATQTVAGYVFAVVAAGIMTNWALAKHRRLKKLFDGKDGKPKYPRRWVILPPFL

SEQ ID NO: 3891 - protein, 310 aa, Helianthus annuus
MKVTVTTRSGRELINGGLVLDSSATVADLQEAIHQRIKKYYPSRQRLTLPLQPGSKEKAVVLQSKKSLKEYTNGNSDTLTVVFKDLGPQVSYRTLFFFEYLGPLILYPVFYYFPVYQIFGYKGERVIHPVQTYALYYWCFHYFKRIMETFFVHRFSHATSPLSNVFRNCAYYWTFGCYIAYYVNHPHYTPVSDLQMKIGFGFGSVMQVANLYCHIILRNLRNPSGNGGYQIPKGFLFNIVTCANYTTEIYQWLGFNIATQTVAGYIFLVVAASIMTNWALAKHRRLRRLFDGKEGRPKYPRRWVILPPFL

SEQ ID NO: 3892 - protein, 310 aa, Eutrema halophilum
MKVTVVSRSGREVLKGPLDLPDSATVADLQEAFHKRAKKFYPSRQRLTLPVAPGSKDKPVVLNSKKSLKDYCDGNTDSLTVVFKDLGAQVSYRTLFFFEYLGPLLIYPLFYYFPVYKFLGYGEDRVIHRVQTYAMYYWCFHYFKRILETFFVHRFSHATSPIANVFRNCAYYWSFGAYIAYYVNHPLYTPVSDLQMKIGFGFGLVCQVANFYCHILLKNLRDPNGSGGYQIPRGFLFNIVTCANYTTEIYQWLGFNIATQTIAGYVFLAVAALIMTNWALGKHSRLRKIFDGKDGKPKYPRRWVILPPFL

SEQ ID NO: 3893 - protein, 311 aa, Beta vulgaris
MKVLVVTRSGRELLKGGIELNDSATVADLQEAIHKKTKKFYPSRQRLTLPLQPGSKGRPTVLDSKKSLKEYSDGNPNNITVVFKDLGPQVSYRTLFFCEYLGPLIIYPIFHYLPVYQYFGYKEERVIHPVQTYACYYWCFHYFKRIMETFFVHRFSHATSPLSNVFRNCMYYWTFGAFIAYYVNHPLYTPVSNDLQWKIGFGFGLLCQLSNFYCHILLKNLRGPGGSGGYQIPSGFLFNIVTCANYTTEIYQWVGFNIATQTVAGYVFLVVAAGIMTNWALAKHRRLKKLFDGKDGKPKYPRRWVILPPFL

SEQ ID NO: 3894 - protein, 310 aa, Musa acuminata
MKIILVSRSAKEVIKGGIELHDEATVSDLQEAIYARTKKFYPSRQRLTLPLQSGNQGKPVVLSPKKKLVEYCDGNVKSLTVVFKDLGVQVLYSTLFFWEYLGPLIIYPIFYYFPVYKYFGYEGERVIYPVQTYATCYWCLHYFKRIMETFFVHRFSHATSPLSNVFRNCAYYWTFGTYIAYHVNHPLYTPVSDLQMKIGFGFGLICQVSNFYCHLILRNLRSPDGNGGYQIPRGFLFNIVTCANYTTEIYQWLGFNIATQTIAGYVFLVVATLIMTNWALAKHRRLKKLFDGKDGRPRYPRRWVILPPFI

SEQ ID NO: 3895 - protein, 310 aa, Cannabis sativa
MKVNVISRSGREVIKGGLELNDSATVDDLQEAIHKRTKKFYPSRQRLTLPVQQGSKERPVVLSSKKSLKEYTNGNSNDLTVVFKDLGPQVSYRTLFFFEYLGPLIIYPLFYYFPVYRYFGFKDERVIYPVQTFALYYWCFHYFKRIMETFFVHRFSHATSPLSNVFRNCLYYWSFGSYIAYYVNHPLYTPVSDLQMKIGFGFGILCQISNFYCHILLSNLRGADGSGGYQIPRGFLFNIVTCANYTTEIYQWLGFNIATQTIAGYIFLVVAAYIMTNWALAKHRRLKKLFDGKDGRPKYPRRWIILPPFL

SEQ ID NO: 3896 - protein, 309 aa, Vigna unguiculata
MKVTVVSRSGREVVKGGVHLSDSATVADLQEAIHKQTKKHPSRQRLTLPVQPGSKERPVVLNYKKSLKEYTSGNSETLTVVFKDLGPQVSYRTLFFCEYLGPLLLYPVFYYFPVYKYFGYKGERVIHPVQTYALYYWCFHYAKRILETFFVHRFSHATSPLSNVFRNCAYYWSFGSYIAYYVNHPLYTPVSDLQIKIGFGFGILCQISNFYCHIILKNLRSPGGEGGYQIPKGFLFNIVTCANYTTEIYQWLGFNIATQTVAGYIFLLVATFIMTNWAFAKHRRLKKLFDGKDGRPRYPRRWIILPPFL

SEQ ID NO: 3897 - protein, 310 aa, Echinacea purpurea
MQVTVTTRSGRELINGGLVLDSSATVADLQEAIHQRIKKYYPSRQRLTLPLQPGSKEKAVVLQSKKSLKEYTDGNSDTLTVVFKDLGPQVSYRTLFFFEYLGPLILYPVFYYFPVYQFFGYKGERVIHPVQTYALYYWCFHYFKRIMETFFVHRFSHATSPLSNVFRNCAYYWTFGCYIAYYVNHPHYTPVSDLQMKIGFGFGLVMQFANLYCHIILRNLRSPSGNGGYQIPQGFLFNIVTCANYTTEIYQWLGFNVATQTVAGYVFLVVAASIMTNWALAKHRRLRRLFDGKEGRPKYPRRWVILPPFL

SEQ ID NO: 3898 - protein, 310 aa, Nicotiana benthamiana
MKVLVVTRSGKELIKGGLELTDSATVTDLQEAIHKRTRKYYPSRQRLTLPVQPGSKERPTVLHYKKSLNEYTNGSTSELTVVFKDLGPQVKYSTLFFWEYLGPLVLYPIIYYFPVYKFFGYKEQRVIHPVQTYAMYYWCFHYFKRIMETFFVHRFSHATSPLSNVFRNCAYYWSFGAFIAYYVNHPLYTPVSDLQMKIGFGFGLVCQVANFYCHLLLRNLRSPSGNGGYQIPYGFLFNIVTCANYTTEIYQWLGFNIATQTVAGYVFMVVAASIMTNWALGKHRRLRKLFDGKEGRPKYPRRWVILPPFL

SEQ ID NO: 3899 - protein, 310 aa, Olea europaea
MKVVVTTRSGRELIKGGLELSDSATVADLQEAIYKRTKKYYPSRQRLTLPIPPGSKEKPTVLHYKKSLKEYTDGNGDTLTVVFKDLGPQVKYSTLFFWEYLGPLILYPMFYYYPVYQFFGYKKERVIYPVQTYALYYWCFHYFKRIMETFFVHRFSHATSPLSNVFRNCAYYWSFGAYIAYYVNHPLYTPVSDLQMKIGFVFGLLCQIANFYCHILLRNLRGADSGGGYQIPHGFLFNIITCANYTTEIYQWLGFNIATQTVAGYIFMVVAASIMTNWALAKHRRLKKLFDGKEGRPKYPRRWVILPPFL

SEQ ID NO: 3900 - protein, 310 aa, Populus trichocarpa
MKVTVVSRSGREVIKGGLELSDSATVADLQEAIHKRTKKFYPSRQRLTLPLPPGSKERPVVLSYKKNLKEYCDGNLGNLTVVFKDLGPQVSYRTLFFCEYLGPLVLYPVFYYFPVYEFFGYKGKRIIHPVQTYALYYWCFHYFKRIMETFFVHRFSHATSPLSNVFRNCAYYWTFGSFIAYYVNHPLYTPVSDLQMKIGFGFGLVCQLANLYCHMLLRNLRRPGGNGGYQIPSGFLFNIVTCANYTTEIYQWLGFNVATQTVSGYFFLVVATSIMTNWALAKHRRLKKLFDGKDGRPRYPRRWVILPPFL

SEQ ID NO: 3901 - protein, 310 aa, Primula obconica
MKVAVVTRSGRELVKGGLDLHDSATVADLQEAIHKRTKKYYPSRQRLTLPVQPGSKEKPVVLQYKKSLKDYSDGNINNLTVQFKDLGPQVSYRTLFFFEYLGPLLIYPIFYYFPVYQYFGYKENRVIHQVQTYAMYYWCFHYFKRIMETFFIHRFSHATSPLSNVFRNCFYYWTFGAYIAYYVNHPLYTPVGDLQMKIGFAFGVLCQISNFYCHILLSKLRSPGGEGGYQIPRGFLFNIVTCANYTTEIYQWLGFNIATQTIAGYIFMVVAASIMTNWAFAKHRRLRKLFDGKDGRPKYPRRWVILPPFL

SEQ ID NO: 3902 - protein, 310 aa, Chenopodium quinoa
MKVSVVTRSGKELLKGGIELNDSATVSDLQEAIHKRTKKYYPSRQRLTLPVQPGSKERPTVLSSKKSLKEYSDGNSNTITVVFKDLGPQVSYRTLFFFEYLGPLVIYPIFHYLPVYRFFGYKEERVIHPVQTYACYYWCFHYFKRIMETFFVHRFSHATSPLSNVFRNCLYYWTFGAFIAYYVNHPLYTPVSDLQWKIGFGFGLLCQLSNFYCHILLKNLRRPDGNGGYQIPRGFLFNIVTCANYTTEIYQWVGFNIATQTVAGYVFAVVAAGIMTNWALAKHRRLKKLFDGKDGKPKYPRRWVILPPFL

SEQ ID NO: 3903 - protein, 310 aa, Solanum phureja
MKVLVVTRSGKELIKGGLELNDSATVADLQEAIHKRTRKFYPSRQRLTLPVQPGSKERPTVLHYQKSLSEYTKGSTGELTVVFKDLGPQVKYSTLFFFEYLGPLLLYPIFYYFPVYKYFGYKEERVIHPVQTYALYYWCFHYFKRIMETFFVHRFSHATSPIANVFRNCAYYWSFGAFIAYFVNHPLYTPVSDLQMKIGFGFGIVCQVANLYCHLLLRNLRSPSGNGGYQIPRGFLFNIVTCANYTTEIYQWLGFNVATQTVAGYIFMIVAASIMTNWALGKHRRLKKLFDGKEGRPKYPRRWVILPPFL

SEQ ID NO: 3904 - protein, 310 aa, Eutrema parvulum
MKVTVVSRSGREVLKGPLDLPDSATVADLQDAFHKRAKKFYPSRQRLTLPVAPGSKDKPVVLNSKKSLKEYSDGNTDSLTVVFKDLGAQVSYRTLFFFEYLGPLLIYPVFYYFPVYKFLGYGEDRVIHPVQTYAMYYWCFHYFKRILETFFVHRFSHATSPIANVFRNCAYYWSFGAYIAYYVNHPLYTPVNDLQMKIGFGFGLLCQAANFYCHILLKNLRDPNGSGGYQIPRGFLFNIVTCANYTTEIYQWLGFNIATQTIAGYVFLAVAALIMTNWALGKHSRLRKIFDGKDGKPKYPRRWVILPPFL

SEQ ID NO: 3905 - protein, 310 aa, Nicotiana tabacum
MKVLVVTRSGKELIKGGLELTDSATVTDLQEAIHKRTRKYYPSRQRLTLPVQPGSKERPTVLHYKKSLNEYINGGTNELTIVFKDLGPQVKYSTLFFWEYLGPLVLYPIIYYFPVYKFFGYKEERVIYPVQTYAMYYWCFHYFKRIMETFFVHRFSHATSPLSNVFRNCAYYWSFGAFIAYYVNHPLYTPVSDLQMKIGFGFGLVCQVANFYCHLLLRNLRSPSGNGGYQIPYGFLFNIVTCANYTTEIYQWLGFNIATQTVAGYVFMVVAASIMTNWALGKHRRLRKLFDGKEGRPKYPRRWVILPPFL

SEQ ID NO: 3906 - protein, 311 aa, Centaurea maculosa
MKVTVTTRSGRELINGGLVLDSSATVADLQEAIHQRIKKYYPSRQRLTLPLQPGSKAKPVVLQSKKSLKEYTTGSSDNITVVFKDLGPQVSYRTLFFFEYLGPLILYPVFYYFPVYQFFGYKVEERVIRPIQTYAMYYWCFHYFKRIMETFFVHRFSHATSPLSNVFRNCAYYWSFGCYIAYYVNHPLYTPVSDLQMKIGLGFGLIMQLSNLYCHIILRNLRSPSGNGGYQIPQGFLFNIVTCANYTTEIYQWLGFNIATQTVAGYIFLVVAASIMTNWALAKHRRLRRLFDGKEGRPKYPRRWVILPPFL

SEQ ID NO: 3907 - protein, 310 aa, Trigonella foenum-graecum
MKVTVVSRSGREIVKGGIELNDSATVADLQEAIHKRTKKHPSRQRLTLPVQPGSKEKPVVLNYKKSLNDYTSGNSETLTVTFKDLGPQVSYRTLFFFEYLGPLLLYPVFYYFPAVYQYFGYKGERVIHPVQTYAMYYWCFHYAKRILETFFVHRFSHATSPLSNVFRNCAYYWTFGCYIAYYVNHPLYTPVSDLQMKIGFGFGILCQVSNFYCHIILRNLRGPAGEGGYQIPRGFLFNIVTCANYTTEIYQWLGFNVATQTIAGYVFVAVATFIMTNWALAKHRRLKKLFDGKEGRPRYPRRWVILPPFL

SEQ ID NO: 3908 - protein, 207 aa, Tabernaemontana elegans
MKVAVVTRSGRELVKGGLELNDSATVADLQEAIHKRTKKYYPSRQRLTLPLQPASKEKPTVLNDKKSLKEYTRGSENQLTVVFKDLGPQVNYSTLFFWEYLGPLVLYPVFYYFNVYQYLGYKGERVIPPVQTYALYYWCFHYFKRIMETFFVHRFSHATSPLSNVFRNCAYYWSFGSFIAYYVNHPLYTPVSDLQMKIGFGFGWFVN

SEQ ID NO: 3909 - protein, 309 aa, Lotus japonicus
MKVTLVSRSGREIVKGGIGLSDSATVADLQEAIHKRTKKHPSRQRLTLPVQPGSKEKPVVLNYKKNLKDYTDGNSETLTLVFKDLGPQVSYRTLFFFEYLGPLLLYPVFYYFPVYQYFGYKNERVIRPVQTYAMYYWCFHYAKRILETFFVHRFSHATSPLSNVFRNCAYYWTFGSYIAYYVNHPLYTPVSDLQIKIGFGFGILCQVANFYCHIILRSLRGPGGEGGYQIPRGFLFNIVTCANYTTEIYQWLGFNIATQTVAGYIFLAVATFIMTNWALAKHRRLKKLFDGKEGRPRYPRRWVILPPFL

SEQ ID NO: 3910 - protein, 310 aa, Olea europaea
MKVVVTTRSGRELIKGGIELSDSDTVADLQEAIHKRTKKYYPSRQRLTLPIPPGSKEKPTVLHYKKSLKEYTDGNGDTLTVVFKDLGPQVKYSTLFFWEYLGPLILYPVFYYYPVYRFFGYKGERVIHPVQTYALYYWCFHYFKRIMETFFVHRFSHATSPLSNVFRNCAYYWSFGAFVAYYVNHPLYTPVNDLQMKIGFGFGLLCQIANFYCHILLRNLRGADSGGGYQIPRGFLFNIVTCANYTTEIYQWLGFNIATQTVAGYVFMVVAASIMTNWALAKHRRLKKLFDGREGRPRYPRRWVILPPFL

SEQ ID NO: 3911 - protein, 308 aa, Picea glauca
MKVSVVSRSGREIIKGGIDLSDNATVDDLKSSIHQRVKKYYPARQRLTLPQPGKGKPVVLERGKRLKDYFEKDEGKLVVVFKDLGPQVAYSTLFFWEYVGPLFIYPIFYYFPVYKYFGYPAERVIHPVQTYAMYYWCFHYAKRILETFFVHRFSHATSPLSNVFRNCCYYWTFGAVIAYFVNHPLYTPVSEKQIKIGFGLGIVCQVANFYCHILLRNLRIPGGKGGYQIPGGFLFNIVTCANYTTEIYQWLGFNIATQTVAGYTFLAVATFIMTNWALAKHRRLKKLFDGKDGRPKYPRRWVILPPFL

SEQ ID NO: 3912 - protein, 310 aa, Tripterygium wilfordii
MKVTVVSRSGREVIKGGLELSDSATVADLQEAIHRRTKKFYPSRQRLTLPQKPGSKERPVVFNYKKSLNEYCDGNSESLTVVFKDLGPQVSYRTLFFWEYVGPFVLYPIFYYFPVYQLFGYEGERVIRPVQTYAVYYWCFHYFKRIMETFFVHHFSHATSPLSNVFRNCAYYWSFGAYIAYYVNHPLYSPVGDLQTKIGFGIGLVCQLANFYCHILLKNLRSPDGNGGYQIPRGFLFNIVTCANYTTEIYQWLGFNIATQTVAGYIFMIVATLIMTNWALAKHRRLKKLFDGKEGRPKYPRRWVILPPFL

SEQ ID NO: 3913 - protein, 176 aa, Hordeum vulgare
MYYFCFHYFKRIMETFFVHRFSHATSPVSNVFRNCAYYWTFGAYIAYYCNHPLYTPVSDLQMKIGFGIGVVCQIANFYCHILLRNLRSPTGSGGYQIPRGFLFNIVTCANYTTEIYQWLGFNIATQTVAGYVFLAVAAAIMTNWALGKHSRLRKLFDGKDGRPKYPRRWVILPPFL

SEQ ID NO: 3914 - protein, 311 aa, Cirsium arvense
MKVTVTTRSGRELINGGLVLDSSATVADLQEAIHQRIKKYYPSRQRLTLPIQPGSKAKPVVLQSKKSLKEYTTGSSDNITVVFKDLGPQVSYRTLFFFEYLGPLILYPVFYYFPVYQFFGYKSEERVIRPIQTYAMYYWCFHYFKRIMETFFVHRFSHATSPLSNVFRNCAYYWSFGCYIAYYVNHPLYTPVSDLQMKIGLGFGLIMQLSNLYCHIILRNLRSPSGNGGYQIPQGFLFNIVTCANYTTEIYQWLGFNIATQTVAGYIFLVVAASIMTNWALAKHRRLRRLFDGKEGRPKYPRRWVILPPFL

SEQ ID NO: 3915 - protein, 61 aa, Zostera marina
MKVSVVSRSGREIIKGGIDLNDSALVSDLQDAIYSRTKNSIRLDNVLPFRWHLEPRGSLSF

SEQ ID NO: 3916 - protein, 310 aa, Ambrosia trifida
MKVSVTTRSGRELINGGLVLDTSATVADLQEAIHQRIKKYYPSRQRLTLPLQPGSKEKAVVLQQKKSLKEYTSGNSDTLTVVFKDLGPQVSYRTLFFFEYLGPLILYPVFYYFPVYQILGYKGERVIHPVQTYALYYWCLHYFKRIMETFFVHRFSHATSPLSNVFRNCAYYWTFGCYIAYYVNHPHYTPVSDLQMKIGFGFGLVMQVANLYCHIILRNLRSPSGNGGYQIPQGFLFNIVTCANYTTEIYQWLGFNIATQTVAGYVFLVVAASIMTNWALAKHRRLRRLFDGKEGRPKYPRRWVILPPFL

SEQ ID NO: 3917 - protein, 309 aa, Eschscholzia californica
MKVTIVSRSGREIVKGGIELNDSAKVTDLQEAIHVQTKKYYPSRQRLTLPLNPGSKEKPVVLNSKNNIRDYCDGNQDNLTVVFKDLGPQVSYRTLFFWEYVGPLIIYPIFYYFPVYQLLGYKEKIIHPFQTYAMYYWCFHYFKRIMETFFVHRFSHATSPVSNVFRNCAYYWTFGAYIAYYVNHPFYTPVSDLQMKTGFVFGLVCQISNLYCHLLLRNLRSPSGNGGYQIPQGFLFNLVTCANYTTEIYQWLGFNIATQTVAGYVFLVVAASIMTNWALAKHRRLRKLFDGKEGRPKYPRRWVILPPFL

SEQ ID NO: 3918 - protein, 308 aa, Pinus taeda
MKVSVVSRSGREIIKGGIDLSDNATVDDLKASIQQRVKKYYTARQRLTLPQSGKGKPVVLERGKRLKDYFEKDEGKLVVVFKDLGPQVSYSTLFFWEYVGPLFIYPIFYYFPVYKYFGYPAERVIHPVQTYAMYYWCFHYAKRILETFFIHRFSHATSPLSNVFRNCCYYWTFGAVIAYFVNHPLYTPVSEKQMKIGFGLGIVCQLANFYCHILLRNLRSPEGKGGYQIPSGFLFNIVTCANYTTEIYQWLGFNIATQTVAGYTFLVVATFIMTNWALAKHRRLKKLFDGKDGRPKYPRRWVILPPFL

SEQ ID NO: 3919 - protein, 184 aa, Ambrosia trifida
METFFVHRFSHATSPLSNVFRNCAYYWTFGCYIAYYVNHPHYTPVSDLQMKIGFGFGMVMQVANLYCHIILRNLRSPSGNGGYQIPQGFLFNIVTCANYTTEIYQWLGFNIATQTVAGYVFLVVAASIMTNWALAKHRRLRRLFDGKEGRPKYPRRWVILPPFCKRLQTWVVPHLPLFWIINWV

SEQ ID NO: 3920 - protein, 78 aa, Papaver somniferum
MKVTVVSRSGREIIKGGIQLSDSATVSNLQEAIHAKTKSTILRDNVSLFPSVLDPKTNLLCSTPRRIYPITVMLRRIT

SEQ ID NO: 3921 - protein, 310 aa, Musa acuminata
MKIILVSRSAKEVIKGGIELHDEATVSDLQEAIYARTKKFYPSRQRLTLPLQSGNQGKPVVLSPKKKLVEYCDGNAKTLTVVFKDLGVQVLYSTLFFWEYLGPLIIYPIFYYFPVYKYFGYEGERVIYPVQTYATCYWCLHYFKRIMETFFVHRFSHATSPLSNVFRNCAYYWTFGTYVAYHVNHPLYTPVSDLQMKIGFGFGLICQVSNFYCHLILRNLRSSDGNGGYQIPRGFLFNIVTCANYTTEIYQWLGFNIATQTIAGYVFLVVATLIMTNWALAKHRRLKKLFDGKDGRPRYPRRWVILPPFI

SEQ ID NO: 3922 - protein, 308 aa, Pinus pinaster
MKVSVVSRSGREIIKGGIDLSDNATVDDLKASIQQRVKKYYTARQRLTLPQSGKGKPVVLERGKRLKDYFEKDEGKLVVVFKDLGPQVAYSTLFFWEYVGPLFIYPIFYYFPVYKYFGYPAERVIHPVQTYAMYYWCFHYAKRILETFFIHRFSHATSPLSNVFRNCCYYWTFGAVIAYFVNHPLYTPVSEKQMKIGFGLGIVCQLANFYCHILLRSLRSPEGKGGYQIPSGFLFNIVTCANYTTEIYQWLGFNIATQTVAGYTFLVVATFIMTNWALAKHRRLKKLFDGKDGRPKYPRRWVILPPFL

SEQ ID NO: 3923 - protein, 310 aa, Quercus alba
MKVTVITRSGREIIKGGLDLNHSATVSDLQEAIHRRCKKYYPSRQRITLPVQPGSKERPVVLNPKKKIEDYYDGKSDHLTVIFKDLGPQVSYRTLFFWEYLGPLIIYPIFYYFPVYQYFGYGGERIIHPVQTYALYYWCFHYFKRIMETFFVHRFSHATSPLSNVFRNCAYYWTFGSLIAYYVNHPLYTPVSDLQMKIGFGFGLICQIANFYCHLILKSLRSPDGSGGYQIPHGFLFNILTCANYTTEIYQWLGFNIATQTVAGSVFLVVAAFIMTNWALAKHRRLKKLFDGKEGRPKYPRRWVILPPFL

SEQ ID NO: 3924 - protein, 310 aa, Petunia hybrida
MKVSVVTRSGKELIKGGLDLSDSATVVDLQEAIHKRTRKYYPSRQRLTLPVQPGSKERPTVLHYKKNLQEYAAGSKSELTVVFKDLGPQVNYSTLFFWEYLGPLLLYPIFYYFPVYKFFGYKEERVIHPAQSYAMYYWCFHYFKRIMETFFVHRFSHATSPLSNVFRNCAYYWSFGAFIAYYVNHPLYTPVSDLQMKIGFGFGIVCQVANFYCHLSLRNLRSPSGNGGHQIPRGFLFNIVTCANYTTEIYQWLGFNIATQTIAGYVFMIVAASIMTNWALAKHRRLKKLFDGKEGRAKYPRRWVILPPFL

SEQ ID NO: 3925 - protein, 309 aa, Cajanus cajan
MKVTVVSRSGREVVKGGIQLDDSATVADLQEAIHKRTKKHPSRQRLTLPVQPGSKERPVVLNYKKSLKDFTSGNSETLTVVFKDLGPQVSYRTLFFCEYLGPLLLYPVFYYFPVYQYFGYKGERVIHPVQTYALYYWCFHYAKRILETFFVHRFSHATSPLSNVFRNCAYYWTFGSFIAYYVNHPLYTPVGDLQMKIGFGFGILCQISNFYCHIILKNLRRPDGEGGYQIPKGFLFNIVTCANYTTEIYQWLGFNIATQTIAGYIFLVVATFIMTNWAFAKHRRLRKLFDGKDGRPRYPRRWIILPPFL

SEQ ID NO: 3926 - protein, 306 aa, Solanum tuberosum
VVTRSGKELIKGGLELNDSATVADLQEAIHKRTRKFYPSRQRLTLPVQPGSKERPTVLHYQKSLSEYTKGSTGELTVVFKDLGPQVKYSTLFFFEYLGPLLLYPIFYYFPVYKYFGYKEERVIHPVQTYALYYWCFHYFKRIMETFFVHRFSHATSPIANVFRNCAYYWSFGAFIAYFVNHPLYTPVSDLQMKIGFGFGIVCQVANLYCHLLLRNLRSPSGNGGYQIPRGFLFNIVTCANYTTEIYQWLGFNVATQTVAGYIFMIVAASIMTNWALGKHRRLKKLFDGKEGRPKYPRRWVILPPFL

SEQ ID NO: 3927 - protein, 310 aa, Rhizophora mangle
MKVTVVSRNGREVVKGGLELSDSAKVIDLQEAIYRRTREFYPSRQRLTLPLSPGSKERPVVLNCKKSVKEYCDGNLDNLTVVFKDMGPQVSYQILFFWEYLGPLVLYPVFYYFPVYQYFGYKGERVIHPVQTYALYYWCFHYFKRIMETFFVHRFSHATSPLSNVFRNCAYYWTFGSYIAYYVNHPLYTPVSDLQMKIGFAFGLLCQVSNVYCHLILRNLRSPDGSGGYQIPRGFLFNVVTCANYTTEIYQWLGFNIATQTVAGYVFLVVATGIMTNWALTKHRRLRKLFDGKDGRPKYPRRWVILPPFL

SEQ ID NO: 3928 - protein, 310 aa, Helianthus annuus
MKVTVTTRSGRELINGGLVLDDSATVADLQEAIHQKIKKYYPSRQRLTLPVEPGSKKKPTVLQHKKSLKEYTTENSDTITVVFKDLGPQVSYRTLFFFEYLGPLILYPVFYYFPVYQFFGYKDERVIHPVQTYAMYYWCLHYFKRIMETFFVHRFSHATSPLSNVFRNCAYYWTFGCYIAYYVNHPLYTPVSDLQMKIGFGFGLVMQVANLYCHVILRNLRSPSGNGGYQIPQGFLFNIVTCANYTTEIYQWLGFNVATQTVAGYVFLVVAASIMTNWALAKHRRLRRLFDGKEGRPKYPRRWVILPPFL

SEQ ID NO: 3929 - protein, 324 aa, Abies balsamea
MKVSVVSRSGREIIKGGIDLSDNATVDDLKASIQQRVKKYYAARQRLTLPQSGKGKPVILERGKKLKDYFEKDEGNLVVVFKDLGPQVAYSTLFFWEYVGPLFIYPIFYYFPVYKYFGYPAERVMHPVQTYAMYYWCFHYAKRILETFFVHRFSHATSPLSNVFRNCCYYWSFGAVIAYFVNHPLYTPVSEKQMKIGFGLGIVCQVANFYCHILLRNLRSPGGRGGYQIPSGFLFNIVTCANYTTEIYQWLGFNIATQTVAGYTFLVVAAFIMTNWALAKHRRLKKLFDGKDGRPKYSKAMGDITSFPMKGCILMCETTFVQFY

SEQ ID NO: 3930 - protein, 310 aa, Trifolium pratense
MKVTVVSRSGREIVKGGIELNDSATVADLQEAIHKRTKKHPSRQRLTLPVQPGSKERPVVLNYKKSLNDYTSGNSETLTVTFKDLGPQVSYRTLFFFEYLGPLLLYPVFYYFPVVYQYFGYKGERVIHPVQTYALYYWCFHYAKRILETFFVHRFSHATSPISNVFRNCLYYCTFGSYIAYYVNHPLYTPVSDLQIKIGFGFGILCQISNFYCHIILRNLRGPAGEGGYQIPRGFLFNIVTCANYTTEIYQWLGFNIATQTIAGYIFLAVATFIMTNWALAKHRRLKKLFDGKEGKPRYPRRWVILPPFL

SEQ ID NO: 3931 - protein, 311 aa, Centaurea maculosa
MKVTVTTRSGRELINGGLVLDSSATVADLQEAIHQLIKKYYPSRQRLTLPLQPGSKAKPVVLQSKKSLKEYTTGSSDNITVVFKDLGPQVSYRTLFFFEYLGPLILYPVFYYFPVYQFFGYKVEERVIRPIQTYAMYYWCFHYFKRIMETFFVHRFSHATSPLSNVFRNCAYYWSFGCYIAYYVNHPLYTPVSDLQMKIGLGFGLVMQLSNLYCHIILRNLRSASGNGGYQIPQGFLFNIVTCANYTTEIYQWLGFNIATQTVAGYIFLVVAASIMTNWALAKHRRLRRLFDGKEGRPKYPRRWVILPPFL

SEQ ID NO: 3932 - protein, 311 aa, Cirsium arvense
MKVTVTTRSGRELINGGLVLDSSATVADLQEAIHQRIKKYYPSRQRLTLPIQPGSKVKPVVLQSKKSLKEYTTGSSDNITVVFKDLGPQVSYRTLFFFEYLGPLILYPVFYYFPVYQFFGYKVEERVIRPIQTYAMYYWCFHYFKRIMETFFVHRFSHATSPLSNVFRNCAYYWSFGCYIAYYVNHPHYTPVSDLQMKIGLGFGLVMQLSNLYCHIILRNLRSPSGNGGYQIPQGFLFNIVTCANYTTEIYQWLGFNIATQTVAGYIFLVVAASIMTNWALAKHRRLRRLFDGKEGRPKYPRRWVILPPFL

SEQ ID NO: 3933 - protein, 311 aa, Cirsium arvense
MKVSVTTRSGRELINGGLVLDSSATVADLQEAIHQRIKKYYPSRQRLTLPIQPGSKVKPVVLQSKKSLKEYTTGSSDNITVVFKDLGPQVSYRTLFFFEYLGPLILYPVFYYFPVYQFFGYKVEERVIRPIQTYAMYYWCFHYFKRIMETFFVHRFSHATSPLSNVFRNCAYYWSFGCYIAYYVNHPLYTPVSDLQMKIGLGFGLIMQLSNLYCHIILRNLRSPSGNGGYQIPQGFLFNVVTCANYTTEIYQWLGFNIATQTVAGYIFLVVAASIMTNWALAKHRRLRRLFDGKEGRPKYPRRWVILPPFL

SEQ ID NO: 3934 - protein, 263 aa, Cocos nucifera
MLPRQPGAQGKPVVLNSKSCLTDYCDKNANSLTVVFKDLGIQVFYRTLFFWEYLGPLFIYPIFYYFPVYKYFGYEGEHVIHPVQTYAMYYWCFHYFKRIMETFFVHRFSHATSPLTNVFRNCAYYWTFGAYIAYYVNHPLYMPVSDLQMKIGFGFGLICQVSNFYCHLLLRNLRSPDSNGGYQIPRGFLFNIVTCANYTTEIYQWLGFNIATQTVAGYVFLVVAALIMTNWALAKHCWLQKLFDGKEGRPRYPRRWVILPPFI

SEQ ID NO: 3935 - protein, 310 aa, Aquilegia formosa
MKVSVVSRSGRDIIKGGVELNDKATVSDLQEAIHRRTKKYYPSRQRLTLPLQPGSKGKAVVLDPKKSLRDYCDGTSENLTVVFKDLGPQVSYSTLFFFEYLGPLIIYPIFYYLPVYRYLGYKEERTIHPVQTYAMYYWCFHYFKRIMETFFVHRFSHATSPISNVYRNCFYYWSFGAYVAYYVNHPLFTPVSDLQMKIGFGLGLLCQVSNFYCHLLLRSLRSPDGKGGYQIPRGFLFNFVTCANYTTEIYQWLGFNIATQTVAGYVFLIVAASIMTNWALGKHRRLVKLFNGKDGKPKYPWRWAILPPFI

SEQ ID NO: 3936 - protein, 310 aa, Aristolochia fimbriata
MKVNLVSRSGREIVKGGIEIKSEATVSDLQEAIHRRTKKYYPSRQRLTLPLKPGTQGRPVVISPKKSLQDYVDGNVDNLTVVFKDLGPQVSYSTLFFWEYLGPLTIYPIFYYFPVYQYFGYKGERVIHPVQTYAMYYWCFHYFKRIMETFFVHRFSHATSPVSNVFRNCAYYWTFGAYIAYHVNHPLYTPVGDLQMNFGFAFGLVCQISNFFCHILLRNLRSTDGNGGYQIPRGFLFNIVTCANYTTEIYQWLGFNIATQTVAGYVFLVVATAIMSNWAMAKHRRLKKLFDGKEGRPKYPRRWVILPPFF

SEQ ID NO: 3937 - protein, 307 aa, Cedrus atlantica
MKVSVVSRSGREIIKGGIDLSDNATVDDLKASIQQRVRKYYPARQRLTLPQTGRGKPVALERGKRLKDYFEKDEGNVVVFKDLGPQVAYSTLFFWEYVGPLFIYPIFYYFPVYKYFGYPAERVIHPVQTYAMYYWCFHYAKRILETFFVHRFSHATSPLSNVFRNCCYYWTFGAIIAYFVNHPLYTPVSEKQMKIGFGLGIICQLANFYCHILLRNLRGPGGSGGYQIPSGFLFNIVTCANYTTEIYQWLGFNIATQTVAGYTFLAVATFIMTNWALAKHRRLKKLFDGKDGRPKYPRRWVILPPFL

SEQ ID NO: 3938 - protein, 310 aa, Cirsium arvense
MKVTVTTRSGRELINGGLVLDSSATVADLQEAIHQRIKKYYPSRQRLTLPLQPGSKAKPVVLQSKKSLKEYTSGSSDNITVVFKDLGTQVSYRTLFFFEYLGPLILYPVFYYFPVYQYFGYKDERVIRPIQTYAMYYWCFHYFKRIMETFFVHRFSHATSPLSNVFRNCAYYWSFGCYIAYYVNHPLYTPVSDLQIKIGLGFGLIMQLSNLYCHIILRNLRSPSGNGGYQIPQGFLFNIVTCANYTTEIYQWLGFNIATQTVAGYIFLVVAAFIMTNWALAKHCRLRRLFDGKEGRPKYPRRWVILPPFL

SEQ ID NO: 3939 - protein, 310 aa, Coffea canephora
MKVTVVTRSGRELVKGGLDLDDSATVADLQEAIHKRTKRYYPSRQRLTLPLPPGSKEKPTILHYKKSLKEYIGESTNELTVAFKDLGPQVAYSTLFFWEYLGPLILYPLFYFFNVYQFFGYKGKRVIHPVQTYALYYWCFHYFKRIMETFFVHRFSHATSPLSNVFRNCAYYWSFGSYIAYYVNHPLYTPVNDLQVKIGFGIGLACQLANFYCHILLRKLRPADGSGGYQIPRGFLFNIVTCANYTTEIYQWLGFNIATQTVAGYVFMVVAAAIMTKWALAKHRRLRKLFDGKDGRPKYPQRWVILPPFL

SEQ ID NO: 3940 - protein, 310 aa, Papaver somniferum
MKVSVVSRSGREIVKGGIELNDSATVSDLQEAIHRRTKKYYPSRQRLTLPLEPGAKGKPIVLDYKKTIQDYCDGNSNSITVVFKDLGAQVYYSTLFFWEYFGPLIIYPIFYYFDLYQYLGFKGERVIHPVQTYAMYCWCFHYFKRIMETFFVHRFSHATSPLSNVFRNCAYYWSFGSYIAYYVNHPLYTPVSDLQMKIGFGFALVCQLSNFYCHILLRNLRSPDGKGGYQIPCGFLFNLVTCANYTTEIYQWIGFNIATQTVAGYVFAAVAAFIMTNWALAKHRRLKKLFDGKEGRAKYPRRWVILPPFI

SEQ ID NO: 3941 - protein, 310 aa, Papaver somniferum
MKVSVVSRSGREIIKRGIELNDSATVSDLQEAIHRRTKKYYPSRQRLTLPLEPGTKGKPIVLDYKKTIQDYCDGNSNSITVVFKDLGTQVYYSTLFFWEYFGPLIIYPIFYYFDLYQYLGFKGERVIHPVQTYAMYCWCFHYFKRIMETFFVHRFSHATSPLSNVFRNCAYYWSFGSYIAYYVNHPLYTPVSDLQMKIGFGFALVCQLSNFYCHILLRNLRSPDGKGGYQIPRGFLFNLVTCANYTTEIYQWIGFNIATQTVAGYIFAAVAAFIMTNWALAKHRRLKKLFDGKEGRAKYPRRWVILPPFI

SEQ ID NO: 3942 - protein, 308 aa, Pseudotsuga menziesii
MKVSVVSRSGREIIKGGIDLNDNANVDDLKASIQQRVKKYYPARQRLTLPQSGKGKPVVLERGKRLKDYFEKDEGKLVVVFKDLGPQVAYSTLFFWEYVGPLFIYPIFYYFPVYKYFGYPAERVIHPVQTYAMYYWCFHYAKRILETFFVHRFSHATSPLANVFRNCCYYWSFGAVIAYFVNHPLYTPVSEKQMKIGFGLGIVCQVANFYCHILLRNLRIPGGKGGYQIPSGFLFNIVTCANYTTEIYQWLGFNIATQTVAGYTFLAVATFIMTNWALAKHRRLKKLFDGKDGRPKYPRRWVILPPFL

SEQ ID NO: 3943 - protein, 310 aa, Rosa hybrid cultivar
MKVTVVTRSGRELFKGGLELSDSATVADLQEEIHKRSKKFYPSRQRLTLPVKPGSKEKAVVLASKKSLKDYYSGNSDNLTVVFKDLGPQVEYRTLFFFEYIGPLLIYPIFYFFPVYQYLGFKGDRVIHPVQTYALYYYCFHYFKRIMETFFIHRFSHATSPLSYVSRNCAYYWSFAALMAYYVNHPLYTPVSDLQMKIGFGFGIICQIANLYCHILLRNLRSPDGSGGYQIPCGFLFNIVTCANYTTEIYQWLGFNIATQTVAGYLFAVVAASIMTNWALGKHRRLKKLFDGKDGRPKYPRRWVILPPFL

SEQ ID NO: 3944 - protein, 310 aa, Fragaria vesca
MKVTVVTRSGRELFKGGLELSDSATVADLQEEIHKRSKKFYPSRQRLTLPVQPGSKEKAVVLTSKKSLKDYYSGNSDNLTVVFKDLGPQVEYRTLFFFEYIGPLLIYPIFYFFPVYQYLGFKGDRVIHPVQTYALYYYCFHYFKRIMETFFIHRFSHATSPVSYVTRNCAYYWSFAALMSYYVNHPLYTPVSDLQMKIGFGFGIINQIANFYCHILLRNLRSPDGSGGYQIPRGFLFNIVTCANYTTEIYQWLGFNIATQTVAGYLFAVVAASIMTNWALGKHRRLKKLFDGKDGRPKYPRRWVILPPFL

SEQ ID NO: 3945 - protein, 310 aa, Helianthus annuus
MKVTVTTRSGRELINGGLVLDSSATVADLQEAIHQKIKKYHPSRQRLTLPVEPGSKKKPTVLQHKKSLKEYTTESSDTITVVFKDLGPQVSYRTLFFFEYLGPLILYPVFYYFPVYQFFGYKDERVIHPVQTYAMYYWCLHYFKRIMETFFVHRFSHATSPLSNVFRNCAYYWTFGCYIAYYVNHPLYTPVSDLQMKIGFGFGLVMQVANLYCHVILRNLRSPSGNGGYQIPQGFLFNIVTCANYTTEIYQWLGFNIATQTVAGYVFLVVAASIMTNWALAKHRRLRRLFDGKEGRPKYPRRWVILPPFL

SEQ ID NO: 3946 - protein, 309 aa, Valeriana officinalis
MKVTVTSRGGKEFIKGGLDLNDSATVADLQEAIYKRTKKYYPSRQRLTLPLQPGSKDKPTVLQQKKNLKDYTDGNTDTLTVIFKDLGPQVSYRTLFFFEYLGPLIIYPLFYYLPLYKFFGYNVDQVKRPVQTYAMYYWCFHYFKRIMETFFIHRFSHATSPLSNVFRNCAYYWSFGAYIAYYVNHPLYTPVCDLQMKIGFGFGLVNQIANLYCHILLRNLRGTGNGGYQIPRGFLFNFVTCANYTTEIYQWLGFNIATQTVAGYVFLVVAASIMTNWALAKHRRLRRLFDGKEGRPKYPRRWVILPPFL

SEQ ID NO: 3947 - protein, 309 aa, Vinca minor
KVSVVTRSGRELVKGGIDLNDSATVADLQEAIHKRTKKFYPSRQRLTLPLQPGSKEKPTVLHYKKSLKEYSSGSDDSLTVVFKDLGPQVNYSTLFFFEYLGPLVLYPVFYFFNVYQYLGFKGERIIHPVQTYALYYWCFHYFKRIMETFFVHRFSHATSPIANVFRNCAYYWSFGCLIAYYVNHPLYTPVSDLQMKIGFGLGLVCQIANFYCHILLRSLRGADGSGGYQIPRGFLFNIVTCANYTTEIYQWLGFNIATQTATGYFFMVVAASIMTNWALAKHRRLRKIFDGKDGRPKYPRRWVILPPFL

SEQ ID NO: 3948 - protein, 311 aa, Chrysanthemum coronarium
MKVVVTTRSGRELINGGLDLDSSSATVADLQNAIHQKTKKYYPSRQRLTLPLQAGSKDKPVVLQSKKSLKEYTSGSSDTITVVFKDLGPQVSYQTLFFFEYLGPLILYPVFYYFPVYQFFGYKGERVMRPAQTYALYYWCFHYFKRIMETFFVHRFSHATSPISNVFRNCAYYWSFGCYIAYYVNHPLYTPVSDLQMKIGFGFGAIMQVANLYCHIILRNLRSPSGPGGYQIPRGFLFNIVTCANYTTEIYQWLGFNIATQTVAGYVFLVVAASIMTNWAIAKHTRLRRLFDGKEGRPKYPRRWVILPPFF

SEQ ID NO: 3949 - protein, 311 aa, Centaurea maculosa
MKVTVTTRSGRELINGGLVLDSSATVADLQEDIHQRIKKYYPSRQRLTLPVQPGSKVKPIVLQSKKSLKEYTTGSSDNITVVFKDLGPQVSYRTLFFFEYLGPLILYPVFYYFPVYQFFGYKVEERVIRPIQTYAMYYWCFHYFKRIMETFFVHRFSHATSPLSNVFRNCAYYWSFGCYIAYYVNHPLYTPVSDLQMKIGLGFGLIMQLSNLYCHIILRNLRSPSGNGGYQIPRGFLFNVVTCANYTTEIYQWLGFNIATQAVAGYIFLVVAASIMTNWALAKHRRLRRLFDGKEGRPKYPRRWVILPPFL

SEQ ID NO: 3950 - protein, 311 aa, Centaurea maculosa
MKVTVTTRSGRELINGGLVLDSSATVADLQEAINQRIKKYYPSRQRLTLPIQPGSKVKPVVLQSKKSLKEYTTGSSDNITVVFKDLGPQVSYRTLFFFEYLGPLILYPVFYYFPVYQFFGYKVEERVIRPIQTYAMYYWCFHYFKRIMETFFVHRFSHATSPLSNVFRNCAYYWSFGCYIAYYVNHPHYTPVSDLQMKIGLGFGLVMQLSNLYCHIILRNLRSPSGNGGYQIPQGFLFNIVTCANYTTEIYQWLGFNIATQTVAGYIFLVVAASIMTNWALAKHRRLRRLFDGKEGRPKYPRRWVILPPFL

SEQ ID NO: 3951 - protein, 238 aa, Tragopogon dubius
MKVTVTTRSGRELINGGLVLDSSDTVADLQEAIHRRIKKYYPSRQRLTLPLQPGSKEKPVVLQYKKSLKEYTTGNSDTLTVVFKDLGPQVSYRTLFFFEYLGPLILYPVFYYFPVYQFFGYNNKRVIHPIQTIAMYYWCFHYFKRIMETFFVHRFSHATSPLSNVFRNCAYYWSFGCYIAYYVNHPLYTPVSNDLQVKIGVGVWVGYANFEFVLPCHTEESSWARWEWRVSDSARVFV

SEQ ID NO: 3952 - protein, 176 aa, Thalictrum flavum
MYYWCFHYFKRIMETFFVHRFSHATSPLSNVFRNCFYYWSFGAYVAYYANHPLYTPVSDLQMKIGFGLGLLCQVSNFYCHLLLRSLRSPDGKGGYQIPRGFLFNFVTCANYTTEIYQWLGFNIATQTVAGYVFLVVAASIMTNWALGKHRRLVKLFNGKDGKPKYPWRWAILPPFI

SEQ ID NO: 3953 - protein, 310 aa, Amaranthus tuberculatus
MKVSVVTRSGKELLKGGIELNDSATVADLQEAIHKKIKKFYPSRQRLTLPVEPGSKSRPTVLNSKKSLKEYADGNSNTLTVVFKDLGPQVSYRTLFFWEYLGPLIIYPIFHYFPVYQYLGYKEDRVIHPVQTYACYYWCLHYFKRIMETFFVHRFSHATSPLSNVFRNCLYYWSFGAFIAYYVNHPLYTPVSELQWKIGFGFGLLCQISNFYCHILLKNLRGADGSGGYQIPRGFLFNIVTCANYTTEIYQWIGFNIATQTVAGYVFVVVAAGIMTNWALAKHRRLKKLFDGKDGRPKYPRRWVILPPFL

SEQ ID NO: 3954 - protein, 308 aa, Arnica chamissonis
VTVITRSGRELINGGLVLDSSATVADLQEAIHQRIKKYYPSRQRLTLPLEPGSKKKPVVLEYNKSLKEYTSGTSDTVTVVFKDLGSQVSYRTLFFFEYLGPLILYPVFYYFPVYQFFGYKGERVIHPVQTYALYYWCLHYFKRIMETFFVHRFSHATSPVSNVVRNCAYYWTFGCYIAYYVNHPLYTPASDLQVKIGFGFGLIMQVANLYCHIILRNLRSPSGNGGYQIPQGFLFNIVTCANYTTEIYQWLGFNIATQTVAGYIFLVVAASIMTNWALAKHRRLRRLFDGKEGRPKYPRRWVILPPFL

SEQ ID NO: 3955 - protein, 307 aa, Arnica chamissonis
MKVTVITRSGRELINGGLVLDSSATVADLQEAIHQRIKKYYPSRQRLTLPLEPGSKKKPVVLQYKKSLKEYTSGTSDTVTVVFKDLGSQVSYRTLFFFEYLGPLILYPVFYYFPVYQFFGYKGERVIHPVQTYALYYWCLHYFKRIMETFFVHRFSHATSPVANVFRNCAYYWTFGCYIAYYVNHPLYTPASDLQVKIGFGFGLIMQVANLYCHIILRNLRSPSGNGGYQIPQGFLFNIVTCANYTTEIYQWLGFNIATQTVAGYIFLVVAASIMTNWALAKHRRLRRLFDGKEGRPKYPRRWVILP

SEQ ID NO: 3956 - protein, 309 aa, Cicer arietinum
MKLTLVSRSGREIVKGGIQLSDSATVADLQEAIYKRIKKHPSRQRLTLPVQPGSKERPVVLNYKKSLNDYTSGNSETLTLVFKDLGPQVSYRTLFFFEYLGPLLLYPVFYYLPVYQYFGYKGERVIQPVQTYALYYWCFHYAKRILETFFVHRFSHATSPLSNVFRNCAYYWCFGSYIAYYVNHPLYTPVSDLQMKIGFGFGILCQVSNFYCHIILRNLRGPAGEGGYQIPRGFLFNIVTCANYTTEIYQWLGFNIATQTIAGYLFLAVATFIMTNWALAKHRRLKKLFDGKEGRPRYPRRWVILPPFL

SEQ ID NO: 3957 - protein, 308 aa, Panax ginseng
MKVTVTTRSGRELIKGGIELNDSATVADLQEAIHKRTKKYYPSRQRLTLPIQPGSKEKPTVLQYKKNLKEYSDEADKLTVLFKDLGPQVSYPILFFWEYLGPLLIYPIFYYFPVYQYLGFKGERVIHPVQTYALYYWCFHYFKRIMETFFVHRFSRATSPLSNVFRNCAYYWSFGAYIAYYVNHPLYTPVSDLQMKIGFGFGLLCQISNLYCHIILRNLRGDGSGGYQIPCGFLFNIVTSANYTTEIYQWLGFNIATQTVAGYVFLVVAASIMTNWALAKHRRLKRLFDGKEGRPKYPRRWVILPPFV

SEQ ID NO: 3958 - protein, 309 aa, Arachis hypogaea
MKVTLVSRSGREIVKGGIELNDSATVADLQREIHKRTKKYPERQRLTLPVPAGSRERPIVLNSKKNLKEYTDGNSGVLTVVFKDLGPQVSYRTLFFFEYLGPLLLYPVFYYFPVYQFFGYKGERVIHPVQTYALYYWCFHYAKRIFETFFVHRFSHATSPLSNVFRNCAYYWTFGSYIAYYVNHPNYTPVSDLQMKIGFGFGIVMQISNFYCHIILRSLRKPEGDGGYQIPRGFLFNIVTCANYTTEIYQWLGFNIATQTVAGYIFLLVATLIMSNWAFAKHRRLRKLFDGKEGRPKYPRRWIILPPFL

SEQ ID NO: 3959 - protein, 309 aa, Vinca minor
KVSVVTRSGRELVKGGLELNDSATVADLQEAIHKRTKKYYPSRQRLTLPIQPGSKEKPTVLHSKKSIKEYSSGSDNSLTVVFKDLGPQVSYRTLFFFEYLGPLVLYPVFYFFNVHECLGNKGERVIHPVQTYALYYWCFHYFKRIMETFFVHRFSHATSPLSNVFRNCAYYWSFGCLIAYYVNHPLYTPVSDLQMKIGFGFGLVCQIANFYCHILLRNLRSADGNGGYQIPRGFLFNIVTCANYTTEIYQWLGFNIATQTTIGYFFMVVAAAIMTNWALAKHRRLRKIFDGKDGRPKYPRRWVILPPFL

SEQ ID NO: 3960 - protein, 311 aa, Centaurea maculosa
MKVTVTTRSGRELINGGLVLDSSATVADLQEDIHQRIKKYYPSRQRLTLPVQPGSKVKPIVLQSKKSLKEYTTGSSDNITVVFKDLGPQVSYRTLFFFEYLGPLILYPVFYYFPVYQFFGYKVEERVIRPIQTYAMYYWCFHYFKRIMETFFVHRFSHATSPLSNVFRNCAYYWSFGCYIAYYVNHPLYTPVSDLQMKIGLGFGLVMQLSNLYCHIILRNLRSPSGNGGYQIPQGFLFNVVTCANYTTEIYQWLGFNIATQTVAGYIFLVVAASIMTNWALAKHRRLRRLFDGKEGRPKYPRRWVILPPFL

SEQ ID NO: 3961 - protein, 310 aa, Lupinus angustifolius
MKVTLVSRSGREIVKGGIQLGDSAIVADLQTEIHRRTKKYPSRQRLTLPVQPGSKERPVVLNYNKSLKEYTDGKSETLTVVFKDLGPQVSYRTLFFCEYLGPLLLYPVFYYFPVIYEYLGYKGERVIHPVQTYAMYYWCFHYGKRILETFFVHRFSHATSPLSNVFRNCAYYWTFGSYIAYYVNHPLYTPVSDLQVKIGFGFGILCQVSNFYCHIILRNLRNPEGSGGYQIPRGFLFNIVTCANYTTEIYQWLGFNIATQTVAGYVFLAVATFIMSNWAIAKHRRLKKLFDGKEGRPRYPRRFIILPPFL

SEQ ID NO: 3962 - protein, 310 aa, Chrysanthemum coronarium
MKVLVTTRSGRELINGGLNLDDSATVADLQNAIHQKIKKYYPSRQRLTLPIQPGSKEKPVVLQGKKSLKEYTSGSSDTVSVVFKDLGPQVSYQTLFFFEYLGPLVLYPVFYYFPVYRFFGYKGERVMHPAQTYALYYWCFHYFKRIMETFFVHRFSHATSPISNVFRNAAYYWSFGCYIAYYVNHPLYTPVSDLQMKIGFGFGAIMQISNLYCHIILRNLRSPNGPGGYQIPRGFLFNIVTCANYTTEIYQWLGFNIATQTVAGYVFLVVAASIMTNWALAKHSRLRRLFDGKEGRPKYPRRWVILPPFF

SEQ ID NO: 3963 - protein, 309 aa, Bupleurum chinense
MKVTVTTRSGRELIKGHIDLNDSATVADLQEAIHKRTKKYYPSRQRLTLPVKPGSKEKPTVLQYKKSLKEFTDGNGDQLTVVFKDLGPQVSYPILFFWEYLGPLLIYPVFYFFPVYQYLGFKGERVIHPVQTYALYYWCFHYFKRIMETFFVHRFSHATSPISNVFRNCTYYWSFGALIAYYVNHPLYTPVSDLQMKIGFGFGILCQVANFYCHIILRNLRGDGSGGYQIPRGFLFNIVTCANYTTEIYQWLGFNIATQTVAGYVFLIVAAFIMTNWALAKHRRLKRLFDGKEGRSKYPRRWVILPPFL

SEQ ID NO: 3964 - protein, 310 aa, Gossypium hirsutum
MKVTLVSRSGREFINGGLELPDSATVADLQEAIYKRTKKFYPSRQRLTLPVPPGSKERPVVLNYKKSLKDYSDEKQNKLTVVFKDLGPQVSYSTLFFFEYLGPLILYPIFYYFPVYKFFGYGEDRVIHPVQTYAVYYWCFHYLKRIMETFFVHRFSHATSPLSNVFRNCAYYWLFGSYIAYYVNHPLYTPVGDLQMKIGFGFGLVCQLSNLYCHIILKNLRNPDGSGGYQIPHRFVFNIVTCANYTTEIYQWLGFNIATQTVAGYVFLVVATSIMTNWALAKHRRLKKLFDGNEGRPKYPRRWVILPPFL

SEQ ID NO: 3965 - protein, 308 aa, Distylium racemosum
MKISAVSRSGREIVKGGIELNDNATVDDLKSSIYQRTKKYYPARQRLTLPVQPGQGKPVVLQSGKRLKDYFENNEGYQVVFKDLGPQVSYRTLFFFEYLGPLLIYPIFYYFPVYKFFGYPAEKVIHPVQTYALYYWCFHYFKRILETFFVHRFSHATSPISNVFRNCCYYWTFGAFIAYFVNHPLYTPVSEKQWKIGFGLGLLCQAANFYCHILLRNLRSPDGKGGYQIPTGFLFNIVTCANYTTEIYQWLGFNIATQTVAGYSFLLVATLIMTDWALGKHRRLKKLFDGKDGRPKYPRRWVILPPFL

SEQ ID NO: 3966 - protein, 195 aa, Echinochloa colona
MATPLSLSSPLFLAAPARARNVISYGVASATPSGSSGNALGKGYVDRVHDWRQQRRRTAIVSVIGRKSTARETVVPDPDYRLPIAILGIAGAFAYADNLLAAAPVGLLGLLLLFQTTRVRFVFDNEALEVKVGEQLQESGENVLWWQEPLEVLNIHKLGAVVATISYLSLLQGDANETRGTNPLLPCDIQWPTTI

SEQ ID NO: 3967 - protein, 221 aa, Saccharum officinarum
WRAEAGGAMATTTLSLSSPFLLGAPARARDVISYGVASASISPSTVNVLGKGYMSRVHDREQQRRTAIVSVLGRKKSTAKETVVPDPDYRLPIAILGIASAFAYADNLLAAAPVGLLGLLLLFQTTRVRFVFDNEALEVKVGDQLQESGENVFVGGKNRWKYSTFVNWELWWPQFPILVYFKETQTKPEGQVHFFPVIFNGRQLYDVMVERAGPSKTSGPK

SEQ ID NO: 3968 - protein, 211 aa, Zea mays
MATTLSLSSPLFLGAPARARDVVPYGVTSASVSLMTLNMPGKGYTSRVRCREQQRRTTIVSMLGRKSTARATVVPDPDYRLPIAILGIASAFAYADNLLAAAPVGLLGLLLLFQTTRVRFVFDNEALEVKVGEQLQESGENVFVGGKNRWKYSTFVNWELWWPQFPVLVYFKETQTKPEGQIHFFPVIFDGRQLYDVMVERAGPSKTSGPK

SEQ ID NO: 3969 - protein, 213 aa, Echinochloa colona
MATPLSLSSPLFLAAPARARDVISYGVASATPSGSSGNALGKGYVDRVHDWRQQRRRTAIVSVIGRRKSTARETVVPDPDYRLPIAILGISGASAYADNLLAAAPVGLLGLLLLFQTTRVRFVFDNEALEVKVGEQLQESGENVFVGGKNRWKYSTFINWELWWPQFPILVYFKETQTKPEGQIHFFPVIFNGRQLYDVMVERAGPSKTSGPK

SEQ ID NO: 3970 - protein, 212 aa, Sorghum bicolor
MATTLSLSSPLFLGAPARARDAISYGVASASISPTTVNVLGKGYTSRVPVREQQRRMAIVSVLGRKKSTAKETVVPDPDYRLPIAILGIASAFAYADNLLAAAPVGLLGLLLLFQTTRVRFVFDNEALEVKVGDQLQESGENVFVGGKNRWKYSTFVNWELWWPQFPILVYFKETQTKPEGQIHFFPVIFNGRQLYDVMVERAGPSKTSGPK

SEQ ID NO: 3971 - protein, 338 aa, Sorghum bicolor
MPAEDEMVLLAADEASWPISSPPPAWFAALVAIGLYIVVRSAATFLLWLHRAFLRPGRDLAGWYGTWAVVTGATDGIGRAVALELARAGLHLVLVGRSPDKLARVAKEVLAAAPPSCKVRTVEFDLAVTGDDDARRGVARVVAAVEGRDVGVLVNNAGATYPCAAYFHEVERPVWEAVLRVNVEAATRITRALLPMMAAKGRGAVVNVGSGSSVVVPAFPLYAVYAASKAYVDQFSRSLSVEYKQYGVDVQCQIPLYVATKMSPVKGASPFIPSPEEYARAALGCIGYEARCVPYWRHSVQWFLASLMPDAALNHWRLQTGIRKRNEMKALLGEKACG

SEQ ID NO: 3972 - protein, 350 aa, Panicum virgatum
MSRLLLSATGVSKMAWLAADRAAPWPPASSSSSPAAPVWFTVLVAVGLFVVVRSAATFLAWLRRAFLRPGRDLAARYGAWAVVTGATDGIGRAVALELARRGLHLVLVGRSPGKLARVGKEVRAAAPSCEVRAVAFDLAATGADARRGVARVAAAVEGRDVGLLVNNAGATYPCAAYFHEVEEAVWEAVVRVNVEAATRITRAVLPLMAARGRGAVVNVGSGSSVVVPAFPLYAVYAASKAYVDKFSRSLSVEYKQYGVDVQCQIPLYVATKMSPVKGDSPFIPSPEEYAKVALGCIGYEARCLPYWRHSVQWFLASLVPDAALNQWRLRIGIRKRNEMKATLVEEKVFS

SEQ ID NO: 3973 - protein, 1775 aa, Sorghum bicolor
MEPAVATAGEGQRFKRIPRQAWSGNLELDPLLNESLDQWPHLNELVQCYKADFVKDDCKYGRYESVAPPSFQNQIFEGPDTDIETELQLCNARHSKAEDATEDDTPSTSGRQIYETESAASSSKVHCSLSPLPAYEPAFDWENERSLIFGQRVPESIPAISNSGLKITVKVLSLSFQAGLVEPFSGTICLYNRDRREKLSEDFYFHILPTDMQDAQGSLDRRGVFSLDAPSPSVCLLIQLEKPATEEGGVTPSVYSRKEPVHLAEKEKQKLQVWSRIMPYKESFAWAMIPLFEGNHAGGLSDAASPSSPLAPSLSGSSSQDSIVDPISKLTLDGKVNHYSSGSSVIVEISNLNKVKESYIEDSLQDPKRKVHKPVKGVLRLEVEKLHNGRNDVDNASEGGSMANDLNDAGDINNGRSNRSSFDGIRSSVNSIAIGQKDAHHNGHISNAENGDSFQAFDFRMLTRSEPFSQLFHCLYVYPLTVSLSRKRNLFVRVELRKDDSDIRKPPLEVIVGYSVLPLSTHIQLLSDVSLPILRELVPHYLQESGKERMDYLEDGKTVFRLRLRLCSSLFPVNERIRDFFVEYDRHTLHTSPPWGSELLEAINSLKNVESTALLQFLQPILNMLLHLIGDGGETLQVAAFRAMVNILTRVQQESSDGAERNRFLINYVDFAFDDFGDRQAPVYPGLSTVWGSLARSKAKGYRVGPVYDDVLAMAWFFLELIVKSMGLEQSRLFYHNLPLGEDVPPLQLKEGVFRCIMQLFDCLLTEVHERCKKGLSLAKRLNSTLAFFCYDLLSIIEPRQVFELVSLYMDKFAGVCQSVLHDCKLTFLQIICDHDLFVEMPGRDPSDRNYLSSVLIQEIFLTLDHDDLSQRAKAARILVVLICKHEFDARYQKSEDKLYIAQLYFPLIGQILDEMPVFYNLNAVEKREVLVVILQIVRNLDDATLIKAWQQSIARTRLFFKLLEECITHFEHNKTGDSMLLGASSRSPDVERPASPKYSERLSPSVNAYLSEASRHEIRPQGTPENGYMWNRVSPQLSSPNQPYSLREALAQAQSSRIGSTARALRESLHPVLRQKLELWEENLSTAVSLEVLGITEKFSVAAGTRSITTDYAKLDCVTSILMGLLSRSQPLAFWKAFLPVVYNIFNLHGATLMARENDRFLKQIAFHLLRLAVFRNDSIRKRAVVGLQILVRNSFNYFKNTTRLRVMLTITLSELMSDVQVTQMKSDGSLEESGEARRLRKSLEEMADVRSKDLLKDCGLPVTALEAVPEGSSDIRWSWVEVKHLSKCLVQALDAGLEHALLGSAVTVDRYAAAEGFYKLAMAYAPVPDLHIMWLLHLCDAHQEMQSWAEAAQCAVAVAGVIMQALVGRNDAVWSKEHVASLCKICPIVNTDVSAEASAAEVEGYGASKLTVDSAVKYLQLANKLFTQAELYHFCASIQELIIPVYKSRRAYGQLAKCHTSLTNIYESILEQEASPIPFIDATYYRVGFYGERFGKLNRKEYVFREPRDVRLGDIMEKLSHIYEAKMDGSHTLHIIPDSRQVNADELQPGVCYLQITAVDPVMEDEDLGSRRERIFSLSTGTVRARVFDRFLFDTPFTKNGKTQGGLEDQWKRRTVLQTEGSFPALVNRLLVTKSESLEFSPVENAIGMIETRTAALRNELEEPRSSEGDQLPRLQSLQRILQGSVAVQVNSGVLSVCTAFLSGEPATRLRSQELQQLIAALLEFMAVCKRAIRVHFRLIGEEDQEFHTQLVNGFQSLTAELSHYIPAILSEL

SEQ ID NO: 3974 - protein, 1839 aa, Zea mays
MEPAVATAGEGQRFKRISRQAWSGNLELDPLLNESLDQWPHLNDLVQCYKADFVKDDCKYGRYESVAPPSFQNQIFEGPDTDIETELQLCNARHFKPEDPTEDDMPSTSGRQMYETESSASSSKVHCSLSPLPAYEPAFDWENERSLIFGQRVPESIPAISNSGLKITVKVLSLSFQAGLVEPFSGTICLYNRDRREKLSEDFYFHILPTDMQDAQGSLDRRGVFSLDTPSPSVCLLIQLEKAATEEGGVTPSVYSRKEPVHLAEKEKQKLQVWSRIMPCKESFAWAMIPLFEGNHAGGLSDAASPSSPLATSLPGSTSQDSIVDPILKLTLDGKVNHYSSGSSVIVEISNLNKVKESYIVDSLQDPKRKVHKPVKGVLRLEVEKLHGGHNDVDNTSEGGSMANDLNDAGDINNGRSNRSSFDGIHSFVNSIAIAQKDAHHNGIISNAENGDNFEAFDFRMLTRSEPFSQLFHCLYVYPLTVSLSRKRNLFVRVELRKDDSDIRKPPLEAVHPRERNMMLQKWGHTQIAVGTRMASYHDEVKISLPALLTPQHHLVFTFFHVDLQMKLEAPKPVIVGHSVLPLSTHIQLLSDVSLPILRELVPHYLQGSGKERMDYLEDGKTVFKLRLRLCSSLFPVNERIRDFFVEYDRHTLHTSPPWGSELLEAINSLKNVESTALLQFLQPILNMLLHLIGDGGETLQVAAFRAMVNILTRVQQESSDGAERNRFLINYVDFAFDDFGGRQAPVYPGLSTVWGSLARSKAKGYRVGPVYDDVLAMAWFFLELIVKSMGLEQSRLFYHNLPLGEDVPPLQLKEGVFRCIMQLFDCLLTEVHERCKKGLSLAKRLNSTLAFFCYDLLSIIEPRQVFELVSLYMDKFAGVCQAVLHDCKLTFLQIICDHDLFVEMPGRDPSDRNYLSSVLIQEIFLTLDHDDLSQRAKAARILVVLICKHEFDARYQKSEDKLYIAQLYFSLIGQILDEMPVFYNLNAIEKREVLVVILQIVRNLDDATLIKAWQQSIARTRLFFKLLEECITHFEHNKTGGSMLLGASSRSPDVERPAPPKYSERLSPSVNAYLSEASRHEIRPQGTPENGYMWNRVSPQLSSPNQPYSLREALAQAQSSRIGSTARALRESLHPVLRQKLELWEENLSTAVSLEVLRITEKFSAAAGTRSITTDYAKLDCVTSIVMGLLSRSQPLAFWKAFLPVVYNIFNLHGATLMARENDRFLKQIAFHLLRLAVFRNDSIRKRAVVGLQILVRNAFNYFKNTTRLRVMLTITLSELLSDVQVTQMKSDGSLEESGEARRLRKSLEEMADVRSKDLLKDCGLPVTALEAAPDGSSDNMWSWAEVKHLSKCLVQALDAGLEHALLDSVVTVDRYAAAEGFYKLAMAYAPVPDLHIMWLQHLCDAHQEMQSWAEAAQCAVAAAGVIMQALVGRNDAVWSKEHVTSLHKICPIVNTDVSAEASAAEVEGYGASKLTVDSAVKYLQLANKLFTQAELYHFCASIQELIIPVYKSRRAYGQLAKCHTSLTNIYESILEQEASPIPFIDATYYRVGFYGERFGKLNKKEYVFREPRDVRLGDIMEKLSHIYEVKMDGSHTLHIIPDSRQVNADELQPGVCYLQITAVDPVMEDEDLGSRRERIFSLSTGTVRARVFDRFLFDTPFTKNGKTQGGLEDQWKRRTVLQTEGSFPALVNRLPVTKSESLEFSPVENAIGMIETRTAALRNELEEPRSSEGDQLPRLQSLQRILQGSVAVQVNSGVLSVCTAFLSGEPATRLRSQELQQLIAALLEFMAVCKRAIRVHFRLIGEEDQEFHTQLVNGFQSLTAELSHYIPAILSEL

SEQ ID NO: 3975 - protein, 1839 aa, Setaria italica
MEPAAAAAGEGQRFKRIPRQAWSGNLELDPLLNENLDQWPHLNELVQCYKADFVKDDGKYGRYESVAPPSFQNQIFEGPDTDIETELQLCNVRHSKPEDATEDDTPSTSGRQIYETEPSASSSKVHCSLSPLPAYEPAYDWENERSLIFGQRVPESLPAINNSGLKITVKVLSLSFQAGLIEPFSGTICLYNRDRREKLSEDFYFHILPTDMQDAQISLDRRGVFSLDAPSPSVCLLIQLEKAATEEGGVTPSVYSRKEPVHLTEKEKQKLQVWSRIMSYKESFAWAMIPLFEGNHAGGLGDAASPSSPLAPSISGSSSQDSIVDPISKLTLDGKLNHYSSGSSVIVEISNLNKVKESYIEDSLQDPKRKVHKPVKGVLRLEVEKLHDGHHDADNVSEGGSMANDLNDAGDLSNGRCNRSSFDGIRSSVNSSGVAQKDAHHNGKISSCENSDSFQAFDFRMMTRSEPFSQLFHCLYVYPLTVSLSRKRNLFVRVELRKDDSDIRKPPLEAVHPRERNTMLQKWGHTQIAVGTRMALYHDELKISLPALLTPQHHLVFTFFHVDLQMKLEAPKPVIVGYSVLPLSTHIQLLSDVSLPILRELVPHYLQESGKERMDYLEDGKTVFRLRLRLCSSLFPVNERIRDFFVEYDRHTLHTSPPWGSELLEAINSLKNVESTALLQFLQPILNMLLHLIGDGGETLQVAAFRAMVNILTRVQQESSDGAERNRFLINYVDYAFDDFGDRQAPVYPGLSTVWGSLARSKAKGYRVGPVYDDVLAMAWFFLELIVKSMGLEQSRLFYHNLPLGEDVPPLQLKEGVFRCIMQLFDCLLTEVHERCKKGLSLAKRLNSTLAFFCYDLLSIIEPRQVFELVSLYMDKFAGVCQSVLHDCKLTFLQIICDHDLFVEMPGRDPSDRNYLSSVLIQEIFLTLDHDDLSQRAKAARILVVLICKHEFDARYQKSEDKLYIAQLYFPLIGQILDEMPVFYNLNAVEKREVLVVILQIVRNLDDATLIKAWQQSIARTRLFFKLLEECITHFEHNKTGDSMLLGASSRSPDVERPASPKYSERLSPSVNAYLSEASRHEIRPQGTPENGYMWNRVSPQLSSPNQPYSLREALAQAQSSRIGSTARALRESLHPVLRQKLELWEENLSTAVSLEVLGITEKFSVAAGTRSITTDYAKLDCVTSILMGLLSRSQPLAFWKAFLPVVYNIFNLHGATLMARENDRFLKQIAFHLLRLAVFRNDSIRKRAVVGLQILVRNSFNYFKNTTRLRVMLTITLSELMSDVQVTQMKSDGSLEESGEARRLRKSLEEMADVRSKDLLKDCGLPVTALEAAPEGSNDNRWSWVEVKHLSKCLVQALDAGLEHALLGSVVNVDRYAAAEGFYKLAMAYAPVPDLHIMWLLHLCDAHQEMQSWAEAAQCAVAVAGVIMQALVGRNDAVWSKEHVASLRKICPIVSTDVSAEVSAAEVEGYGASKLTVDSAVKYLQLANKLFAQAELYHFCASIQELIIPVYKSRRSYGQLAKCHTSLTNIYESILEQEASPIPFIDATYYRVGFYGERFGKLNKKEYVFREPRDVRLGDIMEKLSHTYEAKMDGNHTLHIIPDSRQVNADELQPGVCYLQITAVDPVMEDEDLGSRRERIFSLSTGTVRARVFDRFLFDTPFTKNGKTQGGLEDQWKRRTVLQTEGSFPALVNRLLVTKSESLEFSPVENAIGMIETRTAALRNELEEPRSSEGDQLPRLQSLQRILQGSVAVQVNSGVLSVCTAFLSGEPATRLRSQELQQLIAALLEFMAVCKRAIRVHFRLIGEEDQEFHTQLVNGFQSLTAELSHYIPAILSEL

SEQ ID NO: 3976 - protein, 1839 aa, Setaria italica
MEPAAAAAGEGQRFKRIPRQAWSGNLELDPLLNENLDQWPHLNELVQCYKADFVKDDGKYGRYESVAPPSFQNQIFEGPDTDIETELQLCNVRHSKPEDATEDDTPSTSGRQIYETEPSASSSKVHCSLSPLPAYEPAYDWENERSLIFGQRVPESLPAINNSGLKITVKVLSLSFQAGLIEPFSGTICLYNRDRREKLSEDFYFHILPTDMQDAQISLDRRGVFSLDAPSPSVCLLIQLEKAATEEGGVTPSVYSRKEPVHLTEKEKQKLQVWSRIMSYKESFAWAMIPLFEGNHAGGLGDAASPSSPLAPSISGSSSQDSIVDPISKLTLDGKLNHYSSGSSVIVEISNLNKVKESYIEDSLQDPKRKVHKPVKGVLRLEVEKLHDGHHDADNVSEGGSMANDLNDAGDLSNGRCNRSSFDGIRSSVNSSGAAQKDAHHNGKISSCENSDSFQAFDFRMMTRSEPFSQLFHCLYVYPLTVSLSRKRNLFVRVELRKDDSDIRKPPLEAVHPRERNTMLQKWGHTQIAVGTRMASYHDELKISLPALLTPQHHLVFTFFHVDLQMKLEAPKPVIVGYSVLPLSTHIQLLSDVSLPILRELVPHYLQESGKERMDYLEDGKTVFRLRLRLCSSLFPVNERIRDFFVEYDRHTLHTSPPWGSELLEAINSLKNVESTALLQFLQPILNMLLHLIGDGGETLQVAAFRAMVNILTRVQQESSDGAERNRFLINYVDYAFDDFGDRQAPVYPGLSTVWGSLARSKAKGYRVGPVYDDVLAMAWFFLELIVKSMGLEQSRLFYHNLPLGEDVPPLQLKEGVFRCIMQLFDCLLTEVHERCKKGLSLAKRLNSTLAFFCYDLLSIIEPRQVFELVSLYMDKFAGVCQSVLHDCKLTFLQIICDHDLFVEMPGRDPSDRNYLSSVLIQEIFLTLDHDDLSQRAKAARILVVLICKHEFDARYQKSEDKLYIAQLYFPLIGQILDEMPVFYNLNAVEKREVLVVILQIVRNLDDATLIKAWQQSIARTRLFFKLLEECITHFEHNKTGDSMLLGASSRSPDVERPASPKYSERLSPSVNAYLSEASRHEIRPQGTPENGYMWNRVSPQLSSPNQPYSLREALAQAQSSRIGSTARALRESLHPVLRQKLELWEENLSTAVSLEVLGITEKFSVAAGTRSITTDYAKLDCVTSILMGLLSRSQPLAFWKAFLPVVYNIFNLHGATLMARENDRFLKQIAFHLLRLAVFRNDSIRKRAVVGLQILVRNSFNYFKNTTRLRVMLTITLSELMSDVQVTQMKSDGSLEESGEARRLRKSLEEMADVRSKDLLKDCGLPVTALEAAPEGSNDNRWSWVEVKHLSKCLVQALDAGLEHALLGSVVNVDRYAAAEGFYKLAMAYAPVPDLHIMWLLHLCDAHQEMQSWAEAAQCAVAVAGVIMQALVGRNDAVWSKEHVASLRKICPIVSTDVSAEVSAAEVEGYGASKLTVDSAVKYLQLANKLFAQAELYHFCASIQELIIPVYKSRRSYGQLAKCHTSLTNIYESILEQEASPIPFIDATYYRVGFYGERFGKLNKKEYVFREPRDVRLGDIMEKLSHTYEAKMDGNHTLHIIPDSRQVNADELQPGVCYLQITAVDPVMEDEDLGSRRERIFSLSTGTVRARVFDRFLFDTPFTKNGKTQGGLEDQWKRRTVLQTEGSFPALVNRLLVTKSESLEFSPVENAIGMIETRTAALRNELEEPRSSEGDQLPRLQSLQRILQGSVAVQVNSGVLSVCTAFLSGEPATRLRSQELQQLIAALLEFMAVCKRAIRVHFRLIGEEDQEFHTQLVNGFQSLTAELSHYIPAILSEL

SEQ ID NO: 3977 - protein, 1835 aa, Triticum aestivum
MDSPAAGEGQRFKRIPRQPCGRNLELDPLLNENLEQWPHLSELVQCYNADFVKDDCKYGRYESVAPPSFQNQIFEGPDTDIETELQLCNARHSKPEETTEDDMPSTSGRQIYETEASASSSKKHCTLSPLPAYEPAFDWDNERSLIFGQRLPESLPATHSSGLKITVKVLSLSFQTGLVEPFSGTICLYNRDRREKLSEDFYFHILPTEMQDAHISLDRRGVFSLDTPSPSICLLIQLEKAATEEGGVTPSIYSRKEPVHLTEKEKQKLQVWSRVMPYREPFAWAMIPLFENNHAGGDAASPSSPLAPSMSGSSSQDSIVEPISKLTSDGKLNHYSSGSSVIVEISNLNKVKESYMEDSLQDPKRKVHKPVKGVLRLEVEKLHNDRNEADTISEGGSITNELHDAGELNNGRHSRNSIDGIHSSLNSSAIVKKDTHQNGQSSNGENGNNFQAFDFRMMARSEPFSQLFHCLYVYPLTVSLSRKRNLFVRVELRKDDSDIRKLPVEAVHPRDQNSTLQKCAHTQISVGTRMSCYHDEVKISLPALLTPQHHLLFTFFHVDLQMKLEAPKPVIVGYAALPLSTHIQLLSDVSLPILRELVPHYLQESGKEKMDYLEDGKTVFRLRLRLCSSLFPVNERIRDFFVEYDRHTLHTSPPWGSELLEAINSLKNVESTALLQFLQPILNMLLHLIGDGGETLQVAAFRAMVNILTRVQQESSDGAERNKFLVNYVDFAFDDFGDRQTPVYPGLSTVWGSLARSKAKGYRVGPVYDDVLAMAWFFLELIVKSMGLEQSRLFYHNLPLGEDVPPLQLKEGVFRCIMQLFDCLLTEVHERCKKGLNLAKRLNSTLAFFCYDLLSIIEPRQVFELVSLYMDKFAGVCQSVLHDCKLTFLQIICDHDLFVEMPGRDPTDRNYLSSVLIQEIFLTLDHDDLSQRAKAARILVVLICKHEFDARYQKSEDKLYIAQLYFPLIGQILDEMPVFYNLNAIEKREVLVVILQIIRNLDDTTLIKAWQQSIARTRLFFKLLEECITHFEHNRTGDSLLLGSSSRSPDAERPASPKYSDRLSPSVNAYLSEASRHEIRPQGTPENGYMWNRISPQLSSPNQPYSLREALAQAQSSRIGSTARALRESLHPILRQKLELWEENLSTAVSLEVLGIIDKFSVAAASRSISTDYAKLDCVTSILMGLLSRSQPLTFWKAFLPVVYNIFSLHGATLMARENDRFLKQIAFHLLRLAVFRNDSVRKRAVVGLQILVRNSFNYFKSTTRLRVMLTITLSELLSDVQVTQMKSDGSLEESGEARRLRKSLEEMADVRSKDQLNDCGLPVTALEVAAEGSTDNRWSWVEVKHLSKCLVQALDAGLEHALLGSVMSVDRCAAAEGFYKLALAYAPVPDLHIMWLLHLCDAHQEMQSWAEAAQCAVAVAGVIMQALVGRNDAVWSKEHVASLCRICPIVGTDIGAEVAAAEVEGYGASKLTVDSAVKYLQLANKLFAQAELYHFSASIQELIIPVYKSRRSYGQLAKCHTSLTSIYESILEQEASPIPFIDATYYRVGFYGERFGKLNKREYVFREPRDVRLGDIMEKLSHTYEAKMDVNHTLHIIPDSRQVNADELQPGVCYLQITAVDPVMEDEDLESRRERIFSLSTGSVRARVFDRFLFDTPFTKNGKTQGGLEDQWKRRTVLQTEGSFPALVNRLVVIKSESLEFSPVENAIGMIETRTAALRNELEEPRSSEGDQLPRLQSLQRILQGSVAVQVNSGVLSVCTAFLSGEPATRLRSQELQQLIAALLEFMAVCKRAIRVHFRLIGEEDQEFHTQLVNGFQSLTAELSHYIPAILSEL

SEQ ID NO: 3978 - protein, 1835 aa, Secale cereale
MDSAAPGEGQRFKRIPRQPCGRNLELDPLLNENLEQWPHLNELVQCYNADFVKDDCKYGRYESVAPPSFQNQIFEGPDTDIETELQLCNARHSKPEETTEDDMPSTSGRQIYETEPSASSSKKHCTLSPLPAYEPAFDWDNERSLIFGQRLPESLPATHSSGLKITVKVLSLSFQTGLVEPFSGTICLYNRDRREKLSEDFYFHILPTEMQDAHISLDRRGVFSLDTPSPSICLLIQLEKAATEEGGVTPSIYSRKEPVHLTEKEKQKLQVWSRVMPYREPFAWAMIPLFENNHAGGDAASPSSPLAPSMSGSSSQDSIVEPISKLTSDGKLNHYSSGSSVIVEISNLNKVKESYMEDSLQDPKRKVHKPVKGVLRLEVEKLHNDRNEADTISEGGSITNELHDAGELNNGRHSRNSIDGIHSSLNSSSIVKKDTHQNGQNSNAENGNNFQAFDFRMMARSEPFSQLFHCLYVYPLTVSLSRKRNLFVRVELRKDDSDIRKLPVEAVHPRDQNATLQKCAHTQISVGTRMSCYHDEVKISLPALLTPQHHLLFTFFHVDLQMKLEAPKPVIVGYAALPLSSHIQLLSDVSLPILRELVPHYLQESGKEKMDYLEDGKTVFRLRLRLCSSLFPVNERIRDFFVEYDRHTLHTSPPWGSELLEAINSLKNVESTALLQFLQPILNMLLHLIGDGGETLQVAAFRAMVNILTRVQQESSDGAERNKFLVNYVDFAFDDFGDRQTPVYPGLSTVWGSLARSKAKGYRVGPVYDDVLAMAWFFLELIVKSMGLEQSRLFYHNLPLGEDVPPLQLKEGVFRCIMQLFDCLLTEVHERCKKGLNLAKRLNSTLAFFCYDLLSIIEPRQVFELVSLYMDKFAGVCQSVLHDCKLTFLQIICDHDLFVEMPGRDPTDRNYLSSVLIQEIFLTLDHDDLSQRAKAARILVVLICKHEFDARYQKSEDKLYIAQLYFPLIGQILDEMPVFYNLNAIEKREVLVVILQIIRNLDDTTLIKAWQQSIARTRLFFKLLEECITHFEHNRTGDSLLLGSSSRSPDAERPASPKYSDRLSPSVNAYLSEASRHEIRPQGTPENGYMWNRISPQLSSPNQPYSLREALAQAQSSRIGSTARALRESLHPILRQKLELWEENLSTAVSLEVLGIIEKFSVAAASRSISTDYAKLDCITSILMGLLSRSQPLTFWKAFLPVVYNIFSLHGATLMARENDRFLKQIAFHLLRLAVFRNDSVRKRAVVGLQILVRNSFNYFKSTTRLRVMLTITLSELLSDVQVTQMKSDGSLEESGEARRLRKSLEEMADVRSKDQLNDCGLPVTALEVTAEGSTDNRWSWVEVKHLSKCLVQALDAGLEHALLGSVMSVDRCAAAEGFYKLALAYAPVPDLHIMWLLHLCDAHQEMQSWAEAAQCAVAVAGVIMQALVGRNDAVWSKEHVASLCRICPIVGTDIGAEVAAAEVEGYGASKLTVDSAVKYLQLANKLFAQAELYHFSASIQELIIPVYKSRRSYGQLAKCHTSLTNIYESILEQEASPIPFIDATYYRVGFYGERFGKLNKREYVFREPRDVRLGDIMEKLSHTYEAKMDVNHTLHIIPDSRQVNADELQPGVCYLQITAVDPVMEDEDLESRRERIFSLSTGSVRARVFDRFLFDTPFTKNGKTQGGLEDQWKRRTVLQTEGSFPALVNRLVVIKSESLEFSPVENAIGMIETRTAALRNELEEPRSSEGDQLPRLQSLQRILQGSVAVQVNSGVLSVCTAFLSGEPATRLRSQELQQLIAALLEFMAVCKRAIRVHFRLIGEEDQEFHTQLVNGFQSLTAELSHYIPAILSEL

SEQ ID NO: 3979 - protein, 1838 aa, Brachypodium distachyon
MSAADLLVADAAAREWQRFKLIPRVSCAGNLDLDPLLNENLEQWPHLNELVQCYKADFVKDDCKYGRYESVAPPSFRSQIFEGPDTDIETELQLSKPEETTEDDMPSTSGRQIYETEPSASSSNKPCSLSPLPAYEPAFDWNNERSLIFGQRVTESLPATHISGLKITVKVLSLSLEAGLVEPFGGTICLYNRDRREKLSEDFYFRILPTEMQDAHISLDRWGVFSLDAPSPSVCLLIQLEKAATEEGGVTPSVYSRKEPVHLTEKEKQKLQIWSRIMPYKEPFAWAMIPLFENNHAGGVGDAASPSSPLARSISGSSSQDSIMEPTSKLALDGKLNHYSSGSSVIVEISNLNKVKESYIEDSLQDPKRKAHKPVKGVLRLEVEKLHNDRNDADTISEGGSMNNELHGAELNNGRHHRNSFDGAHSYLNSSAVAQKNAHQNGQNSNAENGDNFQAFDFRMMTRSEPFSQLFHCLYVYPLTVSLSRKRNLFVRVELRKDDADIRKLPLEAIHPTDWSTTLQKFVHTQISVGTRMSCFHDEVKISLPALLTPQHHLLFTFFHVDLQMKLEAPKPVIVGYAALPLSTHIQLLSEVSLPILRELVPHYLQESGKERMEYLEDGKAVFRLRLRLCSSLLPVNERIRDFFVEYDRHTLHTSPPWGSELLEAINSLKNVESTALLQFLHPILNMLLRLIGDGGETLQVAAFRAMVNILTRVQQESSDGAERNRFLVNYVDFAFDDFGDRQTPVYPGLSTVWGSLARSKAKGYRVGPVYDDVLAMAWFFLELIVKSMGLEQSRLFYHNLPLGEDVPPLQLKEGVFRCIMQLFDCLLTEVHERCKKGLNLAKRLNSTLAFFCYDLLSIIEPRQVFELVSLYMDKFAGVCQSVLHDCKLTFLQIICDHDLFVEMPGRDPSDRNYLSSVLIQEIFLTLDHDDLLQRAKAARILVVLISKHEFDARYQKSEDKLYIAQLYFPLIGQILDEMPVFYNLNAVEKREVLVVILQIIRNLDDTTLIKAWQQSIARTRLFFKLLEECITHFEHNRTGDSLLLGSSSRSPDAERPVSPKYSDRLSPSVNAYLSEASRHEIRPQGTPENGYMWNRVSPQLSSPNQPYSLREALAQAQSSRIGSTARALRESLHPVLRQKLELWEENLSTAVSLEVLGIIEKFSVAAASLSISTDYTKLDCVTSILMGLLSRSQPLTFWEAFLPVVYNIFSLHGATLMARENDRFLKQIAFHLLRLAVFRNDSVRKRAVVGLQILVRNSFNYFKSTTRLRVMLTITLSELLSDVQVTQMKSDGSLEESGEARRLRKSLEEMADVRSKDQLNDCGLPVNALEVAAEGSTDNRWSWVEVKHLSKCLVQALDAGLEHALLGSVTTLDRCAAAEGFYKLALAYAPVPDLHIMWLLHLCDAHQEMQSWAEAAQCAVAVAGVIMQALVGRNDAVWSREHVASLCRICPIVGTDVGAEVSAAEVEGYGASKLTVDSAVKYLELANKLFAQAELYHFCASIQELIIPVYKSRRAYGQLAKCHASLTNIYESILEQEASPIPFIDATYYRVGFYGDRFGKLNKKEYVFREPRDVRLGDIMEKLSHTYEAKMDGNQNLHIIPDSRQVNADELQPGVCYLQITAVDPVMEDEDLESRRERILSLSTGTVRARVFDRFLFDTPFTKNGKTQGGLESQWKRRTVLQTEGSFPALVNRLLVIESESLEFSPVENAIGMIETRTAALRNELEEPRSSEGDQLPRLQSLQRILQGSVAVQVNSGVLSVCTAFLSGEPATRLRSQELQQLIAALLEFMAVCKRAIRVHFRLIGEEDQEFHTQLVNGFQSLTAELSHYIPAILSEL

SEQ ID NO: 3980 - protein, 1843 aa, Brachypodium distachyon
MSAADLVVADATAREWQRFKLIPRVSCAGNLDLDPLLNENLEQWPHLNELVQCYKADFVKDDCKYGRYDSVAPPSFRSQIFEGPDTDIETELQLCNARHSKPEETTEDDMPSTSGRQIYETEPCASSSNKPCSLSPLPAYEPAFDWNNERSLIFGQRVTESLPATHISGLKITVKVLSLSLEAGLVEPFGGTICLYNRDRREKLSEDFCFRILPTEMQDAHISLDRWSVFSLDAPSPSVCLLIQLEKAATEEGGVTPSVYSRKEPVHLTEKEKQKLQIWSRIIPYKEPFAWAMIPLFENNHAGGVGDAVSPSSPLAPSISGSSSQDSIVEPTSKLALEGKLNHYSSGSSVIVDISNLNKVKESYIEDSLQDPKRKVHKPVKGVLRLEVEKLHNDRNDTDTISEGGSMNNELHGAELNNGRHHRNSFDGAHSYLNSSAVVQKNARQNGQNSNAENGDNFQAFDFRMMTRSEPFSQLFHCLYVYPLTVSLSRKRNLFVRVELRKDDADIRKLPLEAIHPRDWSTTLQKFVHTQISVGTRMSCFHDEVKISLPALLTPQHHLLFTFFHVDLQMKLEAPKPVIVGYAALPLSTHIQLLSDVSLPILRELVPHYLQESGKERMEYLEDGKAVFRLRLRLCSSLFPVNERIRDFFVEYDRHTLHTSPPWGSELLEAINSLKNVESTALLQFLHPILNMLLRLIGDGGETLQVAAFRAMVNILTRVQQESSDGAERNRFLVNYVDFAFDDFGDRQTPVYPGLSTVWGSLARSKAKGYRVGPVYDDVLAMAWFFLELIVKSMGLEQSHLFYHNLPQGEDVPPLQLKEGVFRCIMQLFDCLLTEVHERCKKGLNLAKRLNSTLAFFCYDLLSIIEPRQVFELVSLYMDKFAGVCQSVLHDCKLTFLQIICDHDLFVEMPGRDPSDRNYLSSVLIQEIFLTLDHDDLLQRAKAARILVVLISKHEFDTRYQKSEDRLYIAQLYFPLIGQILDEMPVFYNLNAVEKREVLVLILQIIRNLDDTTLLKAWQQSIARTRLFFKLLEECITHFEHSRAGDSLLLGSSSRSPDAERPVSPKYSDRLSPSVNAYLSDASRHEIRLQGTPENGYMWNRVIPQLSSPNQPYSLREALAQAQSSRIGSTARALRESLHPVLRQKLELWEENLSTAVSLEVLGIIEKFSVAAASRSISTDYTKLDCVTSILMGLLSRSQPLTFWEAFLPVVYNIFSLHGATLMARENDRFLKQIAFHLLRLAVFRNDSVRKRAVVGLQILVRNSFNYFKSTTRLRVMLTITLSELLSDVQVTQMKSDGSLEESGEARRLRKSLEEMADVRSKDQLNECGLPVNALEVSAEGSTDNRWSWVEVKHLSKCLVQALDAGLEHALLGSVTTLDRCAAAEGFYKLALAYAPVPDLHIMWLLHLCDAHQEMQSWAEAAQCAVAVAGVIMQALVGRNDAVWSREHVASLCRICPIVGTDVGAEVSAAEVEGYGASKLTVDSAVKYLQLANKLFAQAELYHFCASIQELIIPVYKSRRAYGQLAKCHKSLTNIYESILEQEASPIPFIDATYYRVGFYGDRFGKLNKKEYVFREPRDVRLGDIMEKLSHTYEAKMDGNQNLHIIPDSRQVNADELQPGVCYLQITAVDPVMEDEDLESRRERIFSLSTGTVRARVFDRFLFDTPFTKNGKTQGGLESQWKRRTVLQTEGSFPALVNRLLVIKSESLEFSPVENAIGMIETRTAALRNELEEPRSSEGDQLPRLQSLQRILQGSVAVQVNSGVLSVCTAFLSGEPATRLRSQELQQLIAALLEFMAVCKRAIRVHFRLIGEEDQEFHTQLVNGFQSLTAELSHYIPAILSEL

SEQ ID NO: 3981 - protein, 943 aa, Sorghum bicolor
MESGAMVPGVALPEEAPDRNGAGPRDDLGQSQMQVDGPVVLNQSAELGSGDSMAVDDAPVQAQSGQPVAATQQSPTLADTIMEVQKQLKRKRASNSPVIASADKDALVARCRQELEGLFQFYKEVCDRKMQLDGGNLSVNGMVGCLLEESSLGLTKLVDEIYEKLRGLEGVSVASVRSSVLLAGQRMMYGKSSPDADVLEDESESALWCWEIRDLRLLPVKARSILSTRRSVRKKIHERITAIYSTLSVLENSGAYVQVNDLKKASLKLNKSLNLEGIRSMVEKVTQKNTERGVKDAGSAVKELTQEPEKNDQNVRRLEDTSVSELQNGNLPANEKEIQKAQKQVEKEIKRQEKEEAQMRKLQKKQQEEALREQKRREKEEAEAKKQQKKQEEEALKEQKRREKEEAEMKKQQKKQQEEAEKEQKRLEKEAAQLKKQLAIQKQASMMERFFKSKKDSGKLQKPGENNSADDPCNENKETVPATTSKIDSSLSQQESWVLEDLRRLQVTGWKKLSSYNRSSRWGIRCKPKMEAFKELKLQKSSDDMVDEILSTPNEDGGHNSAQENEHDKLESDIDMLQASEVQCHGTSNPKPLQTRLIRKKLLQFDKSNRPAYYGSWRKKSAVIGPRCPLKMDPDLDYEVDSDDEWEEEDPGESLSDCEKDNDEVMEEDSKITDEEDEDSFVVPDGYLSDNEGIQIESLLDDKDEEATSPPTGQCTEVEEFRSLLRQQRVLNTLTEQALRKSQPLIISNLNHEKAELLTAEDLKGTAKIEQLCLQVLSMRICPGGAVVDVPLTDTSSATVEEINQPNVKNGSPGAASAIPETDLPEIVQVIRSCRDGIHKVVELLQHKFPNVPKTQLNRKVREISDFIDNHWKVKKEILDKLGLDSSPVKSKKNKSISTYFSKRCLPPEEAVNALAASPELRLKSKTKSGTEAPQINLFPSKQ

SEQ ID NO: 3982 - protein, 968 aa, Zea mays
MESGAMVLGVVRPEESPDRNGGGPRDDLGPSQMQVDGPVVLNQSAELVSDDSMAVDDVPVQQPSGQPVEATQQSPATLIDTIMEVQKQLKRKRASNSPVIDAADKDALVAGCRQELEGLFQYYKEVSDRKMQLDGGNLSFNGMVGCLLEESSLGLTRLVDEIYQQLKGLEGVSVASVRSSVLLAGQRMMYGNSSLDADVLEDESESALWCWEIRDLRLLPVKVRSILSTRRSVRKKIHERITAIYSTLSVLENSGAYIQVNDLKKASLKLNKSLNLEGIRSMVERATQKNTERGVKDAVSAVKELMQETDKNDQNVRRLEDTSVSEPQNGNSLGNEKEIQKAQKQVEKEIKRQEKEEAQMRKLQKKQQEEALREQKRHEKEEAEAKKQQKKQEDEALKEQKRREKEEAEAKKQQKKQEEEVLKEQKRREKEEAEMKKQQKKQQDEAEKEQKRLEKEAAQLKKQLVIQKQASMMERFFKSKKDNGKHQKPGENNSAEDPCNDNKETIPATTSKIDSSLYQQEGWVLDDLRRLQVTGWKKLSSYNRSSRWGTRCKPKMEAFKELKLQKSSDDMVDEILSTPNEDGGRNPIQENEHDKLESDIDMIQASEMQCHGASNPKPLQTRLIRMKLLQFDKSNRPAYYGSWRKKSAAISPRCPFKMDPDLDYEVDSDDEWEEEDPGESLSDCEKDNDEFMEEDSKITDEEDEDSFVVPDGYLSDNEGIQIESLLDDKEEEANSSPNGQCTEVEEFRSLLRQQRVLNTLTEQALRKSQPLIICNLNHEKAELLTAEDLKGTEKIEQLCLQVLSMRICPGGAIVDVPLTDSSSATVEEINQPNVKNGSPEAASAIPETDLPEFVQVIRSCRDGIHKVVELLQHKFPNVPKTQLNRKVREISDFIDNHWKVKKEILDKLGLDSSPVKPKKNKSIAMYFSKRCLPPEEAVNALAASPELRLKSRNGGREAPQINLFPSEQ

SEQ ID NO: 3983 - protein, 942 aa, Panicum virgatum
MVLDVVRPEEAPDSNGAGAHDDLGQSQMQVDGPVVLNRSAELESCDSMATDDAPAQAPSSQPEAATQQSPSTLTDTIVEVQKQLKRKRASNSPAIADADRDALVAGCRQELEGLFQYYKEVSDRKMRFDAGNLSGNALVGCLLEESSLGLTKLVDEIYEKMKGLQGVSTASVRSSVLLVGQRMMYGKSSPDADVLEDESESALWCWEIRDLKLMPVKARSTLSTRRSVRKKIHDRINAIYSTLSVLENRGVETQVNDLRKTSLKLNKSLNLEEIRLMVERVIQKNTERGVRDAASTAKELMKEAEKNDQNVSRLDDASVSELQNGNLPANEKEIQKVQKQAEKEIKRQEKEEAQMRKLQKKQQEEALREQKRREKEEAEAKKQQKKQEEEALKEQKRREKEEAEMKKQQKKQQEEAEKEQKRREKEAAQLKKQLAIQKQASMMERFFKSKKDSGKLQKSGDNDSADGPIDKKEAVPATTSKIDSSLSQQENWILGDLRRLQVTGWKKLSSYNRSSRWGIRRKPKVEAFKELKLQKSSDDMVDEIFSTPNEDSCHNSCQENEHDKLESDIDMLPTSETQCHGTSNAKPLQTRLIRRKLLQFDKSNRPAYYGTWRKKSAVVGPRCPLKMDPDLDYEVDSDDEWEEEDPGESLSDCEKDGDEVMEEDSKITDEEDEDSFVVPDGYLSDNEGIQIESLLDDKDEEACSSPTGQCPEVEEFRSLLRQQKVLNTLTEQALRKSQPLVISNLNHEKAELLTAEDLKGTTKVEQLCLQVLSMRICPGGAVVDVPSIDNSSASAEEINQSNVKNGSPASASAIPETDLPEIVQVIRSCRDGINKVVELLHQKFPNVSKYQLNRRVREISDFVDNHWKVKKEILDKLGLDSSPVKSKKTKGIAMYFLKRCLPPEEAISALVSSPELRLKSKTIQNGNGGAEAPQINLFPSPQ

SEQ ID NO: 3984 - protein, 462 aa, Setaria italica
MQSLLLPTAAAAPVAAPRGRRQPPGRVSVRASATAAAAAPRRETDPKKRVVITGMGLVSVFGNDVDAYYDRLLAGESGIGPIDRFDASKFPTRFAGQIRGFSSEGYIDGKNDRRLDDCLRYCIVSGKKALESAGIALGSKPMEKIDKARAGVLVGTGMGGLTVFSDGVQNLIEKGYRKITPFFIPYAITNMGSALLGMDIGFMGPNYSISTACATSNYCFYAAANHIRRGEADIMIAGGTEAAIIPIGVGGFVACRALSQRNDDPKTASRPWDKERDGFVMGEGAGVLVMESLEHAMKRDAPIIAEYLGGAVNCDAYHMTDPRSDGLGVSSCIKQSLEDAGVAPEEVNYINAHATSTLAGDLAEVNAIKQVFKDPSGIKINATKSMIGHCLGAAGGLEAIATIKAMTTGWVHPSINQFNPEEVVEFDTVPNVKKQHEVNVGISNSFGFGGHNSVVVFAPFKP

SEQ ID NO: 3985 - protein, 461 aa, Sorghum bicolor
MQSLLLPTAAAAPVAAPRGRRSLPGRLSVRASATAAAAPRRETDPKKRVVITGMGLVSVFGNDVDAYYDRLLAGESGIGPIDRFDASKFPTRFAGQIRGFSSEGYIDGKNDRRLDDCLRYCIVSGKKALEAAGIGLGSKPMEKIDKTRAGVLVGTGMGGLTVFQDGVQNLIEKGYRKITPFFIPYAITNMGSALLGMDIGFMGPNYSISTACATSNYCFYAAANHIRRGEADIMIAGGTEAAIIPIGVGGFVACRALSQRNDDPKTASRPWDKDRDGFVMGEGAGVLVMESLDHAMKRDAPIIAEYLGGAVNCDAYHMTDPRADGLGVSSCIKQSLEDAGVAPEEVNYINAHATSTLAGDLAEVNAIKQVFKDPSGIKINATKSMIGHCLGAAGGLEAIATIKAITTGWVHPSINQFNPEEAVEFDTVPNVKKQHEVNVGISNSFGFGGHNSVVVFAPFKP

SEQ ID NO: 3986 - protein, 461 aa, Zea mays
MQSLLVPTAASAPVAAPRARRNLPMRLSVRASATAAAAPRRETDPKKRVVITGMGLVSVFGNDVDAYYDRLLAGESGIGPIDRFDASKFPTRFAGQIRGFSSEGYIDGKNDRRLDDCLRYCIVSGKKALEAAGIAHGSKPMEKIDKTRAGVLVGTGMGGLTVFSDGVQNLIEKGYRKITPFFIPYAITNMGSALLGMDIGFMGPNYSISTACATSNYCFYAAANHIRRGEADIMIAGGTEAAIIPIGVGGFVACRALSQRNDDPKTASRPWDKDRDGFVMGEGAGVLVMESLEHAIKRDAPIIAEYLGGAVNCDAYHMTDPRSDGLGVSSCIKQSLEDAGVAPEEVNYINAHATSTLAGDLAEVNAIKQVFKDPSGIKINATKSMIGHCLGAAGGLEAIATVKAITTGWVHPSINQFNPEEAVEFDTVPNVKKQHEVNVGISNSFGFGGHNSVVVFAPFKP

SEQ ID NO: 3987 - protein, 461 aa, Zea mays
MQSLLLPTAAVAPVAPPCGRRNLPGRLSVRASATVVAAPRRETDPKKRVVITGMGLVSVFGNDVDAYYDRLLVGESGIGPIDRFDASKFPTRFAGQIRGFSSEGYIDGKNDRRLDDCLRYCIVSGKKALEASGIAHGSKPMEKIDKTRAGVLVGTGMGGLTVFSDGVQNLIEKGYRKITPFFIPYAITNMGSALLGMDIGFMGPNYSISTACATSNYCFYAAANHIRRGEADIMIAGGTEAAIIPIGVGGFVACRALSQRNDDPKTASRPWDKDRDGFVMGEGAGVLVMESLEHAMKRDAPIIAEYLGGAVNCDAYHMTDPRSDGLGVSSCIKQSLKDAGVAPEEVNYINAHATSTLAGDLAEVNAIKQVFKDPSGIKINATKSMIGHCLGAAGGLEAIATIKAITTGWVHPSINQFNPEEAVEFDTVPNVKKQHEVNVGISNSFGFGGHNSVVVFAPFKP

SEQ ID NO: 3988 - protein, 451 aa, Panicum virgatum
APAAAPRGRRQPPRRVSVRASAAAAAAAPRRETDPRKRVVITGMGLVSVFGNDVDAYYDRLLAGESGIGPIDRFDASKFPTRFAGQIRGFSSEGYIDGKNDRRLDDCLRYCIVSGKKALEAAGIAHGSKPMEKIDKARAGVLVGTGMGGLTVFSDGVQNLIEKGYRKITPFFIPYAITNMGSALLGMDIGFMGPNYSISTACATSNYCFYAAANHIRRGEADIMIAGGTEAAIIPIGVGGFVACRALSQRNDDPKTASRPWDKDRDGFVMGEGAGVLVMESLEHAMKRDAPIIAEYLGGAVNCDAYHMTDPRSDGLGVSSCIKQSLEDAGVAPEEVNYINCHATSTLAGDLAEVNAIKKVFKDPSGIKINATKSMIGHCLGAAGGLEAIATVKAITTGWVHPSINQFNPEEAVEFDTVPNVKKQHEVNVGISNSFGFGGHNSVVVFAPFKP

SEQ ID NO: 3989 - protein, 463 aa, Brachypodium distachyon
MQSLLLPTAAASVAPAAPRGRRPGRISVRASATAAAAAAAPRRETDPKKRVVITGMGLVSVFGNDVDAYYDRLLAGESGVGPIDRFDASKFPTRFAGQIRGFSSEGYIDGKNDRRLDDCLRYCIVSGKKALEAAGLPLGSEAMGKIDKARAGVLVGTGMGGLQVFSDGVQNLIEKGYRKITPFFIPYAITNMGSALLGMDIGFMGPNYSISTACATSNYCFYAAANHIRRGEADIMVAGGTEAAIIPIGVGGFVACRALSQRNDDPQTASRPWDKERDGFVMGEGAGVLVMESLEHAMKRGAPIVAEYLGGAVNCDAYHMTDPRADGLGVSSCIRQSLEDAGVAPEEVNYINAHATSTLAGDLAEMNAIKQVFKDPSGIKVNATKSMIGHCLGAAGGLEAIATIKAINTGLVHPSINQFNREPAVEFDTVPNVKAEHEVNVGISNSFGFGGHNSVVVFAPFKP

SEQ ID NO: 3990 - protein, 460 aa, Secale cereale
MQSLLVPTAAACAAPSASRPRPARVSVRASAAAAAAPPRRETDPKKRVVITGMGLVSVFGNDVDAYYDRLLAGESGVGPIDRFDASKFPTRFAGQIRGFSSEGYIDGKNDRRLDDCLRYCIVSGKKALESAGLALGSDAMGKIDKARAGVLVGTGMGGLQVFSDGVQNLLEKGYRKITPFFIPYAITNMGSALLGMDIGFMGPNYSISTACATSNYCFYAAANHIRKGEADVMIAGGTEAAIIPIGVGGFVACRALSQRNDDPKTASRPWDKERDGFVMGEGAGVLVMESLEHAMKRGAPIVAEYLGGAVNCDAYHMTDPRADGLGVSSCIRQSLQDAGVAPEEVNYINAHATSTLAGDLAEMNAIKQVFKDPSGIKVNATKSMIGHCLGAAGGLEAIATIKAINTGLVHPSINQFDREPAVEFDTVPNVKAEHEINVGISNSFGFGGHNSVVVFAPFKP

SEQ ID NO: 3991 - protein, 460 aa, Avena sativa
MQSLLVPTAAASVAPATPRRRPGRISVRASATAAAAPPRRETDPKKRVVITGMGLVSVFGNDVDTYYDRLLAGESGIGLIDRFDASKFPTRFAGQIHGFSSEGYIDGKNDRRLDDCLRYCIVSGKKALESAGLALGSDSMEKIDKSRAGVLVGTGMGGLQVFSDGVQNLIEKGHRKITPFFIPYAITNMGSALLGMDIGFMGPNYSISTACATSNYCFYAAANHIRRGEADIMVAGGTEAAIIPIGVGGFVACRALSQRNDDPKTASRPWDKERDGFVMGEGAGILVMESLEHAMKRGAPIVAEYLGGAVNCDAYHMTDPRADGLGVSSCIRQSLQDSGVAPEEVNYINAHATSTLAGDLAEMNAIKQVFKDPTGIKVNATKSMIGHCLGAAGGLEAIAVIKAINTGLVHPSINQFNREEAVEFDTVPNVKAEHEVNVGISNSFGFGGHNSVVVFAPFKP

SEQ ID NO: 3992 - protein, 440 aa, Pennisetum glaucum
PGRVSVRASATAAAAAAPRRETDPKKRVVITGMGLVSVFGNDVDAYYDRLLAGESGIGPIDRFDASKFPTRFAGQIRGFSSEGYIDGKNDRRLDDCLRYCIVSGKKALESAGIAHGSKPMEKIDKARAGVLVGTGMGGLTVFSDGVQNLIEKGYRKITPFFIPYAITNMGSALLGMDIGFMGPNYSISTACATSNYCFYAAANHIRRGEADIMLAGGTEAAIIPIGVGGFVACRALSQRNDDPKTASRPWDKERDGFVMGEGAGVLVMESLEHAMKRDAPIIAEYLGGAVNCDAYHMTDPRSDGLGVSSCIKQSLEDAGVAPEEVNYINCHATSTLAGDLAEVNAIKQVFKDPSGIKINATKSMIGHCLGAAGGLEAIATIKAINTGWVHPSINQFNPEEVVEFDTVPNVKKQHEVNVGISNSFGFGGHNSVVVFAPFKP

SEQ ID NO: 3993 - protein, 468 aa, Musa acuminata
MQTLRVPTMDGLRLSPATPSATPRRPSLRRPAGASSIRASVVAAAPRRETDPKKRVVITGMGLVSVFGNDVDAYYEKLLEGESGIGPIDRFDASKLPTRFAGQIRGFSSEGYIDGKNDRRLDDCLRYCLVSGKKALESAGLGVGSQAISKIDKVRAGVLVGTGMGGLTVFSDGVQALIEKGHRKITPFFIPYAITNMGSALLAMDIGFMGANYSISTACATSNYCFYAAANHIRRGEADIMIAGGTEAAIIPIGVGGFVACRALSQRNDDPKTASRPWDTGRDGFVMGEGAGVLVMESLEHAMKRDAPIIAEYLGGAVNCDAYHMTDPRADGLGVSSCIRKSLEDAGVAPEEVSYINAHATSTLAGDLAEVNAINQVFKNPSGIKMNATKSMIGHCLGAAGGLEAIATVKAITTGWLHPSINQFNPEPAVEFDTVANKKQQHEVNIAISNSFGFGGHNSVVVFAPFKP

SEQ ID NO: 3994 - protein, 463 aa, Musa acuminata
MQTLLLPAVDGLRLSSPEPPPTLRRRSPRPLTAVRASAAPPRRETDPKKRVVITGMGLVSVFGNDVDAYYDKLLQGESGIGLIDRFDASKFPTRFAGQIRGFSSEGYIDGKNDRRLDGCLRYCLVSGKKALESAGLGVGSQTLNKIDKVRAGVLVGTGMGGLSIFSDGVQALIEKGHRKITPFFIPYAITNMGSALLAMDIGFMGPNYSISTACATSNYCFYAAANHIRRGEADIMIAGGTEAAIIPIGVGGFVACRALSQRNDDPKTASRPWDKDRDGFVMGEGAGVLVMESLEHAMKRDAPIIAEYLGGAVNCDAYHMTDPRADGLGVSSCVQKSLEDAGVAPEEVNYINAHATSTLAGDLAEVNAIKQVFKDPSAVKMNATKSMIGHCLGAAGGLEAIATVKAITTGWLHPTINQFNLEPAVEFDTVANEKQQHEVNVAISNSFGFGGHNSVVVFAPFKP

SEQ ID NO: 3995 - protein, 466 aa, Amorphophallus konjac
MEGLRLHRPAAPPLPSAGARCRRRIGPGPRPSVRASAGVAAAPPRRETDPKKRVVITGMGLVSVFGNDVDAYYERLLEGESGIGPINRFDASKFPTRFAGQIRGFTSEGYIDGKNDRRLDDCLRYCLVSGKKALESAGLPVGSAALEKIDKVRAGVLVGTGMGGLTVFSDGVQALIEKGYRKITPFFIPYAITNMGSALLAMDVGFMGANYSISTACATSNYCFYAAANHIRRGEADIMLAGGTEAAIIPIGLGGFVACRALSQRNDDPKTASRPWDKDRDGFVMGEGAGVLVLESLEHAMKRDAPIIAEYLGGAVNCDAYHMTDPRADGLGVSTCIQRSLEDAGVAPEEVNYINAHATSTLAGDLAEINAIKKVFKNTSEIKINATKSMIGHCLGAAGGLEAIATVKAITTGWLHPSINQFNPEPAVEFDTVANEKQQHEVNVAISNSFGFGGHNSVVVFAPFKP

SEQ ID NO: 3996 - protein, 476 aa, Cocos nucifera
MQTIRVPSMDGLHCSPSFPAPAAAAAPCRRGLLLRRSVRRPAVRASVAAAPVAPRRETDPRKRVVITGMGLVSVFGNDVDVYYEKLLEGESGIGPIDRFDASKFPTRFAGQIRGFSSEGYIDGKNDRRLDDCLRYCLVSGKKALESAGLAVGSKALSKIEKVRAGVLVGTGMGGLSVFSDGVQALIEKGYRKITPFFIPYAITNMGSALLAMDIGFMGANYSISTACATSNYCFYAAANHIRRGEADVMIAGGTEAAVIPIGIGGFVACRALSQRNDEPKTASRPWDKGRDGFVMGEGAGVLVMESLEHAMKRGASIIAEYLGGAVNCDAYHMTDPRADGLGVSSCIQRSLEDAGVAPEEVNYINAHATSTLAGDLAEVNAIKQVFKNPSDIKINATKSMIGHCLGAAGGLEAIATVKAITTGWLHPTINQFNPEPAVEFDTVANKKQQHEVNVAISNSFGFGGHNSVVVFAPFKP

SEQ ID NO: 3997 - protein, 470 aa, Cocos nucifera
MDGLRLPSMDGLRLSPSPPPAAAPSRRCLLLRRSVRRPAVRASVAVAPRRETDPKKRVVITGMGLVSVFGNDVDVYYKKLLEGESGIGPIDRFDASKFPTKFAGQIRGFSSEGYIDGKNDRRLDDCLRYCLVSGKKALESAGLGVGSKDLSKIDKVRAGVLVGTGMGGLTVFSDGVQALIEKGHRKITPFFIPYAITNMGSALLAMDIGFMGANYSISTACATSNYCFYAAANHIRRGEADVMIAGGTEAAIIPIGVGGFVACRALSQRNDDPKTASRPWDKGRDGFVMGEGAGVLVMESLEHAMKRDAPIIAEYLGGAVNCDAYHMTDPRADGLGVSSCIEKSLEDAGVAPEEVNYINAHATSTLAGDLAEVNAVKQVFKNPSEIKMNATKSMIGHCLGAAGGLEAIATVKAITTGWLHPTINQFNPEPAVEFDTVANKKQQHEVNVAISNSFGFGGHNSVVVFAPSKP

SEQ ID NO: 3998 - protein, 469 aa, Elaeis guineensis
MQTIRVPSMEGLRFSPSFPPPAAPSRRGLVRRSIRRPAVRASVAAAPRRETDPRKRVVITGMGLVSVFGNDVDVYYEKLLEGESGIGPIDRFDASKFPTRFAGQIRGFSSEGYIDGKNDRRLDDCLRYCLVSGKKALESTGLEVGSKALSKIDKVRAGVLVGTGMGGLTVFSDGVQALIEKGYRKITPFFIPYAITNMGSALLAMDIGFMGANYSISTACATSNYCFYAAANHIRRGEADVMIAGGTEAAIIPIGIGGFVACRALSQRNDEPKTASRPWDKGRDGFVMGEGAGVLVLESLEHAMKRGAPIIAEYLGGAVNCDAYHMTDPRADGLGVSSCIQKSLEDAGVAPEEVNYINAHATSTLAGDLAEVNAIKQVFKNPSHIKINATKSMIGHCLGAAGGLEAIATVKAITTGWLHPTINQFNPEPAVEFDTVANKKQQHEVNVAISNSFGFGGHNSVVVFAPFKP

SEQ ID NO: 3999 - protein, 470 aa, Elaeis guineensis
MQTLRLPSMDGLHLSPSPPPAAAPSRRGLLLRRSDWRPAVRASVAVAPRRETDPKKRVVITGMGLVSVFGNDVDVYYEKLLEGESGIGLIDRFDASKFPTKFAGQIRGFSSEGYIDGKNDRRLDDCLRYCLVSGKKALESAGLGVGSKDLSKIDKVRAGVLVGTGMGGLTVFSDGVQALIEKGYRKITPFFIPYAITNTGSALLAMDIGFMGANYSISTACATSNYCFYAAANHIRRGEADVMIAGGTEAAIIPIGVGGFVACRALSQRNDDPKTASRPWDRERDGFVMGEGAGVLVMESLEHAMKRDAPIIAEYLGGAVNCDAYHMTDPRADGLGVSSCIEKSLEDAGVAPEEVNYINAHATSTLAGDLAEVNAVKQVFKNPSEIKMNATKSMIGHCLGAAGGLEAIATVKAMTTGWLHPTINQFNPEPAVEFDTVANKKQQHEVNVAISNSFGFGGHNSVVVFAPFKP

SEQ ID NO: 4000 - protein, 144 aa, Panicum virgatum
MQAPAHTLGLRLPPPSSARPRPGRRPAVRAAAAATQAAPRRETDPRKRVVITGMGSGVRVRDRRWRLLRPAPAGRERGRPHRPLRRRQLPHPVRGPDQGILVGGIHRRQKRPQARRLPPILHRQRQEGARERRSRQGLRRARQA

SEQ ID NO: 4001 - protein, 456 aa, Musa acuminata
MQTLLLPAVDGLRLSSPEPPPTLRRRSPRPLTAVRASAAPPRRETDPKKRVVITGMGLVSVFGNDVDAYYDKLLQGECGIGLIDRFDASKFPTRFAGQIRGFSSEGYIDGKNDRRLDGCLRYCLVSGKKALESAGLGVGSQTLNKIDKVRAGVLVGTGMGGLSIFSDGVQALIEKGHRKITPFFIPYAITNMGSALLAMDIGFMGPNYSISTACATSNYCFYAAANHIRRGEADIMIAGGTEAAIIPIGVGGFVACRALSQRNDDPKTASRPWDKDRDGFVMGEGAGVLVMESLEHAMKRDAPIIAEYLGGAVNCDAYHMTDPRADGLGVSSCVQKSLEDAGVAPEEVNYINAHATSTLAGDLAEVNAIKQVFKDPSASMIGHCLGAAGGLEAIATVKAITTGWLHPTINQFNLEPAVEFDTVANEKQQHEVNVAISNSFGFGGHNSVVVFAPFKP

SEQ ID NO: 4002 - protein, 462 aa, Oryza sativa
MQAHAHTLGLRISPPPPAPPRRRARPRRRAVRVAAAASAPRRETDPRKRVVITGMGLVSVFGNEVDAFYERLLAGESGVGAIDRFDAGGFPTRFAGQIRGFSSEGYIDGKNDRRLDDCLRYCIVSGKKALENAGLGKGSDGHTKLDKVRAGVLVGTGMGGLTVFSDGVQNLIEKGYKKISPFFIPYAITNMGSALLAMDAGFMGPNYSISTACATSNYCFYAAANHIRRGEADVIVAGGTEAAIIPIGLGGFVACRALSQRNDDPETASRPWDKERDGFVMGEGAGVLVMESLEHAMKRDAPIIAEYLGGAVNCDAYHMTDPRSDGLGVSSCITQSLEDAGVAPEEVNYINAHATSTLAGDLAEVRAIKQVFKNPSDIKINSTKSMIGHCLGAAGGLEAIAVVKAITTGWVHPTINQFNPEPEVDFDTVANEKQQHEVNVAISNSFGFGGHNSVVVFAPFKP

SEQ ID NO: 4003 - protein, 503 aa, Allium cepa
MHSLRSPTLPLTPPTSRRRYQQKSARPTQIRASASVVAAPKRETDPKKRVVITGMGLVSVFGNDVDTYYDKLLEGESGIGLIDRFDASKFPTRFAGQIRNFSSEGYIDGKNDRRLDDCLRYCIVSGKKALESAGIGVGTEEMEKIDKVRAGVLVGTGMGGLTVFSDGVKALIEKGHRKITPFFIPYAITNMGSALLAMDIGFMGANYSISTACATSNYCFYAAANHIRRGEADIMIAGGTEAAIIPIGIGGFVACRALSQRNDDPKTASRPWDQGRDGFVMGEGAGTLVLESLEHALKRGAPIIAEYLGGSVNCDAYHMTDPRADGLGVSTCIQRSLEDAGVSPEEVNYINAHATSTLAGDLAEINAIKQVFKKPDGIKINATKSMIGHCLGASGGLEAIATVKAITTGWLHPSINQFNPEPAVEFDTVPNKNSNMKLMLQFQIHLGLVDTTRWLSLLHISLDLVRVNESHYLEALVSEIIFMDMRLSNCIIYFATFLRLFFY

SEQ ID NO: 4004 - protein, 462 aa, Allium cepa
MHSLRSPTLPLTPPTSRRRYQQKSARPTQIRASASVVAAPKRETDPKKRVVITGMGLVSVFGNDVDTYYDKLLEGESGIGLIDRFDASKFPTRFAGQIRNFSSEGYIDGKNDRRLDDCLRYCIVSGKKALESAGIGVGTEEMEKIDKVRAGVLVGTGMGGLTVFSDGVKALIEKGHRKITPFFIPYAITNMGSALLAMDIGFMGANYSISTACATSNYCFYAAANHIRRGEADIMIAGGTEAAIIPIGIGGFVACRALSQRNDDPKTASRPWDQGRDGFVMGEGAGTLVLESLEHALKRGAPIIAEYLGGSVNCDAYHMTDPRADGLGVSTCIQRSLEDAGVSPEEVNYINAHATSTLAGDLAEINAIKQVFKKPDGIKINATKSMIGHCLGASGGLEAIATVKAITTGWLHPSINQFNPEPAVEFDTVPNKKQQHEVNVAISNSFGFGGHNSVVVFAPYKP

SEQ ID NO: 4005 - protein, 462 aa, Allium cepa
MHSLRSPTLPLTPPTSRRRYQQKSARPTQIHASASVAAAPKRETDPKKRVVITGMGLVSVFGNDVDTYYEKLLEGESGIGLIDRFDASKFPTRFAGQIRNFSSEGYIDGKNDRRLDDCLRYCIVSGKKALESAGIGVGTEEMEKIDKVRAGVLVGTGMGGLTVFSDGVKALIEKGHRKITPFFIPYAITNMGSALLAMDIGFMGANYSISTACATSNYCFYAAANHIRRGEADIMIAGGTEAAIIPIGIGGFVACRALSQRNDDPKTASRPWDQGRDGFVMGEGAGTLVLESLEHALKRGAPIIAEYLGGSVNCDAYHMTDPRADGLGVSTCIQRSLEDAGVSPEEVNYINAHATSTLAGDLAEINAIKQVFKKPDGIKINATKSMIGHCLGASGGLEAIATVKAITTGWLHPSINQFNPEPAVEFDTVPNKKQQHEVNVAISNSFGFGGHNSVVVFAPYKP

SEQ ID NO: 4006 - protein, 465 aa, Eucalyptus grandis
MQSLHSPSLRGASPLDPLRAAAPRRRRPAPGRVAVVRAASMSAPPKRETDPRKRVVVTGTGLVSVFGNDVDAYYEKLLAGESGIGPIDRFDASKFPTRFAGQIRGFSSQGYIDGKNDRRLDDCLRYCIVAGKKALEHADLGGDRLSKIEKERAGVLVGTGMGGLTVFSDGVKNLIEKGHRKITPFFIPYAITNMGSALIAIELGFMGPNYSISTACATSNYCFYAAANHIRRGEADLMIAGGTEAAIIPIGLGGFVACRALSQRNDDPQTASRPWDKDRDGFVMGEGAGVLVLESLEHAMKRGAPIIAEYLGGAVNCDAYHMTDPRADGLGVSSCIERSLEDAGVSPEEVNYINAHATSTLAGDLAEINAIKKVFKNTSEIKINATKSMIGHCLGAAGGLEAIATVKAITTGWLHPSINQFNPEPSVDFDTVANKKQQHEVNVAISNSFGFGGHNSVVAFSAFKP

SEQ ID NO: 4007 - protein, 436 aa, Avena sativa
HLRPRLGNGGGCAPRRETDPKKRVVITGMGLVSVFGNDVDTYYDRLLAGESGIGLIDRFDASKFPTRFAGQIHGFSSEGYIDGKNDRRLDDCLRYCIVSGKKALESAGLALGSDSMEKIDKSRAGVLVGTGMGGLQVFSDGVQNLIEKGHRKITPFFIPYAITNMGSALLGMDIGFMGPNYSISTACATSNYCFYAAANHIRRGEADIMVAGGTEAAIIPIGVGGFVACRALSQRNDDPKTASRPWDKERDGFVMGEGAGILVMESLEHAMKRGAPIVAEYLGGAVNCDAYHMTDPRADGLGVSSCIRQSLQDSGVAPEEVNYINAHATSTLAGDLAEMNAIKQVFKDPTGIKVNATKSMIGHCLGAAGGLEAIAVIKAINTGLVHPSINQFNREEAVEFDTVPNVKAEHEVNVGISNSFGFGGHNSVVVFAPFKP

SEQ ID NO: 4008 - protein, 462 aa, Allium cepa
MQSLRTPTLPVAPPLSSRRSRRSSAALNPIRASSSTVSIPKRESDPKKRVVITGMGLVSVFGNDVDTYYDKLLQGESGIDLIDRFDASKFPTRFAGQIRNFSSEGYIDGKNDRRLDDCLRYCIVSGKKALESAGIGVGTKELEKIDKVRAGVLVGTGMGGLQVFSDGVQALIEKGYRKITPFFIPYAITNMGSALLAMDIGFMGANYSISTACATSNYCFYAAANHIRRGEADIMIAGGTEAAIIPIGIGGFVACRALSQRNDDPKTASRPWDQGRDGFVMGEGAGTLVLESLEHALKRGAPIIAEYLGGAVNCDAYHMTDPRADGLGVSTCIQRSLEDAGVSHEEVNYINAHATSTLVGDLAEVNAIKQVFKDPTGIKINATKSMIGHCLGAAGGLEAIATIKAITTGWLHPSINQFNPEPAVDFDTVPNKKQQHEVNVAISNSFGFGGHNSVVVFAPYKR

SEQ ID NO: 4009 - protein, 465 aa, Secale cereale
MHAHAPHALGLRVPPPTFPRRRARPRRRPAAAVRASASTSAPPQRETDPRKRVVITGMGLASVFGNDVDTFYDRLLAGESGVGPIDRFDASSFPTRFAGQIRGFSSEGYIDGKNDRRLDDCIRYCILSGKKALESAGLGAGSDAHGKLDVGRAGILVGSGMGGLSVFSDGVQNLIEKGYRKISPFFIPYAITNMGSALLAMDVGFMGPNYSISTACATSNYCFYAAANHIRRGEADIIVAGGTEAAIIPIGLGGFVACRALSQRNDDPVTASRPWDKERDGFVMGEGAGVLVMESLEHAMKRDAPIIAEYLGGAVNCDAYHMTDPRSDGLGVSSCITMSLRDAGVAPEEVNYINAHATSTLAGDLAEVRAIKQVFKNPSEIKINSTKSMTGHCLGAAGGLEAIATIKSITTGWVHPTINQFNPEPEVDFDTVANEKKQHEVNVAISNSFGFGGHNSVVVFAPFKP

SEQ ID NO: 4010 - protein, 425 aa, Ananas comosus
PPPRRETDPKKRVVITGMGLVSVFGNDVDAYYERLLEGESGIGLIDRFDASKFPTRFAGQIRGFTSEGYIDGKNDRRLDDCLRYCLVSGKKALQSAGLGVGTEALKKIEKVRAGVLVGTGMGGLTVFSDGVQALIEKGYRKITPFFIPYAITNMGSALLAMDIGFMGANYSISTACATSNYCFYAAANHIRRGEADIMLAGGTEAAIIPIGVGGFVACRALSQRNDDPKTASRPWDKDRDGFVMGEGAGVLVMESLEHAMKRDAPIIAEYLGGAVNCDAYHMTDPRSDGLGVSSCIGKSLEDAGVAPEEVNYINAHATSTLAGDLAEVNAIKKVFKDPSQIKMNATKSMIGHCLGAAGGLEAIATIKAINTGWLHPSINQFNPEPAVEFDTVANKKQQYEVNVAISNSFGFGGHNSVVVFAPFKP

SEQ ID NO: 4011 - protein, 415 aa, Lolium multiflorum
KRVVITGMGLVSVFGNDVDAYYDRLLAGESGIGPIDRFDASKFPTRFAGQIHGFSSEGYIDGKNDRRLDDCLRYCIVSGKKALEAAGLALGSDAMDKIDKSRAGVLVGTGMGGLQVFSDGVQNLIEKGHRKITPFFIPYAITNMGSALLGMDIGFMGPNYSISTACATSNYCFYAAANHIRRGEADVMIAGGTEAAIIPIGVGGFVACRALSQRNDDPKTASRPWDKERDGFVMGEGAGLLVMESLEHAMKRGAPIVAEYLGGAVNCDAYHMTDPRADGLGVSSCIRQSLQDAGVAPEEVNYINAHATSTLAGDLAEMNAIKQVFKDPTGIKVNATKSMIGHCLGAAGGLEAIAVIKAINTGLVHPSINQFNREEVIEFDTVPNVKAEHEVNVGISNSFGFGGHNSVVVFAPFKP

SEQ ID NO: 4012 - protein, 464 aa, Cajanus cajan
MQALQSPTLRASPLDPLRDHKRRSTAAKRVFFVSATAAPKVSAPQRQKDPKKRVVITGMGLASVFGNDVDGYYEKLLSGQSGITPIDRFDASKFPTRFGGQIRGFSAEGYIDGKNDRRLDDCLRYCIVAGKKALESADLAAENRSKIDKERAGVLVGSGMGGLTVFSDGVQALIEKGHRKITPFFIPYAITNMGSALLGIDLGFMGPNYSISTACATSNYCFYAAANHIRRGEADLMIAGGTEAAIIPIGLGGFVACRALSQRNDDPKTASRPWDKDRDGFVMGEGAGVLVMESLEHAMKRGAPIIAEYLGGAVNCDAYHMTDPRSDGLGVSSCIQSSLEDAGVSPEEVNYINAHATSTLAGDLAEINAIKKVFKDTSGIKINATKSMIGHCLGAAGGLEAIATVKAITTGWLHPTINQFNPEPAVDFDTVASVKQQHEVNVAISNSFGFGGHNSVVAFSAFRP

SEQ ID NO: 4013 - protein, 528 aa, Setaria italica
QQAAYFAFYPNPIRSSTSPSPSKTHTSSATLAARRLRLRPRRGVYITAITTAPTSLPHSSAAAPSPAMQAPAHTLGLRLPPPSSSARRRARRPVRTAAAAATQAAPRRETDPRKRVVITGMGLVSVFGSDVGAFYDRLLQGESGVGPIDRFDAGSFPTRFAAQIRDFSSEGYIDGKNDRRLDDCLRYCIVSGKKALENAGLAKGSDAHVKLDKVRAGVLVGTGMGGLTVFSDGVQNLIEKGYRKISPFFIPYAITNMGSALLAMDVGFMGPNYSISTACATSNYCFYAAANHIRRGEADIIVAGGTEAAIIPIGLGGFVACRALSQRNDDPTTASRPWDKERDGFVMGEGAGVLVMESLEHAMKRDAPIIAEYLGGAVNCDAYHMTDPRSDGLGVSSCITKSLEDAGVAPEEVNYINAHATSTLAGDLAEVRAIKQVFNNTSEIKINSTKSMIGHCLGAAGGLEAIATVEAITTGWVHPTINQFNPEPEVEFDTVANEKKQHEVNVAISNSFGFGGHNSVVVFAPFKA

SEQ ID NO: 4014 - protein, 471 aa, Aristolochia fimbriata
MQTLQVQAPSLRVSPSDRLPRRFTPFPLLRRPNVRRSHPGSFVRASLSGAPNRETDPKKRVVITGMGLVSVFGNDVDTYYDRLLSGESGIGPIDRFDASKFPTRFGGQIRGFTSDGYIDGKNDRRLDDCLRYCLVSGKKALENAGLGGTDISKIDKERAGVLVGTGMGGLTVFSDGVQALIERGYRKITPFFIPYAITNMGSALLGIELGFMGPNYSISTACATSNYCFYAAANHIRRGEADLMLAGGTEAAIIPIGLGGFVACRALSQRNDDPQTASRPWDKDRDGFVMGEGAGVLVMESLEHAMKRGAPIIAEYLGGAVNCDAYHMTDPRADGLGVSSCIERSLEDAGVAPEEVNYINAHATSTLAGDLAEINAIKKVFKDTSGIKINATKSMIGHCLGAAGGLEAIATVKAITTGWLHPSINQFNPEPSVEFDTVANQKKQHEVNVAVSNSFGFGGHNSVVVFSAFKP

SEQ ID NO: 4015 - protein, 415 aa, Hordeum vulgare
KRVVITGMGLVSVFGNDVDAYYDRLLAGESGVGPIDRFDASKFPTRFAGQIRGFSSEGYIDGKNDRRLDDCLRYCIVSGKKALESAGLPLGSDAMAKIDKARAGVLVGTGMGGLQVFSDGVQNLLEKGYRKITPFFIPYAITNMGSALLGMDIGFMGPNYSISTACATSNYCFYAAANHIRKGEADMMIAGGTEAAIIPIGVGGFVACRALSQRNDDPKTASRPWDKERDGFVMGEGAGVLVMESLEHAMKRGAPIVAEYLGGAVNCDAYHMTDPRADGLGVSSCIRQSLQDAGVAPEEVNYINAHATSTLAGDLAEMNAIKQVFKDPSGIKVNATKSMIGHCLGAAGGLEAIATIKAINTGLVHPSINQFDREPAVEFDTVPNVKAEHEINVGISNSFGFGGHNSVVVFAPFKP

SEQ ID NO: 4016 - protein, 463 aa, Vitis vinifera
MHVLQSPALCPTPPHRLGRFNAKQPRKKVSFILSAASPTVAAPKREKDPKKRVVITGMGLVSVFGNDVDAYYEKLLAGESGISPIDRFDASKFPTRFGGQIRGFDSQGYIDGKNDRRLDDCLRYCIVAGKKALEDADLGGADISKIDKERAGVLVGTGMGGLTVFSDGVQALIERGHRKITPFFIPYAITNMGSALLAIDLGFMGPNYSISTACATSNYCFYAAANHIRRGEADLMIAGGTEAAIIPIGLGGFVACRALSQRNDDPQTASRPWDKDRDGFVMGEGAGVLVMESLEHAMKRGAPIIAEYMGGAVNCDAYHMTDPRSDGLGVSSCIESSLEDAGVSPEEVNYINAHATSTIVGDLAEVNAIKKVFKSTSEIKMNATKSMIGHCLGAAGGLEAIATVKAITTGWLHPTINQFNPEPSVEFDTVANKKQQHEVNVAISNSFGFGGHNSVVVFSAFKP

SEQ ID NO: 4017 - protein, 472 aa, Triphysaria pusilla
MQSLHSAALRPSPIDPLLKPPLSTCFPGRNAKLPPKRLPFTISASATTVSAPKRETDPKKRVVITGMGLVSVFGNDVDAYYEKLLAGESGITLIDRFDASKFPTRFGGQIRGFKAEGYIDGKNDRRLDDCLRYCIVAGKKALEGADLGGDNLNKIDKIRAGVLVGTGMGGLTVFSDGVQALIEKGHRKITPFFIPYAITNMGSALLGIDLGFMGPNYSISTACATSNYCFYAAANHIRRGEADLMLAGGTEAAMIPIGLGGFVACRALSQRNDDPKTASRPWDKDRDGFVMGEGAGVLVMESLEHAMKRGAPIIAEYLGGAVNCDAYHMTDPRADGLGVSSCIHSALVDAGVSPEEVNYINAHATSTIVGDLAEVNAIKKVFKNTSEIKINATKSMIGHCLGAAGGLEAIATVKAITTGWLHPSINQFNPESSVEFDTVANKKQQHEVNVAISNSFGFGGHNSVVAFSAFKP

SEQ ID NO: 4018 - protein, 469 aa, Glycine max
MQALHSPTLRTSPLDPLRGPNNAAAKRRASSAKRVFFVSATVAPKVSAPQRQKDSKKRVVITGMGLASVFGNDVEGYYEKLLAGESGITPIDRFDASKFPTRFGGQIRGFSAEGYIDGKNDRRLDDCLRYCIVAGKKALENADLAPDNHSKIDKERAGVLVGSGMGGLTVFSDGVQALIEKGHRKITPFFIPYAITNMGSALLGIDLGFMGPNYSISTACATSNYCFYAAANHIRRGEADLMIAGGTEAAIIPIGLGGFVACRALSQRNDDPKTASRPWDKDRDGFVMGEGAGVLVMESLEHAMKRGAPIIAEYLGGAVNCDAYHMTDPRSDGLGVSTCIQSSLEDAGVSPEEVNYINAHATSTLAGDLAEINAIKKVFKDTSGIKINATKSMIGHCLGAAGGLEAIATVKAITTGWLHPTINQFNPEPAVDFDTVANVKQQHEINVAISNSFGFGGHNSVVAFSAFRP

SEQ ID NO: 4019 - protein, 462 aa, Triticum aestivum
MHAHAPHALGLRVPPPAFPRHRARPRRRPAAAVRATSAAPQRETDPRKRVVITGMGLASVFGNDVDTFYDRLLAGESGVGPIDRFDASSFPTRFAGQIRGFSSEGYIDGKNDRRLDDCIRYCILSGKKALESAGIGAGSDAHGKLDVGRAGILVGSGMGGLSVFSDGVQNLIEKGYRKISPFFIPYAITNMGSALLAMDVGFMGPNYSISTACATSNYCFYAAANHIRRGEADIIVAGGTEAAIIPIGLGGFVACRALSQRNDDPITASRPWDKERDGFVMGEGAGVLVMESLEHAMKRDAPIIAEYLGGAVNCDAYHMTDPRSDGLGVSSCITMSLRDAGVAPEEVNYINAHATSTLAGDLAEVRAIKQVFKNPSEIKINSTKSMIGHCLGAAGGLEAIATIKSITTGWVHPTVNQFNPEPEVDFDTVANEKKQHEVNVAISNSFGFGGHNSVVVFAPFKP

SEQ ID NO: 4020 - protein, 468 aa, Vigna unguiculata
MQALNSPTLRASPLDPLRAPNNAANRRAAAAKRVFFVSATAAPKVSAPQRQKDPKKRVVITGMGLASVFGNDVEGYYEKLLAGESGITAIDRFDASKFPTRFGGQIRGFSAQGYIDGKNDRRLDDCLRYCIVAGKKALESADLAKDNLTKLDKERAGVLVGSGMGGLTVFSDGVQSLIEKGHRKITPFFIPYAITNMGSALLGIDLGFMGPNYSISTACATSNYCFYAAANHIRRGEADLMIAGGTEAAIIPIGLGGFVACRALSQRNDDPKTASRPWDQGRDGFVMGEGAGVLVMESLEHAMKRGAPIIAEYLGGAVNCDAYHMTDPRSDGLGVSSCIQSSLEDAGVSPEEVNYINAHATSTLAGDLAEINAIKKVFKDTSGIKINATKSMIGHCLGAAGGLEAIATVKAITTGWLHPTINQFNPEPAVDFDTVANVKQQHEVNVAISNSFGFGGHNSVVAFSAFRP

SEQ ID NO: 4021 - protein, 533 aa, Citrullus lanatus
MQAAVHSSTLKPSPLDSFRNRKCSPLLVAAAPKSRRRVSYVSAAAASTVSAPKREKDPKKRVVITGMGLVSVFGNDVDTYYDKLLSGESGITLIDRFDASKFPTRFGGQIRGFASQGYIDGKNDRRLDDCLRYCIVAGKKALEDADLGGDKRSKIDKERAGVLVGTGMGGLTVFSDGVQALIEKGHRKITPFFIPYAITNMGSALLAIDIGFMGPNYSISTACATSNYCFYAAANHIRRGEADMMLAGGTEAAIIPIGLGGFVACRALSQRNDDPKTASRPWDKDRDGFVMGEGAGILVMESLEHAMKRGAPILAEYLGGAVNCDAYHMTDPRADGLGVSSCILSSLEDAGVSPEEVNYINAHATSTLAGDLAEINAIKKVFKNTSEIKINATKSMIGHCLGAAGGLEAIATVKAIETGWLHPSINQFNPEPSVDFDTVANVKQQHEVNVAISNSFGFGGHNSVVAFSASSIQTLSMLMLRTTTFCRRIQSLALRIVTNLFINEVALLAAGVLSVFQRFALLCNSICCCFLIQ

SEQ ID NO: 4022 - protein, 469 aa, Daucus carota
MQALQSSPLRVSPLDPLRKPTSGAATVTNVRPPHKKSFISAAATTTSAPKRETDPSKRVVITGMGLVSVFGNDVDTYYDKLLAGESGIGLIDRFDASKFPTRFGGQIRGFSSEGYIDGKNDRRLDDCLRYCIVAGKKALENADLGGDKRFKVDKERAGVLVGTGMGGLTVFSDGVQALIERGHRKITPFFIPYAITNMGSALLAIDLGFMGPNYSISTACATSNYCFYAAANHIRRGEADLMIAGGTEAAIIPIGLGGFVACRALSQRNDDPKTASRPWDKDRDGFVMGEGAGVLVMESLEHAMKRGAPIIAEYLGGAINCDAYHMTDPRSDGLGVSSCIQSSLIDAGVSPEEVNYINAHATSTLVGDLAEVNAVKKVFKNTSGIKMNATKSMIGHCLGAAGGLEAIAVIKAITTGWLHPTINQFNAEPSVEFDTVANQKQQHEVNVGISNSFGFGGHNSVVAFSAFKP

SEQ ID NO: 4023 - protein, 471 aa, Cucumis sativus
MQAAVHSSTLKPSPLDSFRSRKCSPFLVSAPKSRPRLSFISASAASTVSAPKREKDPKKRVVITGMGLVSVFGNDVDTYYDKLLSGESGVTLIDRFDASKFPTRFGGQIRGFASQGYIDGKNDRRLDDCLRYCIVAGKKALEDADLGGDKRSKIDKERAGVLVGTGMGGLTVFSDGVQALIEKGHRKITPFFIPYAITNMGSALLAIDIGFMGPNYSISTACATSNYCFYAAANHIRRGEADMMLAGGTEAAIIPIGLGGFVACRALSQRNDDPKTASRPWDKDRDGFVMGEGAGILVMESLEHAMKRGAPIIAEYLGGAVNCDAYHMTDPRADGLGVSSCILSSLEDAGVSPEEVNYINAHATSTLAGDLAEINAIKKVFKNTSEIKINATKSMIGHCLGAAGGLEAIATVKAIETGWLHPSINQFNPEPSVDFDTVANVKQQHEVNVAISNSFGFGGHNSVVAFSAFKP

SEQ ID NO: 4024 - protein, 467 aa, Phaseolus vulgaris
MQALHSPTLRASPLEPLRAPNNAANRRTAAKRVFFVSATAAPKVSAPQRQKDPKKRVVITGMGLASVFGNDVEGYYEKLLSGQSGITAIDRFDASKFPTRFGGQIRGFSAEGYIDGKNDRRLDDCLRYCIVAGKKALENADLAADNLTKLDKERAGVLVGSGMGGLTVFSDGVQALIEKGHRKITPFFIPYAITNMGSALLGIDLGFMGPNYSISTACATSNYCFYAAANHIRRGEADLMIAGGTEAAIIPIGLGGFVACRALSQRNDDPKTASRPWDKERDGFVMGEGAGVLVMESLEHAMKRGAPIIAEYLGGAVNCDAYHMTDPRSDGLGVSSCIQSSLEDAGVSPEEVNYINAHATSTLAGDLAEINAIKKVFKDTSGIKINATKSMIGHCLGAAGGLEAIATVKAITTGWLHPTINQFNPEPAVDFDTVANVKQQHEVNVAISNSFGFGGHNSVVAFSAFKP

SEQ ID NO: 4025 - protein, 468 aa, Jatropha curcas
MQALQSPSIRASPLSPFHKKSHNATKPPTKKISFITASSTNSSTVTAPKREKDPKKRVVITGMGLVSVFGNDVDAYYDKLLAGESGIGPIDRFDASKFPTRFAGQIRGFGAEGYIDGKNDRRLDDCLRYCIVAGKKSLEHADLGGDNLSKVDKERAGVLVGTGMGGLTVFSDGVQALIEKGHRKITPFFIPYAITNMGSALLAMEIGFMGPNYSISTACATSNYCFYAAANHIRRGEADLMIAGGTEAAIIPIGLGGFVACRALSQRNDDPQTASRPWDRDRDGFVMGEGAGVLVMESLEHAMKRGAPIIAEYLGGAVNCDAYHMTDPRADGLGVSSCIERSLEDAGVSPEEVNYINAHATSTLAGDLAEINAIKKVFKDTSEIKINATKSMIGHCLGAAGGLEAIACAKAITTGWLHPTINQFNPEPSVEFDTVANKKQQHEVNVAISNSFGFGGHNSVVAFSAFKP

SEQ ID NO: 4026 - protein, 466 aa, Populus trichocarpa
MEALQSLYLSSSPLNPLHQKSHNATKPPPERISFIKASSSSTVSAPKREKDPKKRVVITGMGLVSVFGNDVDAYYDKLLAGESGIGTIDRFDASKFPTRFAGQIRGFNAQGYIDGKNDRRLDNCLRYCIVAGKKALEDADLGGNNLSKIDKEKAGVLVGTGMGGLTVFSDGVQSLIEKGHRKITPFFIPYAITNMGSALLGIELGFMGPNYSISTACATSNYCFYAAANHIRRGEADMMIAGGTEAAIIPIGLGGFVACRALSQRNDDPKTASRPWDRDRDGFVMGEGAGVLVMESLEHAMKRGAPIIAEYLGGAVNCDAYHMTDPRADGLGVSSCIERSLEDAGVSPEEVNYINAHATSTLAGDLAEINAIKKVFKNTSEIKINATKSMIGHCLGASGGLEAIATVKAITTGWLHPSINQFNPEPSVEFDTVANKKQQHAVNVAISNSFGFGGHNSVVAFSAFKP

SEQ ID NO: 4027 - protein, 469 aa, Glycine max
MQALHSPTLRASPLDPLRGPNNAAANRRSSSAKRVFFVSATVAPKVSAPQRQKDPKKRVVITGMGLASVFGNDVEGYYEKLLAGESGITAIDRFDASKFPTRFGGQIRGFSAEGYIDGKNDRRLDDCLRYCIVAGKKALENADLAPDNHSKIDKERAGVLVGSGMGGLTVFSDGVQALIEKGHRKITPFFIPYAITNMGSALLGIDLGFMGPNYSISTACATSNYCFYAAANHIRRGEADLMIAGGTEAAIIPIGLGGFVACRALSQRNDDPKTASRPWDKERDGFVMGEGAGVLVMESLEHAMKRGAPIIAEYLGGAVNCDAYHMTDPRSDGLGVSTCIQSSLEDAGVSPEEVNYINAHATSTLAGDLAEINAIKKVFKDTSGIKINATKSMIGHCLGAAGGLEAIATVKAITTGWLHPTINQFNPEPAVDFDTVANVKQQHEINVAISNSFGFGGHNSVVAFSAFKP

SEQ ID NO: 4028 - protein, 471 aa, Lotus japonicus
MQSLHIQPLQPTLRASPLDPLRKSSNAANRRLPGGKRKTFVVSAAVTTAAPKRQKDPKKRVVITGMGLASVFGNEVDGYYDKLLAGESGITPIDRFDASKFPTRFGGQIRGFSAEGYIDGKNDRRLDDCLRYCIVAGKKALESADLGAENRSKIDKERAGVLVGSGMGGLTVFSDGVKALIEKGHRKITPFFIPYAITNMGSALLGIDLGFMGPNYSISTACATSNYCFYAAANHIRRGEADLMLAGGTEAAIIPIGLGGFVACRALSQRNDDPKTASRPWDKDRDGFVMGEGAGVLVMESLEHAMRRGAPIIAEYLGGAVNCDAYHMTDPRSDGLGVSTCIQSSLEDAGVSPEEVNYINAHATSTNAGDLAEINAIKKVFKDTSGIKINATKSMIGHCLGAAGGLEAIATVKAITTGWLHPSINQFNPEPAVDFDTVANVKQQHEVNVAISNSFGFGGHNSVVAFSAFKP

SEQ ID NO: 4029 - protein, 469 aa, Nicotiana benthamiana
MQSIQSPSFRPSPLDPLKKTVPQFTNVRPLSHVKRVSFISASATTVSAPKREKDPKKRVVITGMGLVSVFGNDVDTYYDRLLAGESGISLIDRFDASKFPTRFGGQIRGFTSDGYIDGKNDRRLDDCLRYAIVAGKKALENADLGGDRLGKIDKERAGVLVGTGMGGLTVFSDGVQNLIEKGHRKITPFFIPYAITNMGSALLGIDLGFMGPNYSISTACATSNYCFYAAANHIRRGEADLMLAGGTEAAIIPIGLGGFVACRALSQRNDDPQTASRPWDKERDGFVMGEGAGVLVMESLEHAMKRGAPIIAEYLGGAVNCDAHHMTDPRADGLGVSSCIQSSLEDAGVSPEEVNYINAHATSTIVGDIAEVNAIKKVFKNTSGIKMNATKSMIGHCLGAAGGMEAIATVKAITTGWVHPSINQFNPESSVEFDTVPNKKQQHEVNVGISNSFGFGGHNSVVAFSAFKP

SEQ ID NO: 4030 - protein, 470 aa, Arachis hypogaea
MQAIHTPTLRVSPLDPLRKSTNAPISTRRASKRVSFTVSAAAVSPKVSAPQRQKDPKKRVVITGMGLASVFGNDVDTFYDRLLAGESGITTIDRFDASKFPTRFGGQIRGFSSEGYIDGKNDRRLDDCLRYCIVAGKKALENADLGGEKLNKLDKEKAGVLVGSGMGGLTVFSDGVQALIEKGHRKITPFFIPYAITNMGSALLGIDLGFMGPNYSISTACATSNYCFYAAANHIRRGEADLMIAGGTEAAIIPIGLGGFVACRALSQRNDDPKTASRPWDKDRDGFVMGEGSGVLVMESLEHAMRRGAPIIAEYLGGAVNCDAYHMTDPRSDGLGVSSCIQSSLEDAGVSPEEVNYINCHATSTLAGDLAEINAIKKIFKKTDGIKINATKSMIGHCLGAAGGLEAIATVKAITTGWLHPSINQFNPEPAVDFDTVANVKKQHEINVGISNSFGFGGHNSVVAFSAFKP

SEQ ID NO: 4031 - protein, 469 aa, Nicotiana benthamiana
MQSIQSPSFRPSPLDPLRKTVPQFTNVRPLSHAKRVPFISASATTVSAPKREKDPKKRVVITGMGLVSVFGNDVDTYYDKLLAGESGISLIDRFDASKFPTRFGGQIRGFTSDGYIDGKNDRRLDDCLRYAIVAGKKALENADLGGDRLGKIDKERAGVLVGTGMGGLTVFSDGVQNLIEKGHRKITPFFIPYAITNMGSALLGIDLGFMGPNYSISTACATSNYCFYAAANHIRRGEADLMLAGGTEAAIIPIGLGGFVACRALSQRNDDPQTASRPWDKERDGFVMGEGAGVLVMESLEHAMKRGAPIIAEYLGGAVNCDAHHMTDPRADGLGVSSCIQSSLEDAGVSPEEVNYINAHATSTIVGDIAEVNAIKKVFKNTSGIKMNATKSMIGHCLGAAGGMEAIATVKAITTGWVHPSINQFNPEPSVEFDTVPNKKQQHEVNVGISNSFGFGGHNSVVAFSAFKP

SEQ ID NO: 4032 - protein, 416 aa, Lippia dulcis
MQSLQTTALRPSPLDPLRKPSHSAALPSNNAKPPAKRRPFKITASASTASAPKRETDPKKRVVITGMGLVSVFGNDVDAYYEKLLAGESGITLIDRFDASKFPTRFGGQIRGFTSEGYIDGKNDRRLDDCLRYCIVAGKKALESADLGGDKLNKIDKIRAGVLVGTGMGGLTVFSDGVQALIEKGHRKITPFFIPYAITNMGSALLAIDLGLMGPNYSISTACATSNYCFYAAANHIRRGEADIMIAGGTEAAIIPIGLGGFVACRALSQRNDDPKTASRPWDKDRDGFVMGEGAGVLVMESLEHAMKRDAPIIAEYLGGAVNCDAYHMTDPRADGLGVSSCIQSALEDAGVSPEEVNYINAHATSTIVGDLAELNAIKKVFKNTSGIKINATKSMIGHCLGAAGGLEAIATVKDH

SEQ ID NO: 4033 - protein, 472 aa, Cicer arietinum
MQSLQIQQLPSTLRPSPLDPLRRKTSNAAATKIKPTSKRLSHISAAVTTTAPQREKDPKKRVVITGMGLASVFGNDVDGFYDKLLAGESGITSIDRFDASKFPTRFAGQIRDFNSEGYIDGKNDRRLDDCLRYCIVAGKKALENADLGAGNLSKIDKERAGVLVGSGMGGLTVFSEGVKNLIEKGHRKITPFFIPYAITNMGSALLGIDLGFMGPNYSISTACATSNYCFYAAANHIRRGEADLMIAGGTEAAIIPIGLGGFVACRALSQRNDDPKTASRPWDKDRDGFVMGEGSGVLVMESLEHAMKRGAPIIAEYLGGAVNCDAHHMTDPRSDGLGVSTCIQSSLIDAGVSPEEVNYINAHATSTLAGDLAEINAIKKVFKNTSGIKINATKSMIGHCLGASGGLEAIATVKAITTGWLHPSINQFNPEPAVDFDTVPNVKKQHEINVGISNSFGFGGHNSVVAFSAFRP

SEQ ID NO: 4034 - protein, 469 aa, Cleome spinosa
MQVLQSPSLRASPPNPLRKHSNRQSHQIANARPTRKRHFIAASAAVSAPKRETDPKKRVVITGTGLVSVFGNDVDAYYEKLLAGESGISNIDRFDASKFPTRFGGQIRGFSSEGYIDGKNDRRQDDCLKYCIVAGKKALESADLGGDKLNKIDKIRAGVLVGTGMGGLTVFSDGVQALIEKGHRRITPFFIPYAITNMGSALLAIDLGLMGPNYSISTACATSNYCFYAAANHIRRGEADMMLAGGTEAAIIPIGLGGFVACRALSQRNDDPKTASRPWDKDRDGFVMGEGAGVLVMESLEHALKRGAPIIAEYLGGAINCDAYHMTDPRSDGLGVSSCIERCLEDAGVSPEEVNYINAHATSTLAGDLAEINAIKKVFKNTSEIKINATKSMIGHCLGAAGGLEAIATVKAITTGWLHPTINQFNPEPAVDFDTVPNQKKQHDVNVAISNSFGFGGHNSVVAFSAFRP

SEQ ID NO: 4035 - protein, 243 aa, Trifolium pratense
MQSLQIQQLPSTLRPSPLEPLRKKSTNAATAAKPKSSKRFTRVSASVTTTAPQRQKDPKKRVVITGMGLASVFGNDVDGYYEKLLAGESGITSIDRFDASKFPTRFAGQIRGFSSEGYIDGKNDRRLDDCLRYCIVAGKKALEHANLGGENLSKIDKERAGVLVGSGMGGLTVFSEGVKNLIEKGHRKITPFLFLMQLRIWVRLCLGLIWVSWVQIIQFQLLVLLRIIVFMLLPITFVGVRRI

SEQ ID NO: 4036 - protein, 472 aa, Trifolium pratense
MQSLQIQQLPSTLRPSPLEPLRKKSSNAATAAKTKSSKRFTRVSAAVTTTAPQRQKDPKKRVVITGMGLASVFGNDVDGYYEKLLAGESGITSIDRFDASKFPTRFAGQIRGFSSEGYIDGKNDRRLDDCLRYCIVAGKKALEHANLGGENLSKIDKERAGVLVGSGMGGLTVFSEGVKNLIEKGHRKITPFFIPYAITNMGSALLGIDLGFMGPNYSISTACATSNYCFYAAANHIRRGEADLMIAGGTEAAIIPIGLGGFVACRALSQRNDDPRTASRPWDKDRDGFVMGEGSGVLVLESLEHAMKRGAPIIAEYLGGAVNCDAYHMTDPRSDGLGVSTCIQSSLVDAGVSPEEVNYINAHATSTLAGDLAEINAIKKVFKNTSGIKINATKSMIGHCLGAAGGLEAIATVKAITTGWVHPSINQFNPEPAVDFDTVPNVKQQHEINVGISNSFGFGGHNSVVAFSAFRP

SEQ ID NO: 4037 - protein, 462 aa, Brachypodium distachyon
MQSHAAHALGLRGPPPALPGRRRARPWRRPATAVRAAVAPQRETDPRKRVVITGMGLVSVFGSEVDGFYDRLLAGESGVRTIDRFDPGSFPTRFAGQIRGFSSEGYIDAKNDRRMDDCIRYCIVSGRKALESAGLDRGSDAHGKIDLGRAGVLVGTGMGGLSVFSNGVQNLIEKGYRKISPFFIPYAISNMGSALLATDVGFMGPNYSISTACATSNYCFYAAANHIRRGEADVIVAGGTEAAIIPIGLGGFVACRALSQRNDDPETASRPWDKERDGFVMGEGAGVLVMESLGHAIKRDAPIIAEYLGGAVNCDAYHMTDPRSDGLGVSSCIAKSLEDAGVAPEEVNYINAHATSTLAGDLAEVRAIKQVFKNLSETKINSTKSMIGHCLGAAGGLEAIATIKSITNGWVHPTINQFNSEPEVDFDTVANEKKQHEVNVAISNSFGFGGHNSVVVFAPFKP

SEQ ID NO: 4038 - protein, 467 aa, Euonymus alatus
MQSLQSTSLRASPLNPFQKKSSCDRSNAKIPKRVSFIKASSASVSAPKREKDPKERVVITGMGLVSVFGNEVDKYYDRLLTGESGIGLIDRFDASKFPTRFGGQIRGFNSEGYIDGKNDRRLDDSLRYCIVAGKKALEDADLGGDDLSKIDKERAGVLVGTGMGGLSVFSDGVKALIEKGHRKITPFFIPYAITNMGSALLAIELGFMGPNYSISTACATSNYCFYAAANHIRRGEADLMIAGGTEAAIIPIGLGGFVACRALSQRNDDPQTASRPWDKDRDGFVMGEGAGVLVMESLEHAMKRGAPIIAEYLGGAVNCDAYHMTDPRADGLGVSSCIERSLEDAGVSPEEVNYINAHATSTLAGDLAEINAIKKVFKNTSGIKINATKSMIGHCLGAAGGLEAIATVKAITTGWLHPSINQFNPEPSVDFDTVPNKKQQHEVNVAISNSFGFGGHNSVVAFSAFKP

SEQ ID NO: 4039 - protein, 466 aa, Panax ginseng
MQALQPSHLRPSPLDPLRKNSGAAISNAKPPRKISFITASSTNSAPKREKDPKKRVVITGMGLVSVFGNDVDAYYDKLLSGESGIGPIDRFDASKFPTRFGGQIRGFNSEGYIDGKNDRRLDDCLRYCIVAGKKALENADLGGDKRTKIDKERAGVLVGTGMGGLTVFSDGVQALIERGHRKITPFFIPYAITNMGSALLAIDLGFMGPNYSISTACATSNYCFYAAANHIRRGEADLMIAGGTEAAIIPIGLGGFVACRALSQRNDDPKTASRPWDKDRDGFVMGEGAGVLVMESLEHAMKRGAPIIAEYLGGAVNCDAYHMTDPRSDGLGVSSCIQSSLQDAGVSLEEVNYINAHATSTIVGDLAEVNAVKKVFKNTSGIKMNATKSMIGHCLGAAGGLEAIATVKAITTGWLHPTINQYNPEPSVEFDTVANQKQQHEVNVGISNSFGFGGHNSVVAFSAFKA

SEQ ID NO: 4040 - protein, 472 aa, Medicago truncatula
MQSVQIQQQLPSTLRPSPLEPLRRKSSNAATATAKTKRVTRISAAVTTTTAPQREKDPKKRVVITGMGLASVFGNDVDAYYDKLLAGESGITSIDRFDASKFPTRFAGQIRDFSSEGYIDGKNDRRLDDCLRYCIVAGKKALEHANLGAANLSKIDKERAGVLVGSGMGGLTVFSEGVKNLIEKGYRKITPFFIPYAITNMGSALLGIDLGFMGPNYSISTACATSNYCFYAAANHIRRGEADLMIAGGTEAAIIPIGLGGFVACRALSQRNDDPKTASRPWDKARDGFVMGEGSGVLVLESLEHAMKRGAPIIAEYLGGAVNCDAYHMTDPRSDGLGVSTCIQSSLEDAGVSPEEVNYINAHATSTLAGDLAEINAIKKVFKDTSGIKINATKSMIGHCLGAAGGLEAIATVKAITTGWLHPSINQFNPEPAVDFDTVANVKQQHEINVGISNSFGFGGHNSVVAFSAFRP

SEQ ID NO: 4041 - protein, 462 aa, Helianthus annuus
MQAQALLQSPHFRVSPLDPLRTRPKPTNFKPRTTVIASATAPKREKDPKKRVVITGMGLVSVFGNDVDTYYEKLLAGESGIGLIDRFDASKFPTRFGGQIRGFKSDGYIDGKNDRRLDDCLRYCIVAGKKALEDADLGGDKLSKIDKERAGVLVGTGMGGLTVFSDGVQNLIEKGYRKITPFFIPYAITNMGSALLAIDVGFMGPNYSISTACATSNYCFYAAANHIRRGEADMMIAGGTEAAIIPIGLGGFVACRALSQRNDDPQTASRPWDKDRDGFVMGEGAGVLVMESLEHAMKRGAPIIAEYLGGAVNCDAYHMTDPRSDGLGVSSCIQSSLEDAGVSPEEVNYINAHATSTLVGDLAEVNAVKKVFKSTDGIKMNSTKSMIGHCLGAAGGLEAIATVKAIQTGWLHPTINQFNPEPAVEFDTVANQKQQHEVNVAISNSFGFGGHNSVVAFSAFKP

SEQ ID NO: 4042 - protein, 467 aa, Tripterygium wilfordii
MQSLQSTSLRASPLNPFQKKSGGDRSNAKIPKRVSFIKASSAPVSAPKREKDPKKRVVITGMGLVSVFGNEVDKYYDKLLAGESGIGLIDRFDASKFPTRFGGQIRGFSSEGYIDGKNDRRLDDCLRYCIVAGKKALEDADLGGDDLSKIDKERAGVLVGTGMGGLTVFSDGVQALIEKGPRKITPFFIPYAITNMGSALLAIELGLMGPNYSISTACATSNYCFYAAANHIRRGEADLMIAGGTEAAIIPIGLGGFVACRALSQRNDDPQTASRPWDKDRDGFVMGEGAGVLIMESLEHAMKRGAPIIAEYLGGAVNCDAYHMTDPRADGLGVSSCIERSLEDAGVSPEEVNYINAHATSTLAGDLAEINAVKKVFKNTSGIKINATKSMIGHCLGASGGLEAIATVKAITTGWLHPSINQFNPEPAVDFDTVANQKQQHEVNVAISNSFGFGGHNSVVAFSAFKP

SEQ ID NO: 4043 - protein, 460 aa, Elaeis guineensis
GRSTFLRPSEPRPLQTIPASPSTGTGRTRPLSPSFRSSRLVARPTSSPGPRAVLLRPIRPRGPAVRASVAAAAAAAPRRETDPRKRVVITGMGLVSVFGNDVDVYYQKLLEGESGIGPIDRFDASKLPTRFAGQIRGFSSEGYIDGKNGRRLDDCLRYCLVSGKRALESAGLGVGSKALGKVDKARAGVLVGTGMGGVTVLCDGIWSLTESNYKKVTPFSIPYAITNMGSALLAMDIGFMGANYSISTACATSNYCFYAAANHIRRGEADVMIAGGTEAPIIPMGVGGFVACRALSQRNDDPTTASRPWDKDRDGFVMGEGAGVLVMESLEHAMKRDAPIIAEYLGGAVNCDAYHMTCPRADGLGVSSCIQKSLEHAGVAPEEVNYINAHATSTPAGDLAEVNAIKQVFKNPSDVKINATKSMIGHCLGAAGGLEAIATVKAIATGWLHPTINQFSGACS

SEQ ID NO: 4044 - protein, 468 aa, Amaranthus tuberculatus
MQALLSPNLRPSPLDPFHKKSQFPKCKTPNRVSFFTPRASVSPSQVAPKRETDPKKRVVITGMGLVSVFGNDPDVFYEKLLDGVSGIAPIDRFDASKFPTRFAGQIRDFSSEGYIDGKNDRRLDDCLRYCIVAGKKALESADLGSDNLSKIDKVRAGVLVGTGMGGLTVFSDGVQALIEKGHRKITPFFIPYAITNMASALLAIDLGLMGPNYSISTACATSNYCFYAAANHIRRGEADVMVAGGTEAAILPIGLGGFVACRALSQRNDDPQTASRPWDKERDGFVMGEGAGVLVMESLEHAMKRNAPIIAEYLGGAVNCDAYHMTDPRSDGLGVSSCIERSLEDAGVSPEEVNYINAHATSTIVGDLAEVNAVKKVFKNTSEIKMNATKSMIGHCLGAAGGLEAIATVKACTTGWLHPTINQFNPEPSVEFNTVPNKKQQHEVNVAISNSFGFGGHNSVVVFSAFKP

SEQ ID NO: 4045 - protein, 467 aa, Echinacea purpurea
MQAQALLQSTPLRVSPLDPIHKPTNAKSSSLSTRRRAVISAVAAAAPKREKDPKKRVVITGMGLVSVFGNDVDTYYEKLLAGQSGIGLIDRFDASKFPTRFGGQIRGFKADGYIDGKNDRRLDDCLRYCIVAGKKALEDADLGGDKLSKIDKERAGVLVGTGMGGLTVFSDGVQNLIEKGYRKITPFFIPYAITNMGSALLAIDLGFMGPNYSISTACATSNYCFYAAANHIRRGEADMMIAGGTEAAIIPIGLGGFVACRALSQRNDDPQTASRPWDKDRDGFVMGEGAGVLVMESLEHAMKRDAPIIAEYLGGAVNCDAYHMTDPRSDGLGVSSCIQSSLEDAGVSPEEVNYINAHATSTLVGDLAEVNAVKKVFKSTAGIKMNATKSMIGHCLGASGGLEAIATVKAIQTGWLHPTINQFNPEPAVEFDTVANQKQQHEINVAISNSFGFGGHNSVVAFSAFKP

SEQ ID NO: 4046 - protein, 469 aa, Nicotiana tabacum
MQSIQSPSFRPSPLDPLKKTVPQLTNVRPLSHAKRVPFISASATTVSAPKREKDPKKRVVITGMGLVSVFGNDVDTYYDRLLAGESGISLIDRFDASKFPTRFGGQIRGFTSDGYIDGKNDRRLDDCLRYAIVAGKKALENADLGGDRLGKVDKERAGILVGTGMGGLTVFSDGVQNLIEKGHRKITPFFIPYAITNMGSALLGIDLGFMGPNYSISTACATSNYCFYAAANHIRRGEADLMLAGGTEAAIIPIGLGGFVACRALSQRNDDPQTASRPWDKERDGFVMGEGSGVLVMESLEHAMKRGAPIIAEYLGGAVNCDAHHMTDPRADGLGVSSCIQSSLEDAGVSPEEVNYINAHATSTIVGDIAEVNAIKKVFKNTSGIKMNATKSMIGHCLGAAGGMEAIATVKAITTGWVHPSINQFNPEPSVEFDTVPNKKQQHEVNVGISNSFGFGGHNSVVAFPAFKP

SEQ ID NO: 4047 - protein, 271 aa, Platanus occidentalis
ANARITRKQPSKLISASASTTASAPKRETDPKKRVVITGMGLVSVFGNDVDAYYDRLLAGESGISLIDRFDASKFPTRFGGQIRGFTSQGYIDGKNDRRLDDCLRYCLVAGKKSLEDAGLGGDNLSKIDKERAGVLVGTGMGGLTVFAEGVKNLLDKGYRKITPFFIPYAITNMGSALLAIDLGFMGPNYSISTACATSNYCFCAAANHIRRGEADLMIAGGTEAAIIPIGWGVLLLVELYHREMMIHKLLQGRGTKIEMALLWEKVPGCW

SEQ ID NO: 4048 - protein, 466 aa, Panax ginseng
MHALQSSPLRASPLDPLRKNSATTISNVQPPKRVSFITASSTNSAPKREKDPKKRVVITGMGLVSVFGNVVDAYYDKLLSGDSGIGPIDRFDASKFPTRFAGQIRGFSSEGYIDGKNDRRLDDCLRYCIVAGKKALEDADLGGDKRSKIDKERAGVIVGTGMGGLTVFSDGVQALIERGHRKITPFFIPYAITNMGSALLAIDLGFMGPNYSISTACATSNYCFYAAANHIRRGEADLMIAGGTEAAIIPIGLGGFVACRALSQRNDDPKTASRPWDKDRDGFVMGEGAGVLVMESLEHAMKRGAPIIAEYLGGAVNCDAYHMTDPRSDGLGVSSCIQSSLQDAGVSPEEVNYINAHATSTIVGDLAEVNAVKKVFKNISGIKMNATKSMIGHCLGAAGGLEAIATVKAITTGWLHPTINQFNSESSVEFDTVANQKQQHEVNVGISNSFGFGGHNSVVAFSAFKP

SEQ ID NO: 4049 - protein, 466 aa, Panax ginseng
MHALQSSPLRASPLDPLRKNSATTISNVQPPKRVSFITASSTNSAPKREKDPKKRVVITGMGLVSVFGNEVDAYYDKLLSGESGIGPIDRFDASKFPTRFGGQIRGFSSEGYIDGKNDRRLDDCLRYCIVAGKKALEDADLGGDKRSKIDKERAGVIVGTGMGGLTVFSDGVQALIERGHRKITPFFIPYAITNMGSALLAIDIGFMGPNYSISTACATSNYCFYAAANHIRRGEADLMIAGGTEAAIIPIGLGGFVACRALSQRNDDPKTASRPWDKDRDGFVMGEGAGVLVMESLEHAMKRGAPIIAEYLGGAINCDAYHMTDPRSDGLGVSSCIQSSLQDAGVSPEEVNYINAHATSTIVGDLAEVNAVKKVFKNTSGIKMNATKSMIGHCLGAAGGLEAIATVKAITTGWLHPTINQFNSESSVEFDTVANQKQQHEVNVGISNSFGFGGHNSVVAFSAFKP

SEQ ID NO: 4050 - protein, 443 aa, Gossypium hirsutum
TLPPRPAKKFSSITASSPTVSAPKREKDPKKRVVITGMGLVSVFGNDVDAYYEKLLAGESGIGIIDRFDASKFPTRFAGQIRGFTSESYIDGKNDRRLDDCLRYCIVAGKKALEDADLGADNLSKIDKERTGVLVGTGMGGLTVFSDGVQNLIEKGYRKITPFFIPYSITNMSSALLAIELGFMGPNYSISTACATSNYCFYAAANHIRRGEAELMIAGGTEAAIIPIGLGGFVACRALSQRNDDPRTASRPWDKDRDGFVMGEGAGVLVMESLEHAMKRGAPIIAEYLGGAVNCDAHHMTDPRADGFGVSSCIERSLEDAGVSPEEVNYINAHATSTLAGDLAEINAIKKVFKNTSDIKINATKSMIGHCLGASGGLEAIATVKAITTGWLHPSINQFNPEPSVEFDTVANQKKQHEVNVAISNSFGFGGHNSVVAFSAFEP

SEQ ID NO: 4051 - protein, 467 aa, Echinacea purpurea
MQAQALLQSIPLRVSPLDPIHKPTNAKSSSLSTRRRAVISAVAAAAPKREKDPKKRVVITGMGLVSVFGNDVDTYYEKLLAGQSGIGLIDRFDASKFPTRFGGQIRGFKADGYIDGKNDRRLDDCLRYCIVAGKKALEDADLGGDKLSKIDKERAGVLVGTGMGGLTVFSDGVQNLIEKGYRKITPFFIPYAITNMGSALLAIDLGFMGPNYSISTACATSNYCFYAAANHIRRGEADMMIAGGTEAAIIPIGLGGFVACRALSQRNDDPQTASRPWDKDRDGFVMGEGAGVLVMESLEHAMKRDAPIIAEYLGGAVNCDAYHMTDPRSDGLGVSSCIQSSLEDAGVSPEEVNYINAHATSTLVGDLAEVNAVKKVFKSTAGIKMNATKSMIGHCLGASGGLEAIATVKAIQTGWLHPTINQFNPEPAVEFDTVANQKQQHEINVAISNSFGFGGHNSVVAFSAFKP

SEQ ID NO: 4052 - protein, 467 aa, Lupinus angustifolius
MQTLNSPTLHFSPLDPFLTKSPNATAKPKRVSFITASATVTPKVSAPQREKDPKKRVVVTGMGLASVFGNNVDQYYEKLLAGESGVSLIDRFDASKFPTRFAGQIRGFSSEGYIDGKNDRRLDDCLRYCIVAGKKALESADLGADKLNTIDKQRAGVLVGSGMGGLTVFSDGVKALIEKGHRKITPFFIPYAITNMGSALLGIDLGFMGPNYSISTACATSNYCFYAAANHIRRGEADLMIAGGTEAAIIPIGLGGFVACRALSQRNDDPKTASRPWDKDRDGFVMGEGSGVLVLESLEHAMKRGAPILAEYLGGAVNCDAYHMTDPRADGLGVSSCIKSTLEDAGVSPEEVNYINAHATSTLAGDLAEINAIKKVFKDTSGIKINATKSLIGHSLGASGGLEAIATVKAITTGWLHPSINQFNPEPAVDFDTVPNVKKQHEVNVAISNSFGFGGHNSVVAFSAFKP

SEQ ID NO: 4053 - protein, 470 aa, Zostera marina
MQSLQISTSQPQTHHIFRRNAPPPPSRISPTRRVRFNPIRATATVSAPKRETDPKKRIVITGMGLVSVFGNEVDRFYERLLEGESGIKPIDRFDASKFPTKFAGQIKGFVSEGYIDGKNDRRLDDCLRYCIVSGKKALENAGIGVGTAEMEKINKERAGVLVGTGMGGLTVFSDGVQNLIEKGHRKITPFFIPYAITNMGSALLAMDIGFMGANYSISTACATSNYCFYSAANHIRRGDVDIMLAGGTEAAIIPIGLGGFIACRALSQRNDDPETASRPWDKGRDGFVMGEGAGVLVMESLEHAMKRGATIIAEYLGGAVNCDAHHMTDPRADGLGVSTCIKKSLEDARVSPEEVNYINAHATSTLAGDLAEVNAIKQVFKNTSEIKINGTKSMIGHCLGASGGLEAIATVKAITTGWLHPTINQFNPEESVEFDTVANKKKQHEVNVAISNSFGFGGHNSVVVFAPFKP

SEQ ID NO: 4054 - protein, 477 aa, Papaver somniferum
MQTLQSAALRVSPLESLRKQSPLLNNNNNVSNKNRSKLKRNPSLVISASSKTSVNAPKREKDPKKRVVITGMGLVSVFGNDVDTYYERLLAGESGISLIDRFDASKFPTRFGGQIRGFDSQGYIDGKNDRRLDDCLRYCLVAGKKALEDAGLGGENLSKLDKERGGVLVGTGMGGLTVFSDGVQALIERGHRKITPFFIPYAITNMGSALLGIELGLMGPNYSISTACATSNYCFYAAANHIRRGEADLMIAGGTEAAIIPIGLGGFVACRALSQRNDDPQTASRPWDKERDGFVMGEGAGVLVMESLEHAMKRGAPILAEYLGGAVNCDAHHMTDPRADGLGVSTCIEKSLEDAGVSPEEVNYINAHATSTLAGDLAEVNAIKKVFKNTSSIKINATKSMIGHCLGAAGGLEAIATVKAINTGWLHPSINQFNPEPAVDFDTVANVKKQHEVNVAISNSFGFGGHNSVVVFSEFKP

SEQ ID NO: 4055 - protein, 79 aa, Papaver somniferum
MQTLQSAALRVSPLESLRKQSPLLNNNSNVSNKNRSKLKRNPSLVISASSKTSVNAPKREKDTQKESCYYRNGFSFCLW

SEQ ID NO: 4056 - protein, 467 aa, Ambrosia trifida
MQAQALLQSTPLRVSPLDPIHKPINLKPPSLSTTRRRAVISAVAAAPKREKDPKKRVVITGMGLVSVFGNDVDTYYEKLLAGESGIGLIDRFDASKFPTRFGGQIRGFKADGYIDGKNDRRLDDCLRYCIVAGKKALEDANLAADNRSKIDKERAGVLVGTGMGGLTVFSDGVQSLIEKGYRKITPFFIPYAITNMASALLAIDLGFMGPNYSISTACATSNYCFHAAANHIRRGEADLMIAGGTEAAIIPIGLGGFVACRALSQRNDDPQTASRPWDQGRDGFVMGEGAGVLVMESLEHAMKRDAPILAEYLGGAINCDAYHMTDPRSDGLGVSSCIQSSLEDAGVSAEEVNYINAHATSTLVGDLAEVNAIKKVFKDTAGIKMNATKSMIGHCLGAAGGLEAIATVKAIQTGWLHPSINQFNPEPAVEFDTVANVKQQHEINVAISNSFGFGGHNSVVAFSAFKP

SEQ ID NO: 4057 - protein, 467 aa, Flaveria ramosissima
MQAQALLQSTHLRISPLDPLRHNHRHQFPTNVKPTRRPTVVMSATAPKREKDPKKRVVITGMGLVSVFGNDVDTYYEKLLAGESGIGLIDRFDASKFPTRFGGQIRGFKSDGYIDGKNDRRLDDCLRYCIVAGKKALEDADLGGDKRSKIDKERAGVLVGTGMGGLTVFSDGVQNLIEKGYRKITPFFIPYAITNMGSALLAIDLGFMGPNYSISTACATSNYCFYAAANHIRRGEADMMIAGGTEAAIIPIGLGGFVACRALSQRNDDPQTASRPWDKDRDGFVMGEGAGVLVMESLEHAMKRDAPIIAEYLGGAVNCDAYHMTDPRSDGLGVSSCIQSSLEDAGVSPEEVNYINAHATSTLVGDLAEVNAVKKVFKSTAGIKMNATKSMIGHCLGAAGGLEAIATVKAIQTGWLHPTINQFNPEPAVEFDTVANQKQQHEINVAISNSFGFGGHNSVVAFSAFKP

SEQ ID NO: 4058 - protein, 463 aa, Panax ginseng
LQSSPLRASPLDPLRKNSATTISNVQPPKRVSFITASSTNSAPKREKDPKKRVVITGMGLVSVFGNVVDAYYDKLLSGDSGIGPIDRFDASKFPTRFAGQIRGFSSEGYIDGKNDRRLDDCLRYCIVAGKKALEDADLGGDKRSKIDKERAGVIVGTGMGGLTVFSDGVQALIERGHRKITPFFIPYAITNMGSALLAIDLGFMGPNYSISTACATSNYCFYAAANHIRRGEADLMIAGGTEAAIIPIGLGGFVACRALSQRNDDPKTASRPWDKDRDGFVMGEGAGVLVMESLEHAMKRGAPIIAEYLGGAVNCDAYHMTDPRSDGLGVSSCIQSSLQDAGVSPEEVNYINAHATSTIVGDLAEVNAVKKVFKNISGIKMNATKSMIGHCLGAAGGLEAIATVKAITTGWLHPTINQFNSESSVEFDTVANQKQQHEVNVGISNSFGFGGHNSVVAFSAFKP

SEQ ID NO: 4059 - protein, 508 aa, Valeriana officinalis
RSKSTFTLHYIVLIDLSFSHYKFTTTLLPSLRRHHPPCKHSNLHLSDLLHSTQFANNPQTSPPESMPTLPKKLPFIAASASQTTAVAPKREKDPKKRVVITGMGLVSVFGNDVDTYYNRLLEGESGISLIDRFDASKFPTRFGGQIRDFNSEGYIDGKNDRRLDDCLRYCIVAGKKALEHADLGGEKRSKVDKERAGVLVGTGMGGLTVFSDGVQALIERGYRKITPFFIPYAITNMGSALLGIDLGFMGPNYSISTACATSNYCFYAAANHIRRGEADLMVAGGTEAAIIPIGLGGFVACRALSQRNDDPKTASRPWDKDRDGFVMGEGAGVLVMESLEHAMKRGAPIIAEYLGGAVNCDAYHMTDPRSDGLGVSSCIQSSLLDAGVSPEEVNYINAHATSTIVGDLAEINAIKKVFKDTSGIKINSTKSMIGHCLGAAGGLEAIASVKAITTGWLHPTINQFNPEPSVDFDTVANKKQQHEVNVAISNSFGFGGHNSVVAFSAFKP

SEQ ID NO: 4060 - protein, 208 aa, Trigonella foenum-graecum
MQSLQIQQLPSTLRPSPLEPLRRKSSSNAAATTAAKTKRLTRISASATTAPQRQKDPKKRVVITGMGLASVFGNDVDAYYDKLLAGESGITSIDRFDASKFPTRFAGQIRDFSSEGYIDGKNDRRLDDCLRYCIVAGKKALEHANLGAANLSKIDKERAGVLVGSGMGGLTVFSEGVKNLIEKGHRKITPFLFLMLLPIWVQHCLGLI

SEQ ID NO: 4061 - protein, 441 aa, Olea europaea
MPNPRIPTPKTPFIISASSAPKRETDPKKRVVITGMGLVSVFGNDVDAYYEKLLAGESGIAAIDRFDASKFPTRFGGQIRGFKSEGYIDGKNDRRLDDSLRYCIVAGKKALENADLGREDLGKIDKVRAGVLVGTGMGGLTVFSDGVQALIEKGHRKITPFFIPYAITNMGSALLAIDLGLMGPNYSISTACATSNYCFYAAANHIRRGEADLMLAGGTEAAIIPIGLGGFVACRALSQRNDDPQTASRPWDKDRDGFVMGEGAGVLVMESLEHAMKRDAPIIAEYLGGAVNCDAYHMTDPRSDGLGVSSCIQSALEDAGVSPEEVNYINAHATSTIVGDLAEVNAVKKVFKDTSQIKMNATKSMIGHCLGAAGGLEAIATVKAITTGWLHPTINQFNPEPSVEFDTVANQKQQHEVNVAISNSFGFGGHNSVVAISAFKP

SEQ ID NO: 4062 - protein, 446 aa, Gossypium hirsutum
YVFTLPHRPTKRFTSITASSTTVSAPKREKDPKKRVVVTGMGLVSVFGNDVDVYYDKLLSGESGIGLIDRFDASKFPTRFAGQIRGFTSEGYIDGKNDRRLDDCLRYCIVAGKKALEDADLGGDKLSKIDKERTGVLVGTGMGGLTVFSDGVQNLIEKGHRKITPFFIPYAITNMGSALLAIELGFMGPNYSISTACATSNYCFYAAANHIRRGEADLMIAGGTEAAIIPIGLGGFVACRALSQRNEDPQTASRPWDKERDGFVMGEGAGVLVMESLEHAMKRGAPIIAEYLGGAVNCDAYHMTDPRADGLGVSSCIERSLEDAGVSPEEVNYINAHATSTLAGDLAEINAIKKVFKNTSEIKINATKSMIGHCLGAAGGLEAIATVKAITTGWVHPTINQFNPEPSVEFDTVANEKQQHEVNVAISNSFGFGGHNSVVAFSAFKP

SEQ ID NO: 4063 - protein, 463 aa, Triphysaria pusilla
APPPSTPLLKPPRSTCFPGHNAKLPSKRLPFTISASAPTVSAPKRETDPKKRVVITGMGLVSVFGNDVDAYYEKLLAGESGITLIDRFDASKFPTRFGGQIRGFKAEGYIDGKNDRRLDDCLRYCIVAGKKALEGADLGGDNLNKIDKIRAGVLVGTGMGGLTAFSDGVQALIEKGHRKITPFFIPYAITNMGSALLGIDLGFMGPNYSISTACATSNYCFYAAANHIRRGEADLMLAGGTEAAMIPIGLGGFVACRALSQRNDDPKTASRPWDKDRDGFVMGEGAGVLVMESLEHAMKRGAPIIAEYLGGAVNCDAYHMTDPRADGLGVSSCIHSALQDAGVSPEEVNYINAHATSTIVGDLAEVNAIKKVFKNTSEIKINATKSMIGHCLGAAGGLEAIATVKAITTGWLHPSINQFNPESSVEFDTVANKKQQHEVNVAISNSFGFGGHNSVVAFSAFKP

SEQ ID NO: 4064 - protein, 473 aa, Gossypium hirsutum
MEAIQASSLRASPLKPLLKPKFNIHFPNASRLVPRATKKFSSITASSPTVSAPKREKDPKKRVVITGMGLVSVFGNDVDAYYDKLLAGESGIGLIDRFDASKFPTRFAGQIRGFSSQGYIDGKNDRRLDDCLRYCIVAGKKALEDADLGGDKLSKIDKERAGVLVGTGMGGLTVFSDGVQNLIEKGYRKITPFFIPYAITNMSSALLAIDLGLMGPNYSISTACATSNYCFYAAANHIRRGEAEMMIAGGTEAAIIPIGLGGFVACRALSQRNDDPQTASRPWDKDRDGFVMGEGAGVLVMESLEHAMKRGAPIIAEYLGGAVNCDAYHMTDPRSDGLGVSSCIERSLEDAGVSPEEVNYINAHATSTLAGDLAEINAIKKVFKNASGIKINATKSMIGHCLGAAGGLEAIASVKAITTGWLHPSINQFNPEPSVEFDTVANKKQQHEVNVAISNSFGFGGHNSVVAFSAFKP

SEQ ID NO: 4065 - protein, 471 aa, Prunus persica
MQALQSSSLRPAPLDPIRKRTPHFPSVTPRPTSSRRVSFISASSAPAVSAPKREKDPKKRVVITGMGLVSVFGNDVNAYYDKLLAGESGVGPIDRFDASKFPTRFGGQIHGFSSEGYIDGKNDRRLDDCLRYSIVAGKKALEDADLGGDKRSKLDKSRAGVLVGSGMGGLTVFSDGVHALIEKGHRKITPFFIPYAITNMGSALLGIDLGFMGPNYSISTACATSNYCFYAAANHIRRGEADLMIAGGTEAALIPVGLGGFVACRALSQRNDDPKTASRPWDKDRDGFVMGEGAGVLVMESLEHATKRGAPIIAEYLGGAINCDAYHMTDPRADGLGVSTCIERSLEDAGVSPEEVNYINAHATSTLAGDLAEINAIKKVFKNTRDIKINATKSMIGHCLGASGGLEAIATVKAITTGWLHPSINQFNPEPSVEFDTVANVKKQHEVNVAISNSFGFGGHNSVVAFSAFKP

SEQ ID NO: 4066 - protein, 469 aa, Solanum phureja
MEAMQSLSFRPSPLDPLRKNMPQFTNVRSLGAKRVPFIISASASTVSAPKREKDPKKRVVITGTGLVSVFGNDVDTYYERLLAGESGISLIDRFDASKFPTRFGGQIRGFTSEGYIDGKNDRRLDDCLRYAIVAGKKALENADLGGDRLEKIDKERAGVLVGTGMGGLTVFSDGVQNLIEKGHRKITPFFIPYAITNMGSALLGIDLGFMGPNYSISTACATSNYCFYAAANHIRRGEADLMLAGGTEAAMIPIGLGGFVACRALSQRNDDPQTASRPWDKDRDGFVMGEGAGILVMESLEHAMKRGAPIIAEYLGGAVNCDAYHMTDPRADGLGVSSCILSSLEDAGVSPEEVNYINAHATSTIVGDLAEINAVKKVFKTTSGIKMNATKSMIGHCLGAAGGLEAIATIKAITTGWVHPSINQFNPEPSVEFDTVPNKKQQHEVNVAISNSFGFGGHNSVVAFSAFKP

SEQ ID NO: 4067 - protein, 469 aa, Chrysanthemum coronarium
MQTQSQALLQQPHFRVTTSPDPFRRQQPITFKPTTLRRKPITAAISSAPQRETDPKKRVVITGMGLVSVFGNDVDTYYEKLLAGESGIGLIDRFDASKFPTRFGGQIRGFKSDGYIDGKNDRRLDDCLRYCIVAGKKALESAGLGADQRDQIDKERAGVLVGTGMGGLTVFSDGVQNLIEKGYRKITPFFIPYAITNMGSALLAIDLGFMGPNYSISTACATSNHCFYAAANHIRRGEADLMIAGGTEAAIIPIGLGGFVACRALSQRNDDPQTASRPWDKNRDGFVMGEGAGVLVMESLEHAMKRGAPIIAEYLGGAVNCDAHHMTDPRADGLGVSSCIKNGLEDAGVSAEEVNYINAHATSTPVGDLAEVNAIKKVFKSTEGIKMNATKSMIGHCLGAAGGLEAIATLKAIQTGWLHPTINQIDPEPAVEFNTVANQKQQHEVNVAISNSFGFGGHNSVVVFSPFKP

SEQ ID NO: 4068 - protein, 201 aa, Castanea mollissima
MQSLQSSPPCLRPSPLTPLLQNQSKSKSHFHFRPSRSSFRRRSSSGASVIVNVSAPKREHDPKKRVVITGMGLVSVFGNEVDEYYNRLLSGESGIGPIDRFDASKFPTRFAGQIRGFNSEGYIDGKNDRRLDDCLRYCIVAGKKALVDADLGGDKLSKIDKERAGVLVGTGMGGLTVFSDGVQALIEKGHRKITPFSFPML

SEQ ID NO: 4069 - protein, 469 aa, Ricinus communis
MQALQSPSLRPSPLTPLHKNTHNAAKRPTKKVSFITASSTNNNTTISAPKREKDPRKRVVITGTGLVSVFGNDVDTYYDKLLAGESGIGLIDRFDASKFPTRFGGQIRGFNSQGYIDGKNDRRLDDCLRYCIVAGKKALEHADLGGDKLSKIDKERAGVLVGTGMGGLTVFSDGVQALIEKGHRKITPFFIPYAITNMGSALLAIELGLMGPNYSISTACATSNYCFYAAANHIRRGEAELMIAGGTEAAIIPIGLGGFVACRALSQRNDDPQTASRPWDKDRDGFVMGEGAGVLVMESLEHAMKRGAPIIAEYLGGAVNCDAYHMTDPRADGLGVSSCIERSLEDAGVSPEEVNYINAHATSTLAGDLAEINAIKKVFKNTSDIKINATKSMIGHCLGAAGGLEAIACVKAITTGWLHPTINQFNPEPSVEFDTVANKKQQHEVNVAISNSFGFGGHNSVVAFSAFKP

SEQ ID NO: 4070 - protein, 454 aa, Flaveria ramosissima
TSPIDPLRRHNHRQFPTNVKPPRRPTVVMSATAPKREKDPKKRVVITGMGLVSVFGNDVDTYYEKLLAGESGIGLIDRFDASKFPTRFGGQIRGFKSDGYIDGKNDRRLDDCLRYCIVAGKKALEDADLGGDKRSKIDKERAGVLVGTGMGGLTVFSDGVQNLIEKGYRKITPFFIPYAITNMGSALLAIDLGFMGPNYSISTACATSNYCFYAAANHIRRGEADMMIAGGTEAAIIPIGLGGFVACRALSQRNDDPQTASRPWDKDRDGFVMGEGAGVLVMESLEHAMKRDAPIIAEYLGGAVNCDAYHMTDPRSDGLGVSSCIQSSLEDAGVSPEEVNYINAHATSTLVGDLAEVNAVKKVFKSTAGIKMNATKSMIGHCLGAAGGLEAIATVKAIQTGWLHPTINQFNPEPAVEFDTVANQKQQHEINVAISNSFGFGGHNSVVAFSAFKP

SEQ ID NO: 4071 - protein, 473 aa, Gossypium raimondii
MQALQAPTLRASPLNPLKKPNPNPHFRYVFTLPHRPTKRFTSITASSTTVSAPKREKDPKKRVVVTGMGLVSVFGNDVDVYYDKLLSGESGIGLIDRFDASKFPTRFAGQIRGFTSEGYIDGKNDRRLDDCLRYCIVAGKKALEDADLGGDKLSKIDKERTGVLVGTGMGGLTVFSDGVQNLIEKGHRKITPFFIPYAITNMGSALLAIELGFMGPNYSISTACATSNYCFYAAANHIRRGEADLMIAGGTEAAIIPIGLGGFVACRALSQRNEDPQTASRPWDKERDGFVMGEGAGVLVMESLEHAMKRGAPIIAEYLGGAVNCDAYHMTDPRADGLGVSSCIERSLEDAGVSPEEVNYINAHATSTLAGDLAEINAIKKVFKNTSEIKINATKSMIGHCLGAAGGLEAIATVKAITTGWVHPTINQFNPEPSVEFDTVANEKQQHEVNVAISNSFGFGGHNSVVAFSAFKP

SEQ ID NO: 4072 - protein, 463 aa, Euphorbia esula
HLPLASPLNPLQEKTRNATKTPPKRVSFITASSSTINPATSPPKREKDPKKRVVITGMGLVSVFGNDVDVYYDTLLSGKSGIGPIDRFDASKFPTRFGGQIRGFDSEGYIDGKNDRRLDDCLRYCIVAGKNAFENAGLGGDTLSKIDKERAGVLVGTGMGGLTVFSDGVQALIERGHRKITPFFIPYAITNMGSALLGIELGLMGPNYSISTACATSNYCFYAAANHIRRGEAEMMIAGGTEAAIIPIGLGGFVACRALSQRNDDPQTASRPWDKDRDGFVMGEGAGVLVMESLEHAMKRGAPILAEYLGGAVNCDAYHMTDPRADGLGVSSCIERSLEDAGVSPEEVNYINAHATSTLAGDLAEINAIKKVFKNTSEIKINATKSMIGHCLGAAGGLEAIACVKAINTGWLHPTINQFNPEPSVEFDTVANTKKQHEVNVAISNSFGFGGHNSVVVFSSFKP

SEQ ID NO: 4073 - protein, 496 aa, Pinus taeda
MASSALAGMTASLSIAGFEPSRGTCSRSISRFDGLRAAEAELSDVSLLLGVRPNRLSRAGPKTGVRAMLLPSVNALNREKDPKKRVVITGMGLVSVFGNNVDTYYERLLEGQSGIAPIDRFDASKFPTRFGGQIRGFSSEGYIDPKNDRRLDDCIRYCLVSGQKALEDADLGKDKINKIDKERAGVLVGSGMGGLKVFSDGVQALIDKGYRKITPFFIPYAITNMGSALLGIEVGFMGPNYSISTACATSNYCFYAAANHIRRGEADIMLAGGTEAAIIPIGLGGFVACRALSQRNDDPQSASRPWDKDRDGFVMGEGAGVLVMESLEHAKKRGAPILAEYLGGAINCDAYHMTDPRADGLGVSSCIERSLIDAGVSPEEVNYINAHATSTLAGDLAEVNAIKSVFKNTSEIKINATKSMIGHCLGAAGGLEAIATVKAINTGWLHPSINQFNPEPAVEFDTVSNVKKQHEVNVAISNSFGFGGHNSVVVFAAYRP

SEQ ID NO: 4074 - protein, 468 aa, Manihot esculenta
MQSLQSPSLRPPLLNPFHKNSHNAKKTPTRKLSFISASSTNNSTISAPKREKDPKKRVVITGMGLVSVFGNDVDVYYDKLLDGESGIGLIDRFDASKFPTRFGGQIRGFTSEGYIDGKNDRRLDDCLRYCIVAGKKSLEHADLGGDKLSKIDKERAGVLVGTGMGGLTVFSDGVQALIERGYRKITPFFIPYAITNMGSALLAMDIGFMGPNYSISTACATSNYCFYAAANHIRRGEADLMIAGGTEAAIIPIGLGGFVACRALSQRNDDPQTASRPWDKGRDGFVMGEGAGVLVMESLEHAMKRGAPIIAEYLGGAVNCDAYHMTDPRADGLGVSSCIERSLEDAGVSPEEVNYINAHATSTLAGDLAEINAIKKVFTNTSEIKINATKSMIGHCLGAAGGLEAIACVKAITTGWLHPSINQFDPEPSVEFDTVANKKQQHEVNVAISNSFGFGGHNSVVAFSAFKP

SEQ ID NO: 4075 - protein, 468 aa, Citrus sinensis
MQSLQSSSLHASPLNPLRSKSNFNLPNNARPTARRVSFITASSTKSAPKREKDPKKRVVITGMGLVSVFGNDVDAYYNKLLDGESGITMIDRFDASKFPTRFGGQIRGFSAEGYIDGKNDRRLDDCLRYCIVAGKKALEDADLGADISKKIDKERAGVLVGTGMGGLTVFSDGVQALIEKGHRKITPFFIPYAITNMGSALLAIDLGFMGPNYSISTACATSNYCFYAAANHIRRGEADLMLAGGTEAAIIPIGLGGFVACRALSQRNDDPQTASRPWDKDRDGFVMGEGAGVLVMESLEHAMKRGAPIIAEYLGGAVNCDAYHMTDPRADGLGVSSCIESSLEDAGVSPEEVNYINAHATSTLAGDLAEINAIKKVFKNTTGIKINATKSMIGHCLGAAGGLEAIATVKAITTGWLHPSINQFNPEPSVEFDTVANKKQQHEVNVAISNSFGFGGHNSVVAFSAFKP

SEQ ID NO: 4076 - protein, 467 aa, Helianthus annuus
MQAQALLQSTPLRVSPLDPIHKPINLKPPSLSSTRRRAVISAVSAAPKREKDPKKRVVITGMGLVSVFGNDVDTYYEKLLAGESGIGLIDRFDASKFPTRFGGQIRGFKADGYIDGKNDRRLDDCLRYCIVAGKKALEHADLAADNRSKIDKERAGVLVGTGMGGLTVFSDGVKSLIEKGYRKITPFFIPYAITNMASALLAIDLGFMGPNYSISTACATSNYCFHAAANHIRRGEADMMIAGGTEAAIIPIGLGGFVACRALSQRNDDPQTASRPWDQDRDGFVMGEGAGVLVMESLEHAMKRDAPILAEYLGGAINCDAYHMTDPRSDGLGVSSCIQSCLDDAGVSAEEVNYINAHATSTLVGDLAEVNAVKKVFKNTAGIKMNATKSMIGHCLGAAGGLEAIATVKAIQTGWLHPSINQFNPEPAVEFDTVANVKQQHEINVGISNSFGFGGHNSVVAFSAFKP

SEQ ID NO: 4077 - protein, 471 aa, Triphysaria pusilla
MQSLHYAALRPSPIDPLKTPRSTAFPGCNAKPPSKRLPFTISASTPTISAPKRETDPKKRVVITGMGLVSVFGNDVDAYYEKLLSGESGITPIDRFDASKFPTRFGGQIRGFKSEGYIDGKNDRRLDDCLRYCIVAGKKALEGADLGGDNLNKIDKIRSGVLVGTGMGGLTAFSDGVQNLIEKGHRKISPFFIPYAITNMGSALLGIDLGFMGPNYSISTACATSNYCFYAAANHIRRGEADLMLAGGTEAAIIPIGLGGFVACRALSQRNDDPKTASRPWDKDRDGFVMGEGAGVLVMESLEHAMKRGAPIIAEYLGGAVNCDAYHMTDPRADGLGVSSCIHSALEDAGVSPEEVNYINAHATSTIVGDLAEVNAIKKVFKNTSEIKINATKSMIGHCLGAAGGLEAIATVKAITTGWLHPSINQFNPESSVEFDTVANKKQQHEVNVAISNSFGFGGHNSVVAFSAFKP

SEQ ID NO: 4078 - protein, 392 aa, Fagus grandifolia
MQLQALQSPTLRPSPLTSLRNKHSHSHSHFHFQTSRRRASVIVNVATAPKRENDPKKRVVITGMGLVSVFGNEVDEYYNRLLSGESGIGPIDRFDASKFPTRFAGQIHGFSSEGYIDGKNDRRLDDCLRYCIVAGKKALVDADLGGDKLSKIDKERAGVLVGTGMGGLTVFSDGVQALIEKGHRKITPFFIPYAITNMGSALLGIDLGFMGPNYSISTACATSNYCFYAAANHIRRGEADLMIAGGTEAAVIPIGLGGFVACRALSQRNDDPKTASRPWDRDRDGFVMGEGAGVLIMESLEHAMKRGAPIVAEYLGGAVNCDAHHMTDPRADGLGVSSCIQSSLEDAGVSPEEVNYINAHATSTLAGDLAEINAIKKVSRTLQRSKLMQLSQ

SEQ ID NO: 4079 - protein, 473 aa, Catharanthus roseus
SLQSPPLRPSPLDPLRKPTSHFLSINTRPPTPLSKKLPFISASATTNSTVSAPKREKDPKKRVVITGMGLVSVFGNDVDAYYEKLLAGESGITPIDRFDASKFPTRFGGQIRGFKSEGYIDGKNDRRLDDCLRYCIVAGKKALENADLGGDRIGTIDKERAGVLVGTGMGGLTVFSDGVQALIEKGYRKITPFFIPYAITNMGSALLAIDLGFMGPNYSISTACATSNYCFYAAANHIRRGEADMMIAGGTEAAIIPIGLGGFVACRALSQRNDDPQTASRPWDKDRDGFVMGEGAGVLVMESLEHAMKRGAPIIAEYLGGAVNCDAYHMTDPRADGLGVSSCIQSSLEDAGVSPEEVNYINAHATSTIVGDLAEVNAIKKVFKNTSGIKMNATKSMIGHCLGAAGGLEAIATVKAITTGWLHPTINQFNPEPSVEFDTVANKKQQHEINVGISNSFGFGGHNSVVAFSAFKA

SEQ ID NO: 4080 - protein, 469 aa, Cichorium intybus
MQAQALLQSTPLRVSPLDPLQKHSLLTNVKSTSFATRRRAVISAVAAAPKREKDPKKRVVITGMGLVSVFGNDVDTYYEKLLAGESGIGLIDRFDASKFPTRFGGQIRGFKADGYIDGKNDRRLDDCLRYCIVAGKKALEDADLGGDKRSKIDKERAGVLVGTGMGGLTVFSDGVQSLIERGYRKITPFFIPYAITNMGSALLAIDLGFMGPNYSISTACATSNYCFHAAANHIRRGEADMMIAGGTEAAIISIGLGGFVACRALSQRNDDPQTASRPWDQDRDGFVMGEGAGVLVMESLEHAMKRDAPILAEYLGGAINCDAYHMTDPRSDGLGVSSCIQSSLQDAGVSAEEVNYINAHATSTLVGDLAEVNAVKKVFKNTDGIKMNATKSMIGHCLGAAGGLEAIATVKAIQTGWLHPSINQFNPEPAVEFDTVANVKQQHEINVAISNSFGFGGHNSVVAFSAFKP

SEQ ID NO: 4081 - protein, 475 aa, Chrysanthemum coronarium
FPVLFQQTQSQALLQQPHFHVTTSPNPFRRQAITFKPTTLRRKPISAAAAISSAPQRETDPKKRVVITGMGLVSVFGNDVDTYYEKLLAGESGIGLIDRFDASKFPTRFGGQIRGFQSEGYIDGKNDRRLDDCLRYCIVAGKKALESAGLGADQRHQIDKERAGVLVGTGMGGLTVFSDGVQNLIEKGYRKITPFFIPYAITNMGSALLAIDLGFMGPNYSISTACATSNHCFYAAANHIRRGEADLMIAGGTEAAIIPIGLGGFVACRALSQRNDDPKTASRPWDKNRDGFVMGEGAGVLVMESLEHAMKRGAPIIAEYLGGAVNCDAHHMTDPRADGLGVSSCIKNGLEDAGVSAEEVNYINAHATSTPVGDLAEVNAIKKVFKSTEGIKMNATKSMIGHCLGAAGGLEAIATLKAIQTGWLHPTINQIDPEPAVEFNTVANQKQQHEINVGISNSFGFGGHNSVVVFSPFKP

SEQ ID NO: 4082 - protein, 467 aa, Cichorium intybus
MQAQALLQSTQLRASPLDPLRHHSFGINVKPLPVPRRTTIVMSASAPKRETDPKKRVVITGMGLVSVFGNDVDTYYEKLLAGESGIGLIDRFDASKFPTRFGGQIRGFKSDGYIDGKNDRRLDDCLRYCIVAGKKALEDADLGGDKRSKIDKERAGVLVGTGMGGLTVFSDGVQSLIERGYRKITPFFIPYAITNMGSALLAIDVGFMGPNYSISTACATSNYCFYAAANHIRRGEADMMIAGGTEAAIIPIGLGGFVACRALSQRNDDPQTASRPWDKDRDGFVMGEGAGVLVMESLEHAMKRDAPILAEYLGGAVNCDAYHMTDPRSDGLGVSSCIKTSLIDAGVSAEEVNYINAHATSTLVGDLAEVNAVKKVFKSTDGIKMNSTKSMIGHCLGAAGGLEAIATIKAIQTGWLHPTINQFNPEPAVEFDTVANQKQQHEINVAISNSFGFGGHNSVVAFSAFKP

SEQ ID NO: 4083 - protein, 468 aa, Artemisia annua
MQTQSQALLQQPHFRVTTSPDPFRRQPITFKPTTLRRKPITAAISSAPQRETDPKKRVVITGMGLVSVFGNDVDTYYEKLLAGESGIGLIDRFDASKFPTRFGGQIRGFKSDGYIDGKNDRRLDDCLRYCIVAGKKALESAGLGADQRDQIDKERAGVLVGTGMGGLTVFSDGVQNLIEKGYRKITPFFIPYAITNMGSALLAIDLGFMGPNYSISTACATSNHCFYAAANHIRRGEADLMIAGGTEAAIIPIGLGGFVACRALSQRNDDPKTASRPWDKNRDGFVMGEGAGVLVMESLEHAMKRGAPIIAEYLGGAVNCDAHHMTDPRADGLGVSSCIKSGLEDAGVSAEEVNYINAHATSTPVGDLAEVNAIKKVFKSTEGIKMNATKSMIGHCLGAAGGLEAIATLKAIQTGWLHPTINQIDPEPAVEFNTVANQKQQHEVNVAISNSFGFGGHNSVVVFSPFKP

SEQ ID NO: 4084 - protein, 459 aa, Brassica napus
SPPNPLLKPSNRQSHQITNARQPTRRRTFISASAAVSAPKRETDPKKRVVITGMGLVSVFGNDVDAYYEKLLSGESGISLIDRFDASKFPTRFGGQIRGFSSEGYIDGKNERRLDDCLKYCIVAGKKALESANLGGDKLNTIDKQRAGVLVGTGMGGLTVFSDGVQALIEKGHRRISPFFIPYAITNMGSALLAIDLGLMGPNYSISTACATSNYCFYAAANHIRRGEADMMIAGGTEAAIIPIGLGGFVACRALSQRNDDPKTASRPWDKQRDGFVMGEGAGVLVMESLEHAMKRGAPIVAEYLGGAVNCDAHHMTDPRADGLGVSSCIESCLEDAGVSPEEVNYINAHATSTLAGDLAEINAIKKVFKSTAGIKINATKSMIGHCLGAAGGLEAIATVKAINTGWLHPSINQFNPEPAVDFDTVANEKKPHEVNVAISNSFGFGGHNSVVAFSAFKP

SEQ ID NO: 4085 - protein, 473 aa, Gossypium hirsutum
MEALQASSLRASPLKPLQKPKLNIHFPNASRLVPRPTKKFSSITASSPTVSAPKREKDPKKRVVITGMGLVSVFGNDVDAYYDKLLAGESGIGLIDRFDASKFPTRFAGQIRGFSSQGYIDGKNDRRLDDCLRYCIVAGKKALEDADLGGDKLSKIDKERAGVLVGTGMGGLTVFSDGVQNLIEKGYRKITPFFIPYAITNMSSALLAIDLGLMGPNYSISTACATSNYCFYAAANHIRRGEAEMMIAGGTEAAIIPIGLGGFVACRALSQRNDDPQTASRPWDEDRDGFVMGEGAGVLVMESLEHAMKRGAPIIAEYLGGAVNCDAYHMTDPRSDGLGVSSCIERSLEDAGVSPEEVNYINAHATSTLAGDLAEINAIKKVFKNTSGIKINATKSMIGHCLGAAGGLEAIATVKAITTGWLHPSINQFNPEPSVEFDTVANKKQQHEVNVAISNSFGFGGHNSVVAFSAFKP

SEQ ID NO: 4086 - protein, 473 aa, Gossypium raimondii
MEALQASSLRASPLKPLQKPKLNIHFPNASRLVPRPTKKFSSITASSPTVSAPKREKDPKKRVVITGMGLVSVFGNDVDAYYDKLLAGESGIGLIDRFDASKFPTRFAGQIRGFSSQGYIDGKNDRRLDDCLRYCIVAGKKALEDADLGGDKLSKIDKERAGVLVGTGMGGLTVFSDGVQNLIEKGYRKITPFFIPYAITNMSSALLAIDLGLMGPNYSISTACATSNYCFYAAANHIRRGEAEMMIAGGTEAAIIPIGLGGFVACRALSQRNDDPQTASRPWDKDRDGFVMGEGAGVLVMESLEHAMKRGAPIIAEYLGGAVNCDAYHMTDPRSDGLGVSSCIERSLEDAGVSPEEVNYINAHATSTLAGDLAEINAIKKVFKNTSGIKINATKSMIGHCLGAAGGLEAIATVKAITTGWLHPSINQFNPEPSVEFDTVANKKQQHEVNVAISNSFGFGGHNSVVAFSAFKP

SEQ ID NO: 4087 - protein, 469 aa, Mimulus guttatus
MQALNPTTFRPSPLEPLRKPQISTGNNAKTPAKRLPFKVSASAVTAAPPKRETDPKKRVVITGMGLVSVFGNDVDAYYEKLLSGVSGITPIDRFDVSKFPTRFGGQIRGFKSEGYIDGKNDRRLDDCLRYCIVAGKKAIEDADLGGDKLNTIDKTRAGVLVGTGMGGLTVFSDGVQALIEKGHRKITPFFIPYAITNMGSALLAIDLGLMGPNYSISTACATSNYCFYAAANHIRRGEADLMVAGGTEAAIIPIGLGGFVACRALSQRNDDPQTASRPWDKERDGFVMGEGAGVLVMESLEHAMKRGAPIIAEYLGGAINCDAYHMTDPRADGLGVSSCIHAALEDAGVSPEEVNYINAHATSTIVGDLAELNAIKKVFKSPKEIKINATKSMIGHCLGAAGGLEAIATVKAITTGWLHPTINQFNPEPSVEFDTVANTKQQHEINVGISNSFGFGGHNSVVAFSAFKP

SEQ ID NO: 4088 - protein, 468 aa, Solanum phureja
MQAIQSSSLRPSPVDPFLKTIPQFTNVKPLRPKRTPFISASSTTVSAPTREKDPKKRVVITGMGLVSVFGNDVDAYYDKLLAGESGVTLIDRFDASKFPTRFGGQIRGFKADGYIDGKNDRRLDDCLRYCIVAGKKALENADLGIDRDKKIDKERAGVLVGTGMGGLTVFSDGVQALIEKGHRKITPFFIPYAITNMGSALLAIDVGFMGPNYSISTACATSNYCFYAAANHIRRGEADLMIAGGTEAAIIPIGLGGFVACRALSQRNDDPQTASRPWDKDRDGFVMGEGAGVLVMESLEHAMKRGAPIIAEYLGGAVNCDAHHMTDPRADGLGVSSCILSSLEDAGVSPEEVNYINAHATSTIVGDLAEVNAIKKVFKNTSEIKMNATKSMIGHCLGAAGGLEAIATVKAIKTGWLHPSINQFNTEPSVEFDTVPNKKQQHEINVAISNSFGFGGHNSVVVFSDFKP

SEQ ID NO: 4089 - protein, 441 aa, Echinacea purpurea
SFPTNVKPTRRPTVVMSAAAPKREKDPKKRVVITGMGLVSVFGNDVDTYYEKLLAGESGIGLIDRFDASKFPTRFGGQIRGFSSDGYIDGKNDRRLDDCLRYCIVAGKKALEDAHLGGDNRSKIDKERAGVLVGTGMGGLTVFSDGVKSLIEKGYRKITPFFIPYAITNMASALLAIDLGFMGPNYSISTACATSNYCFHAAANHIRRGEADMMVAGGTEAAIIPIGLGGFVACRALSQRNDDPQTASRPWDQDRDGFVMGEGAGVLVMESLEHAMKRDAPILAEYLGGAINCDAYHMTDPRSDGLGVSSCIQSSLVDAGVSAEEVNYINAHATSTLVGDLAEVNAIKKVFKNTAGIKMNATKSMIGHCLGAAGGLEAIATVKAIQTGWLHPSINQFNPEPAVEFDTVANVKQQHEINVAISNSFGFGGHNSVVAFSAFKP

SEQ ID NO: 4090 - protein, 468 aa, Citrus clementina
MQSLQSSSLHASPLNPLRSKSNFNLPNNARPTARRVSFITASSTKSAPKREKDPKKRVVITGMGLVSVFGNDVDAYYNKLLDGESGITMIDRFDASKFPTRFGGQIRGFSAEGYIDGKNDRRLDDCLRYSIVAGKKALEDADLGADISKKIDKERAGVLVGTGMGGLTVFSDGVQALIEKGHRKITPFFIPYAITNMGSALLAIDLGFMGPNYSISTACATSNYCFYAAANHIRRGEADLMLAGGTEAAIIPIGLGGFVACRALSQRNDDPQTASRPWDKDRDGFVMGEGAGVLVMESLEHAMKRGAPIIAEYLGGAVNCDAYHMTDPRADGLGVSSCIESSLEDAGVSPEEVNYINAHATSTLAGDLAEINAIKKVFKSTAGIKINATKSMIGHCLGAAGGLEAIATVKAITTGWLHPSINQFNPEPSVEFDTVANKKQQHEVNVAISNSFGFGGHNSVVAFSAFKP

SEQ ID NO: 4091 - protein, 470 aa, Medicago truncatula
MQSLQHQLPFTLRPSPLEPLRKKPSNAATTAARTPKRLSVVSSSVTTAAPQREKDPKKRVVITGMGGVTVHGNDVDIFYEKLLAGDSGITLIDRFDASKFPTRFAGQIRGFSSEGYIDGKNDRRQDDCLRYCNVAGKKALEDAGLGAENLDKIDKERAGVLVGSGMGGLTVFSDGVKNLIEKGHRKISPFFIPYAITNMASALLGIDLGFRGPNYSISTACATSNYCFVAAANHIRRGEADLMIAGGTEAAIIPIGLGGFVACRALSQRNDDPKTASRPWDKDRDGFVMGEGAGVLVMESLEHAMKRGAPIIAEYLGGAVNCDAYHMTDPRSDGLGVSSCIQSSLVDAGVSPEEVNYINAHATSTLVGDLAEINAIKKVFKNPSGIKINATKSMIGHCLGAAGGLEAIATIKAITTGWLHPSINQFNPEPAVDFDTVANVKQQHEINVGISNSFGFGGHNSVVAFSAFRP

SEQ ID NO: 4092 - protein, 472 aa, Orobanche aegyptiaca
MQALQSSALLHSPLDPLRRSTHSAALPSNNAKPPAKRLPFTISASASTVSAPKRETDPKKRVVITGMGLVSVFGNDVDAYYEKLLAGESGIAPIDRFDASKFPTRFGGQIRGFKSEGYIDGKNDRRLDDCLRYCLVAGKKALEGADLGGDRLNKIDKIRGGVLVGTGMGGLTVFSDGVQALIEKGHRKITPFFIPYAITNMGSALLAIDLGLMGPNYSISTACATSNYCFYAAANHIRRGEADLMLAGGTEAAIIPIGLGGFVACRALSQRNDDPKTASRPWDKDRDGFVMGEGAGVLVMESLEHAMKRGAPIIAEYLGGAVNCDAYHMTDPRADGLGVSSCIKSALEDAGVSPEEVNYINAHATSTIVGDLAELNAIKKVFKNTSGIKINATKSMIGHCLGAAGGLEAIATVKAIRTGWLHPTINQFNPEPSVGFDTVANEKQQHEVDVAISNSFGFGGHNSVVAFSAFKP

SEQ ID NO: 4093 - protein, 471 aa, Populus trichocarpa
MQALQSTPLRSSPLNPLHKKPHNATKSPTQRLSFIKASSSSSTSNSTVSAPKREKDPKKRIVITGMGLVSVFGNEVDAYYDKLLAGESGIGTIDRFDASKFPTRFGGQIRGFSAQGYIDGKNDRRLDDCLRYCIVAGKKALEDADLGGDNLSKIDKEKAGVLVGTGMGGLTVFSDGVQSLIEKGHRKITPFFIPYAITNMGSALLAIELGFMGPNYSISTACATSNYCFYAAANHIRRGEADMMIAGGTEAAIIPIGLGGFVACRALSQRNDDPKTASRPWDKDRDGFVMGEGAGVLVMESLEHAMRRGAPIIAEYLGGAVNCDAYHMTDPRADGLGVSSCIERSLEDAGVSPEEVNYINAHATSTIAGDLAEINAIKKVFKNTSGIKINATKSMIGHCLGAAGGLEAIASVKAITTGWLHPSINQFNPEPSVEFDTVANKKQQHEVNVAISNSFGFGGHNSVVVFSAFKP

SEQ ID NO: 4094 - protein, 471 aa, Prunus mume
MQALQSSSLRPAPLDPIRKRTPHFPIVSPRPTSSRRVSFISASSAPAVSAPKREKDPKKRVVITGMGLVSVFGNDVNAYYDKLLAGESGVGPIDRFDASKFPTRFGGQIHGFSSEGYIDGKNDRRLDDCLRYSIVAGKKALEDADLGGDKRSTLDKSRAGVLVGSGMGGLTVFSDGVHALIEKGHRKITPFFIPYAITNMGSALLGIDLGFMGPNYSISTACATSNYCFYAAANHIRRGEADLMIAGGTEAALIPVGLGGFVACRALSQRNDDPKTASRPWDKDRDGFVMGEGAGVLVMESLEHATKRGAQIIAEYLGGAINCDAYHMTDPRADGLGVSTCIERSLEDAGVSPEEVNYINAHATSTLAGDLAEINAIKKVFKNTRDIKINATKSMIGHCLGASGGLEAIATVKAITTGWLHPSINQFNPEPSVEFDTVANVKKQHEVNVAISNSFGFGGHNSVVAFSAFKP

SEQ ID NO: 4095 - protein, 478 aa, Phalaenopsis aphrodite
MHSLLSPLALQIPASEGLRSCPSIPTIAHRRCRYGRFAVRSSRVRAAVASVPAAAPRRETDPKKRVVITGMGLVSVFGNDVDKYYERLLEGESGIGQIDRFDASVFPTKFAGQIRNFSSEGYIDGKNDRRLDDCMRYCLVSGKKALENADLPPGSAALKKIDKVRAGVLVGTGMGGLTVFSDGVQALIDKGYRKITPFFIPYAITNMSSALLAMDIGFMGANYSISTACATSNYCFYAAANHIRRGDADVMIAGGTEAAIIPIGLGGFVACRALSQRNDEPRTASRPWDKGRDGFVMGEGSGVLVLESLEHAMKRDAPIIAEYLGGAVNCDAYHMTDPRADGLGVSTCIQKSLEDAGVAPEEVNYINAHATSTPAGDLAEVNAIKKVFKNPKDIKMNATKSMIGHCLGASGGLEAIACAKAITTGWLHPTINQFDPEPAVDFDTVANKKQQHEVNVAISNSFGFGGHNSVVVFAPFKP

SEQ ID NO: 4096 - protein, 445 aa, Trifolium pratense
AATAAKTKSSKRFTRVSASVTTTAPQRQKDPKKRVVITGMGLASVFGNDVDGYYEKLLAGESGITSIDRFDASKFPTRFAGPIRGFSSEGYIDGKNDRRLDDCLRYCIVAGKKALEHANLGGENLSKIDKERAGVLVGSGMGGLTVFSEGVKNLIEKGHRKITPFFIPYAITNMGSALLGIDLGFMGPNYSISTACATSNYCFYAAANHIRRGEADLMIAGGTEAAIIPIGLGCFVACRALSQRNDDPRTASRPWDKDRDGFVMGEGSGVLVLESLEHAMKRGAPIIAEYLGGAVNCDAYHMTDPRSDGLGVSTCIQSSLVDAGVSPEEVNYINAHATSTLAGDLAEINAIKKVFKNTSGIKINATKSMIGHCLGAAGGLEAIATVKAITTGWVHPSINQFNPEPAVDFDTVPNVKQQHEINVGISNSFGFGGHNSVVAFSAFRP

SEQ ID NO: 4097 - protein, 301 aa, Ambrosia trifida
MSATAPKREKDPKKRVVITGMGLVSVFGNDVDTYYEKLLSGESGIGLIDRFDASKFPTRFGGQIRGFKSDGYIDGKNDRRLDDCLRYCIVAGKKALEDADLGGDKLSKIDKERAGVLVGTGMGGLTVFSDGVQNLIEKGYRKITPFFIPYAITNMGSALLAIDLGFMGPNYSISTACATSNYCFYAAANHIRRGEADMMIAGGTEAAIIPIGLGGFVACRALSQRNDDPQTASRPWDKDRDGFVMGEGAGVLVMESLEHAMKRGAPIIAEYLGGAVNCDAYHMTDPRSDGLGVSSCHSKQP

SEQ ID NO: 4098 - protein, 272 aa, Flaveria ramosissima
MGSALLAIDLGFMGPNYSISTACATSNYCFYAAANHIRRGEADMMIAGGTEAAIIPIGLGGFVACRALSQRNDDPQTASRPWDKDRDGFVMGEGAGVLVMESLEHAMKRDAPIIAEYLGGAVNCDAYHMTDPRSDGLGVSSCIQSSLEDAGVSPEEVNYINAHATSTLVGDLAEVNAVKKVFKSTAGIKMNATKSMIGHCLGAAGGLEAIATVKAIQTGWLHPTINQFNPEPAVEFDTVANQKQQHEINVAISNSFGFGGHNSVVAFSAFKP

SEQ ID NO: 4099 - protein, 305 aa, Amaranthus tuberculatus
MGGLTVFSDGVQALIEKGHRKITPFFIPYAITNMASALLAIDLGLMGPNYSISTACATSNYCFYAAANHIRRGEADVMVAGGTEAAILPIGLGGFVACRALSQRNDDPQTASRPWDKERDGFVMGEGAGVLVMESLEHAMKRDAPIIAEYLGGAVNCDAYHMTDPRSDGLGVSSCIERSLEDAGVSPEEVNYINAHATSTIVGDLAEVNAVKKVFKSTSEIKMNATKSMIGHCLGAAGGLEAIATVKACTTGWLHPTINQFNPEPSVEFDTVPNKKQQHEVNVAISNSFGFGGHNSVVVFSAFKP

SEQ ID NO: 4100 - protein, 458 aa, Castanea mollissima
LLQNQSKSKSHFHFRPSRSSFRRRSSSGASVIVNVSAPKREHDPKKRVVITGMGLVSVFGNEVDEYYNRLLSGESGIGPIDRFDASKFPTRFAGQIHGFNSEGYIDGKNDRRLDDCLRYCIVAGKKALVDADLGGDKLSKIDKERAGVLVGTGMGGLTVFSDGVQALIEKGHRKITPFFIPYAITNMGSALLGIDLGFMGPNYSISTACATSNYCFYAAANHIRRGEADLMVAGGTEAAVIPIGLGGFVACRALSQRNDDPKTASRPWDKGRDGFVMGEGAGVLIMESLEHAMKRGAPIIAEYLGGAVNCDAYHMTDPRADGLGVSSCIQSSLEDAGVSPEEVNYINAHATSTLAGDLAEINAIKKVFKDTSGIKINATKSMIGHCLGAAGGLEAIATVKAINTGWLHPSINQFNPEPSVDFDTVANTKQQHEVNVAISNSFGFGGHNSVVAFSAFKP

SEQ ID NO: 4101 - protein, 469 aa, Cichorium intybus
MQAQALLQSTPLRVSPLDPLQKHSLLTNVKSTSFATRRRAVISAVAAAPKREKDPKKRVVITGMGLVSVFGNDVDTYYEKLLAGESGIGLIDRFDASKFPTRFGGQIRGFKADGYIDGKNDRRLDDCLRYCIVAGKKALEDADLGGDKRSKIDKERAGVLVGTGMGGLTVFSDGVQSLIERGYRKITPFFIPYAITNMGSALLAIDLGFMGPNYSISTACATSNYCFHAAANHIRRGEADMMIAGGTEAAIIPIGLGGFVACRALSQRNDDPQTASRPWDQDRDGFVMGEGAGVLVMESLEHAMKRDAPILAEYLGGAINCDAYHMTDPRSDGLGVSSCIQSSLQDAGVSAEEVNYINAHATSTLVGDLAEVNAVKKVFKNTDGIKMNATKSMIGHCLGAAGGLEAIATVKAIQTGWLHPSINQFNPEPAVEFDTVANVKQQHEINVAISNSFGFGGHNSVVAFSAFKP

SEQ ID NO: 4102 - protein, 469 aa, Petroselinum crispum
MQALQSSPLRVSPLDPLRKATSGAAAVTNVRPPHKKSFISAATSTSSAPKRETDPSKRVVITGMGLVSVFGNDVDTYYDKLLAGESGIGLIDRFDASKFPTRFGGQIRGFSSEGYIDGKNDRRLDDCLRYAIVAGKKALENADLGGDNRFKVDKERAGVLVGTGMGGLTVFSDGVQALIERGHRKITPFFIPYAITNMGSALLAIDLGFMGPNYSISTACATSNYCFYAAANHIRRGEADLMIAGGTEAAIIPIGLGGFVACRALSQRNDDPKTASRPWDKDRDGFVMGEGAGVLVMESLEHAMKRGAPIIAEYLGGAINCDAYHMTDPRSDGLGVSSCIQSSLLDAGVSPEEVNYINAHATSTIVGDLAEVNAVKKVFKNTSGIKMNATKSMIGHCLGAAGGLEAIAVIKAITTGWLHPTINQFNSEPSVEFDTVANHKQQHEVNVGISNSFGFGGHNSVVAFSAFKP

SEQ ID NO: 4103 - protein, 469 aa, Petroselinum crispum
MQALQSSPLRVSPLDPLRKATSGAAAVTNVRPPHKKSFISAATSTSSAPKRETDPSKRVVITGMGLVSVFGNDVDTYYDKLLAGESGIGLIDRFDASKFPTRFGGQIRGFSSEGYIDGKNDRRLDDCLRYAIVAGKKALENADLGGDNRFKVDKERAGVLVGTGMGGLTVFSDGVQALIERGHRKITPFFIPYAITNMGSALLAIDLGFMGPNYSISTACATSNYCFYAAANHIRRGEADLMIAGGTEAAIIPIGLGGFVACRALSQRNDDPKTASRPWDKDRDGFVMGEGAGVLVMESLEHAMKRGAPIIAEYLGGAVNCDAYHMTDPRSDGLGVSSCIQNCLRDAGVSPEEVNYINAHATSTIVGDLAEVNAVKKVFKNTSGIKMNATKSMIGHCLGAAGGLEAIAVIKAITTGWLHPSINQFNSEPSVEFDTVANQKQQHAVNVGISNSFGFGGHNSVVAFSAFKP

SEQ ID NO: 4104 - protein, 482 aa, Cannabis sativa
MQSLQASTLRPSPPLDPHRHRGTQFLRNATTKAWPRPTRPTKVSFISASSSSVAPKREKDPKKRVVITGMGLVSVFGNDVDAYYDKLLSGESGIGLIDRFDASKFPTRFGGQIRGFNSEGYIDGKNDRRLDDCLRYCIVAGKKALEDADLGGEKLSKIDKERAGVLVGTGMGGLTVFSDGVKALIEKGHRKITPFFIPYAITNMGSALLAIDLGFMGPNYSISTACATSNYCFYAAANHIRRGEADMMIAGGTEAAIIPIGLGGFVACRALSQRNDDPKTASRPWDRDRDGFVMGEGAGVLVMESLEHAMKRGAPIIAEYLGGAVNCDAYHMTDPRADGLGVSSCILSSLEDAGVSPEEVNYINAHATSTLAGDLAEINAIKKVFKDTSGIKINATKAISLARSSMIGHCLGAAGGLEAIATVKAINSGWLHPSINQFNPEPSVDFDTVANTKQQHEVNVAISNSFGFGGHNSVVAFSAFKP

SEQ ID NO: 4105 - protein, 469 aa, Cirsium arvense
MQAQALLQSTPLRVSPLDPLHKRSLPINVNSPSLAATRRRAVISAVAAPKREKDPKKRVVITGMGLVSVFGNDVDTYYEKLLAGESGIGLIDRFDASKFPTRFGGQIRGFKADGYIDGKNDRRLDDCLRYCIVAGKKALEDADLGGDKRSKIDKERAGVLVGTGMGGLTVFSDGVQSLIERGYRKITPFFIPYAITNMGSALLAIDLGFMGPNYSISTACATSNYCFHAAANHIRRGEADMMIAGGTEAAIIPIGLGGFVACRALSQRNDDPQTASRPWDQDRDGFVMGEGAGVLVMESLEHAMKRDAPILAEYLGGAINCDAYHMTDPRSDGLGVSSCIHSSLEDAGVSPEEVNYINAHATSTLVGDLAEVNAVKKVFKKTEGIKMNATKSMIGHCLGAAGGLEAIATVKAIQTGWLHPSINQFNPEPAMEFDTVANVKQQHEINVAISNSFGFGGHNSVVAFSAFKP

SEQ ID NO: 4106 - protein, 487 aa, Eschscholzia californica
MQTLQSSSSLRVSPLESLRKQSPLLNTNNNVITTTNNNNRSKKKNPSSLVISASSSPTTNNVTTSTPKREKDPKKRVVITGMGLVSVFGNDVDTYYERLLSGESGISLIDRFDASKFPTRFGGQIRGFESQGYIDGKNDRRLDDCLRYCLVAGKKALEDAGLGGETLSKINKERGGVLVGTGMGGLTVFSNGVESLIEKGHRKITPFFIPYSITNMGSALLGIELGLMGPNYSISTACATSNYCFYAAANHIRRGEADFMLAGGTEAAIIPIGLGGFVACRALSQRNDDPKTASRPWDKDRDGFVMGEGAGVLVMESLEHAMKRNAPIIGEYLGGAVNCDAYHMTDPRADGLGVSTCIQKSLEDAGVSSEEVNYINAHATSTLAGDLAEVNAIKKVFKDSSNIKINATKSMIGHCLGAAGGLEAIATMKAITTGWLHPTINQFNPEPAVEFDTVANVKKQHEVNVAISNSFGFGGHNSVVVFSGFKP

SEQ ID NO: 4107 - protein, 460 aa, Euphorbia peplus
SLRASPLNPLHEKTRNAIKTPPKRVSFITASSSAGTTTPPKREKDPKKRVVITGMGLVSVFGNDVDVYYDTLLSGKSGIGPIDRFDASKFPTRFGGQIRGFDSQGYIDGKNDRRLDDCLRYCIVAGKKAFENAGLGGDGSYKIDKERAGVLVGTGMGGLTVFSDGVQALIERGHRKITPFFIPYAITNMGSALLGIELGLMGPNYSISTACATSNYCFYAAANHIRRGEAEMMIAGGTEAAIIPIGLGGFVACRALSQRNDDPQTASRPWDKDRDGFVMGEGAGVLVMESLEHAMKRGAPILAEYLGGAVNCDAYHMTDPRADGLGVSSCIERSLEDAGVSPEEVNYINAHATSTLAGDLAEINAIKKVFKNTSEIKINATKSMIGHCLGAAGGLEAIACVKAINTGWLHPSINQFNPEPSVEFDTVANTKKQHEVNVAISNSFGFGGHNSVVVFSSFKP

SEQ ID NO: 4108 - protein, 471 aa, Cucumis melo
MQAAVHSSTLKPSPLDSFRRRKCSPFLVSAPKSRPRVSFVSASAASTVSAPKREKDPKKRVVITGMGLVSVFGNDVDTYYDKLLSGESGVTLIDRFDASKFPTRFGGQIRGFASQGYIDGKNDRRLDDCLRYCIVAGKKALEDADLGGDKRSKIDKERAGVLVGTGMGGLTVFSDGVQALIEKGHRKITPFFIPYAITNMGSALLAIDIGFMGPNYSISTACATSNYCFYAAANHIRRGEADMMLAGGTEAAIIPIGLGGFVACRALSQRNDDPKTASRPWDKDRDGFVMGEGAGILVMESLEHAMKRGAPIIAEYLGGAVNCDAYHMTDPRADGLGVSSCILSSLEDAGVSPEEVNYINAHATSTLAGDIAEINAIKKVFKNTSEIKINATKSMIGHCLGAAGGLEAIATVKAIETGWLHPSINQFNPEPSVDFDTVANVKQQHEVNVAISNSFGFGGHNSVVAFSAFKP

SEQ ID NO: 4109 - protein, 469 aa, Fragaria vesca
MQAIQSSTLRPAPLDPLRKRTHFPNLTPRPAPRRVSFISASSATTVSAPTREKDPKKRVVITGLGCVSVFGNDVNAYYDKLLAGESGVGPIDRFDASKFPTRFGGQIRGFTSEGYIDGKNDRRLDDCLRYAIVAGKKALEDADLGADNRPKLDKSRAGVLVGSGMGGLTVFSDGVHALIDKGHRKITPFFIPYAITNMGSALLGIDLGFMGPNYSISTACATSNYCFYAAANHIRRGEADLMIAGGTEAALIPIGLGGFVACRALSQRNDDPKTASRPWDKDRDGFVMGEGAGILVMESLEHAMKRGAPIIAEYLGGAINCDAYHMTDPRADGLGVSTCIERSLEDSGVSPEEVNYINAHATSTLAGDLAEVNAIKKVFKNTKEIKINATKSMIGHCLGASGGLEAIATVKAIQTGWLHPSINQFNPEPSVEFDTVANVKQQHEVNVAISNSFGFGGHNSVVAFSAFKP

SEQ ID NO: 4110 - protein, 469 aa, Eutrema parvulum
MQSLQSSSLRASPPNPLLRPSNRQSHQITNARPTRRRSFISASAAVSAPKRETDPKKRVVITGMGLVSVFGNDVDAYYEKLLSGESGISLIDRFDASKFPTRFGGQIRGFSSEGYIDGKNERRLDDCLKYCIVAGKKALESANLGGDKLNTIDKQKAGVLVGTGMGGLTVFSDGVQALIEKGHRRISPFFIPYAITNMGSALLAIDLGLMGPNYSISTACATSNYCFYAAANHIRRGEADMMIAGGTEAAIIPIGLGGFVACRALSQRNDDPQTASRPWDKQRDGFVMGEGAGVLVMESLEHAMKRGAPIVAEYLGGAVNCDAHHMTDPRADGLGVSSCIESCLEDAGVSPEEVNYINAHATSTLAGDLAEINAIKKVFKSTSGIKINATKSMIGHCLGAAGGLEAIATVKAINTGWLHPSINQFNPEPAVDFDTVANEKKQHEVNVAISNSFGFGGHNSVVAFSAFKP

SEQ ID NO: 4111 - protein, 469 aa, Solanum lycopersicum
MEAIQSLSFRPSPLEPLRKNIPQFTNVRSLGAKRVPLTITASASTVSAPKREKDPKKRVVITGTGLVSVFGNDVDTYYDRLLAGESGISLIDRFDASKFPTRFGGQIRGFTSEGYIDGKNDRRLDDCLRYAIVAGKKALENADLGGDRLEKIDKERAGVLVGTGMGGLTVFSDGVQNLIEKGHRKITPFFVPYAITNMGSALLGIDLGFMGPNYSISTACATSNYCFYAAANHIRRGEADLMLAGGTEAAIIPIGLGGFVACRALSQRNDDPQTASRPWDKERDGFVMGEGAGILVMESLEHAMKRGAPIIAEYLGGAVNCDAYHMTDPRADGLGVSSCILSSLEDAGVSPEEVNYINAHATSTIVGDLAEINAVKKVFKTTTGIKMNATKSMIGHCLGAAGGLEAIATIKAITTGWVHPSINQFNPEPSVEFDTVPNKKQQHEVNVAISNSFGFGGHNSVVAFSAFKP

SEQ ID NO: 4112 - protein, 915 aa, Brachypodium distachyon
MAPLPTPSPRPGPPPTGMTTPLRTPTSKHRLHFTPRSAHHGGGGAAGAATEHPVEVIGRVRNLTAAAAGASALEVAGGGTAVRVRGDAGGCRDFTLDGVSVSEEEDLEGFYRRFVRSRIEGVRVGAKCTVMVYGPTGSGKSHTMFGCAKQPGIVYRALRDILEGGGGGSSSSEGESRGEEDAGFGMGLFVQVAVLEIYNEEIYDLLVGSGANAKGNAPKVRLEVMGKKAKNATYISGNEAGKISREVAKVEKRRTVKSTLCNERSSRSHCMIILDVPSVGGRLMLVDMAGSENIEAAGQTGFEAKMQTAKINQGNTALKRVVESIANGDSHVPFRDSKLTMLLQDSFEDDKSKILMILCASPDPKELHKTVSTLEYGAKAKCIIRAAHASTPRDKMSSEESSSMLNSRIVAMNQFIYKLQKENKQREKERNEAQNILRLKEEELAQARAKLRLIEGQGAAAKEEEINSKVIEKTQILKSELRMMEEKMLRQQQELLALKQRLQEVEREKVDARQPVQQDIIGGRLLARLSEMSAGVDPSMSMAMSMSMDLDTGDQPTVLDVKVIKEDTRQQGQVWNHSSTAGSCTTALEQEDIVRLSGFPEKAVLSTVFEEGDEEGEEKDNGAEAEVCKEVVEEESYKVDRMEQPLAEPDRTNRIQNIFRLCGNYRELVKKPNVESPANQQVFGDENKQLGKQFLGDENNQPEKQLFADENKDPSAWAAIETPMCDVKVTDSPVSSQLSPIVCQVVDEAKLTVPEELKSCTTPEATDQGKPKEQEGLLEVYIKWESGNLIKGLKLLQNACLSDLRKLIEAHFEEAGSKLQPHQFTFLLLGDPSGAPVSREKEATIQISKLPNWNNQPSSYLACLRAVKKPATDQLHQIPFSPLESKLNSTLNATGALSPKVVAQMSPNYIRELRA

SEQ ID NO: 4113 - protein, 912 aa, Setaria italica
MAPPTPSPRPGLTPTPQGGGLATPLRTPTSKHRLHFPAATPKNAHHGGGGAATEHPVEVIGRIRNLASGGASALEIAGGGTAVRVRGDAGGCRDFTLDGVSVSEEEDLEGFYRRFVRSRIEGVRVGAKCTVMVYGPTGSGKSHTMFGCAKQPGIVYRALRDILEGGGGGRGGDGDGSGGGSEDDAGFGAGLFVQVAVLEIYNEEIYDLLVGSGANARGNAPKARLEVMGKKAKNATYICGNEAGKISREVAKVEKRRTVKSTLCNERSSRSHCMIILDIPSVGGRLMLVDMAGSENIEAAGQTGFEAKIQTAKINQGNTALKRVVESIANGDSHVPFRDSKLTMLLQDSFEDDKSKILMILCASPDPKELHKTVSTLEYGAKAKCIIRSAHAATPREKMSSEESSAMLNSRIVAMNQFIYKLQKENRLREKERNEAQNVLRLKEEELSQLKAKLKLMEGQEKAAKEETEKTQALRSELMKMEEKMLRQQEELAALKQRLQEVEREKTDACQPVQQDLIGSRLLARLSEMPAGFDQSMSMVMSMELDMGDQPQDVKVIKEDTRHQGHIWNHTATAGVCTGAVVQEDDVRLSGYPEKVVLSTVFEEGDDEDAEGGNGLEEEVCKEVVEESFKVDITQDALADPDDPATRKHRIENIFRLCGNHRELAKKPKVQSPAKEVFGDQNKSPAKKVFGDVKKSPAKQVFGDENKEPSAWGTMDTPMCDVKVTDSPVSSQLSPIVCQVVDEPLSEQLKLCSTVQESDQNKENSVAGQKEQDGLLEVYIKWESGNLIKGLKLLPNSCLSELRKLIEAHFEEAGSKQQQQFTFLLLGDPSGGPVSREKEASVQISKLPHWNNQPNSYLACLRAAKKPTVDHMPFSPLESKLNSVVKDAHLAGMLSPKAANQMSPNYIRELRA

SEQ ID NO: 4114 - protein, 911 aa, Panicum virgatum
MAPPTPSPRPGPPQGGALPTPLRTPASKHRLHFPATTPKNAHHGVGVGAATEHPVEVIGRIRNLSSAGASALEIAGGGTAVRVRGDAGGCRDFTLDGVSVSEEEDLEGFYRRFVRSRIEGVRVGAKCTVMVYGPTGSGKSHTMFGCAKQPGIVYRALRDILEGGGGGEGDGPAGGGDDDAGFGAGLFVQVAVLEIYNEEIYDLLVGSGANAKGNAPKARLEVMGKKAKNATYLSGNEAGKISREVAKVEKRRTVKSTLCNDRSSRSHCMIILDVPSVGGRLMLVDMAGSENIEAAGQTGFEAKMQTAKINQGNTALKRVVESIANGDSHVPFRDSKLTMLLQDSFEDDKSKILMILCASPDPKELHKTVSTLEYGAKAKCIIRAAHAATPRDKISSEESSTMLNSRIVAMNQFIYKLQKENKLREKEHNEAKNLLRLKEEELTQLRAKLKLIEGQEKAVKEEEINSKVMEKTQTLRNELMKMEEAMLRQQEELTALKQRLQEVEHEKADACQPVQQDFIGGRLLARLSEMPAGLDQSMSMVMSMELDTGDQPQDVKVIKEDTRQQGHIWNHTATAGVCTGAVAQDDDVRLSGYPEKVVLSTVFEEADEEDAERDSGLEEVCKEVVQESFKADTIQNALTEPDDPATRKHLIENIFRLCGNHRELAKKPKVQSPTKEVFADENRSPSKHVFGEESRSAAKQAYGNENREPLAWGALETPMCDVKVAESPVSSQLSPIVCQVVDEPMVEQLKSCSTMEDSDQNKENSFAGQKEQDGLLEVYIKWESGNLIKGLKLLQNSCLSDLRKLIEAHFEEAGGKEQHQFTFLLLGDPSGAPVSREKEASVQIRKLPHWNNHPDSYLACLRAAKKPAVDHMPFSPLDSKLNSVVKDTHLAGVLSPKVNQMSPNYIRELRA

SEQ ID NO: 4115 - protein, 910 aa, Panicum virgatum
MAPPTPSPRPGPPPTPHGGALATPLRTPASKHRLHFPATTPKNAHLGAATEHPVEVIGRIRNLSPGGASALEIAGGGTAVRVRGDAGGCRDFTLDGVSVSEEEDLEGFYRRFVRSRIEGVRVGAKCTVMVYGPTGSGKSHTMFGCAKQPGIVYRALRDILEGGAGGEGDGPAGRGEDDAGFGAGLFVQVAVLEIYNEEIYDLLVGSGANARGNAPKARLEVMGKKAKNATYLSGNEAAKISREVAKVEKRRIVKSTLCNDRSSRSHCMIILDVPSVGGRLMLVDMAGSENIEAAGQTGFEAKMQTAKINQGNTALKRVVESIANGDSHVPFRDSKLTMLLQDSFEDDKSKILMILCASPDPKELHKTVSTLEYGAKAKCIIRAAHAATPRDKISSEESSTMLNSRIVAMNQFIYKLQKENKLREKERNEAQNLLRLKEEELTQLRSKLKLIEGQEKAAKEEEINSKVMEKTRTLRSELTKMEEAMLRQQEELAALKQRLQEVEHVKADACQPVQQDFIGGRLLARLSEMPAGLDQSMSMVMSMELDMGDQQQDVKVIKEDTRQQGHIWNHTTTAGVCTGAVVQEDDVRLSGYPEKVVLSTVFEEGDEEDAERDSGLEEVCKEVVQESFKVDTTQHALAEKDDPATRKHRIENIFRLCGNHRELAKKPKVQSPTKEVFADENRSPAKYVFGEESTSAAKQAYGNEDREPLARGALETPMCDVKVAESPVSSQLSPIVCQVVDQPLSEQLKSCSTVEDSDQNKEHSFAGQKEQDGLLEVYIKWESGNLIKGLKLLRNSCLSDLRKLIEAHFEEQSGKDQFIFLLLGDPSGGPVSREKEASVQISKLPHWNNQPDSYLACLRAAKKPVAVMDHMPFSPLDSKLNSVAKDTQLAGVLSPKVNQMSPNYIRELRA

SEQ ID NO: 4116 - protein, 1218 aa, Oryza sativa
MLTKFETKSNRVKGLSFHPRRPWILASLHSGVIQMWDYRMGTLLDRFDEHDGPVRGVHFHATQPLFVSGGDDYKIKVWNYKTHRCLFTLHGHLDYIRTVQFHHEYPWIVSASDDQTIRIWNWQSRTCVAVLTGHNHYVMCASFHPKEDLVVSASLDQTVRVWDIGALRKKTVSPADDILRLTQMNTDLFGGVDAVVKYVLEGHDRGVNWASFHPTLPLIVSGADDRQVKLWRMNDTKAWEVDTLRGHMNNVSCVMFHAKQDIIVSNSEDKSIRIWDATKRTGIQTFRREHDRFWILSAHPEMNLLAAGHDSGMIVFKLERERPAFSVSGDTVFYVKDRFLRFFEFTTQKEVQLAPIRRPGSVSLNQSPKTLSYSPTENAVLICSDVDGGSYELYIVPKDSAGRADYLQDAKKGAGGSAVFVARNRFAVLEKSSNQVLVKNLKNEIVKKSPLPIATDAIYYAGTGNLLCKAEDRVTIFDLQQRLILGELQAPSVKYVVWSSDMESVALLSKHAVVIANKKLVHRCTLHETIRVKSGAWDENGVFIYTTLNHIKYCLPNGDSGIIKTLDVPIYITRVIGNNIFCLDRDGKNKLVTVDASEYIFKLALLRKRYDHVMSMIKNSQLCGQAVISYLQQKGFPEVALHFVKDEKTRFNLALESGNIQIAVASAKEIDDKDHWYRLGIEALRQGNVGIVEYAYQRTKNFERLAFLYLITGYMDKVGFMCKIAGQNNNLMGQFHNALYLGDALKRVEILENAGQLPLAYITATTHGLTEIADRLAAELGENIPSLPEGKARSLLIPPAPLTASGDWPLLRVMHGIFEGGLDATGKAELEEDDEAAGADWGDEDLDMVDASEAMANGGDGFDAEEGEANEEDGEEGGWDLEDLELPPEAETPKNAGNARSAVFVAPPPGMPVSLIWTQKSSLAGEHAAAGNFDTAMRLLSRQLGIKNFAPLKPLFVDLHMGSHSYLRALATAPIIPIAVEKGWSESASPNVRGPPALVFTFPQMEDRLKAAYKATTDGKFPEALRQFLSILHTIPLIVVDSRREVDEVKELIEIVREYVLGLRMELKRKELRDDVNRQQELAAYFTNCKLQRVHMRLVLGSAMGLCYKQKNFATAEHFARMLLENNPNEAQARRARQVQQQCSGKKDSSELNYDYRNPFVVCGATYVPIYRGQKDVSCPYCGSRFVPSIEGQLCTICELAVVGADASGLLCSPTQSR

SEQ ID NO: 4117 - protein, 1218 aa, Oryza sativa
MLTKFETKSNRVKGLSFHPRRPWILASLHSGVIQMWDYRMGTLLDRFDEHDGPVRGVHFHATQPLFVSGGDDYKIKVWNYKTHRCLFTLHGHLDYIRTVQFHHECPWIVSASDDQTIRIWNWQSRTCVAVLTGHNHYVMCASFHPKEDLVVSASLDQTVRVWDISALRKKSVSPADDILRLTQMNTDLFGGVDAVVKYVLEGHDRGVNWASFHPTLPLIVSGADDRQVKIWRMNDTKAWEVDTLRGHMNNVSCVMFHAKQDIIVSNSEDKSIRIWDATKRTGIQTFRREHDRFWILSAHPEMNLLAAGHDSGMIVFKLERERPAFSVSGDTVFYVKDRFLRFFEFTTQKEVQLAPIRRPGSVSLNQSPKTLSYSPTENAVLICSDVDGGSYELYIVPKDSAGRADYLQDAKKGAGGSAVFVARNRFAVLEKSSNQVLVRNLKNEIVKKSPLPIATDAIYYAGTGSLLCKAEDRVTIFDLQQRLILGELQAPSVKYVVWSSDMESVALLSKHAVVIANKKLVHRCTLHETIRVKSGAWDENGVFIYTTLNHIKYCLPNGDSGIIKTLDVPIYITRVIGNNIFCLDRDGKNKLVTVDASEYIFKLALLRKRYDHVMSMIKNSQLCGQAVISYLQQKGFPEVALHFVKDEKTRFNLALESGNIQIAVASAKEIDDKDHWYRLGIEALRQGNVGIVEYAYQRTKNFERLAFLYLITGYMDKVGFMCKIAGQNNNLMGQFHNALYLGDAMKRVEILENAGQLPLAYITATTHGLTEIADRLAAELGENIPSLPEGKARSLLIPPAPLTASGDWPLLRVMRGIFEGGLDATGKAELEEDDEAAGADWGDEGLDIVDASEAMANGGDGFDAEEGEANEEDGEEGGWDLEDLELLPEAETPKNAGNARSAVFVAPPPGMPVSLIWTQKSSLAGEHAAAGNFDTAMRLLSRQLGIKNFAPLKPLFLDLHMGSHSYLHALATAPIIPVAVEKGWSESASPNVRGPPALVFTFPQMEDRLKAAYKATTDGKFPEALRQFLSILHTIPLIVVDSRREVDEVKELIEIVREYVLGLRMELKRKELRDDVNRQQELAAYFTNCKLQRVHMRLVLGSAMGLCYKQKNFATAEHFARMLLENNPNEAQARRARQVQQQCSGKKDSSELNYDYRNPFVVCGATYVPIYRGQKDVSCPYCGSRFVPSIEGQLCTICELAVVGADASGLVCSPTQLR

SEQ ID NO: 4118 - protein, 1217 aa, Secale cereale
MLTKFETKSNRVKGLSFHPRRPWILASLHSGVIQMWDYRMGTLLDRFDEHDGPVRGVHFHATQPLFVSGGDDYKIKVWNYKTHRCLFTLTGHLDYIRTVQFHHEYPWIVSASDDQTIRIWNWQSRTCVAVLTGHNHYVMCASFHPKEDLVVSASLDQTVRVWDIGALRKKTVSPADDIMRLTQMNTDLFGGVDAVVKYVLEGHDRGVNWASFHPTLPLIVSGADDRQVKLWRMNDTKAWEVDTLRGHMNNVSCVMFHAKQDIIVSNSEDKSIRIWDATKRTGIQTFRREHDRFWILAAHPEMNLLAAGHDSGMIVFKLERERPAFSVSADTVFYVKDRFLRFFEYSTQKEVQVAPIRRPGSVSLNQSPRTLSYSPTENAVLICSDVDGGSYDLYIVPKDSAGRADYLQEAKKGAGGSAVFVARNRFAVLEKSSNQVLVKNLKNEIVKKSPLPIATDAIYYAGTGNLLCKAEDRVTIFDLQQRLVLGELQTAGVKYVVWSSDMEYVALLSKHAVVIASKKLVHRSTLHETIRVKSGAWDENGIFIYSTLNHIKYCLPNGDSGIIKTLDVPVYITRVIGNNIFCLDRDGKNKLITVDASEYIFKLALLRKRYDHVMSMIKSSQLCGQAVISYLQQKGFPEVALHFVKDEKTRFNLALESGNIQIAVASAKEIDDKDHWYRLGIEALRQGNVGIVEYAYQRTKNFERLTFLYLITGYMDKVGFMCKIAGQNNNLMGQFHNALYLGDARKRAEILENAGQLPLAYVTAATHGLTEIAERLAAELGENVPSLPEGKTRSLLIPPAPLISSVDWPLLRVMRGIFEGGLDATGRAEVEEDDEAAGADWGDEDLDIVDASDAVANGGDGFDPEEGEANEEDGEEGGWDLEDLELPESETPKAAGNARSTVFVAPTLGMPVSQIWTQKSSLAGEHAAAGNFDTAMRLLSRQLGIKNFAPLKPMFLDLHMGSHSYLRALATAPVISIAVEKGWSESSSPNVRGPPSLVFTFSQMEDRLKAAYKATTEGKFPEALRQFLSILHTIPLIVVDSRREVDEVKELVEIVREYVLGLRMELKRKELKDNVNRQQELAAYFTNCKLQRVHMRLVLSNAMALCYKQKNFATAEHFARLLLENSPNEVQAKKARQVQQQCNGKQDSHELNYDYRNPFVVCGSTYVPIYRGQKDISCPYCGSRFVPAIEGQLCTICELAVVGADASGLLCSPTQTR

SEQ ID NO: 4119 - protein, 1217 aa, Sorghum bicolor
MLTKFETKSNRVKGLSFHPRRPWILASLHSGVIQMWDYRMGTLLDRFDEHDGPVRGVHFHATQPLFVSGGDDYKIKVWNYKTHRCLFTLHGHLDYIRTVQFHHEYPWIVSASDDQTIRIWNWQSRTCVAVLTGHNHYVMCASFHPKEDLVVSASLDQTVRVWDIGALRKKTVSPADDILRLTQMNTDLFGGVDAVVKYVLEGHDRGVNWASFHPTLPLIVSGADDRQVKLWRMNDTKAWEVDTLRGHMNNVSCVMFHAKQDIIVSNSEDKSIRVWDATKRTGIQTFRREHDRFWILAAHPEMNLLAAGHDSGMIVFKLERERPAFCVSGDTVFYVKDRFLRFFEYTSQKEVQVAPIRRPGSVSLNQSPRTLSYSPTENAVLICSDADGGSYELYIVPKDSAGRSDYLQEAKKGAGGSAVFVARNRFAVLEKSSNQVLVKNLKNEIVKKSPLPIATDAIYYAGTGNLLCKSEDRVTIFDLQQRLVLGELQTPAVKYVVWSSDMESVALLSKHAVVIASKKLVHRCTLHETIRVKSGAWDENGVFIYTTLNHMKYCLPNGDSGIIKTLDVPIYITRVVGNNIFCLDRDGKNKLIAVDASEYIFKLALLRKRYDHVMSMIKNSQLCGQAVISYLQQKGFPEVALHFVKDEKTRFNLALESGNIQIAVASAKEIDDKDHWYKLGIEALRQGNVGIVEYAYQRTKNFERLAFLYLITGYLDKVGFMCKIAGQNNNLMGQFHNALYLGDAKKRVEILENAGQIPLAYVTAVTHGLTEIAERLAAELGENVPSLPEGKSHSLLIPPAPLTACGDWPLLRVMRGIFEGGLDATGRADLEEDDEAAGADWGDEDLDIVDASEVVANGDGFDVEEGEPNEEDGEEGGWDLEDLELPPETETPKSVGNARSAVFVAPTPGIPVSQIWTQRSSLAGEQAAAGNFDTAMRLLSRQLGIKNFVPLKPLFLDLHMGSHTYLRALAAAPVISVAVEKGWNESASPNVRGPPALVFSFSQMEDRLKAAYKATTEGKFPEALRQFLSILHTIPVIVVDSRREVDEVKELIEIVREYVLGLRMELKRKELRDDVTRQQELAAYFTNCKLQRVHMRLVLASAMALCFKQKNYATAGHFARMLLENSPQEAQAKKARQVLQACQDKNDSHQLNYDFRNPFVVCGATYVPIYRGQKDVSCPYCGSRFVPSIEGQLCTICELAAVGADASGLLCSPTQSR

SEQ ID NO: 4120 - protein, 1215 aa, Avena sativa
MLTKFETKSNRVKGLSFHPRRPWILASLHSGVIQMWDYRMGTLLDRFDEHDGPVRGVHFHATQPLFVSGGDDYKIKVWNYKTHRCLFTLTGHLDYIRTVQFHHEYPWIVSASDDQTIRIWNWQSRTCVAVLTGHNHYVMCASFHPKEDLVVSASLDQTVRVWDIGALRKKTVSPADDIMRLTQMNTDLFGGVDAVVKYVLEGHDRGVNWASFHPTLPLIVSGADDRQVKLWRMNDTKAWEVDTLRGHMNNVSCVLFHAKQDIIVSNSEDKSIRIWDATKRTGIQTFRREHDRFWILAAHPEMNLLAAGHDSGMIVFKLERERPAFSVSADTVFYVKDRFLRFFEYSTQKEVQVAPIRRPGSVSLNQSPRTLSYSPTENAVLICSDVDGGSYDLYIVPKDSTGSLQEAKKGAGGSAVFVARNRFAVLEKSSNQVLVKNLKNEIVKKSPLPIATDAIYYAGTGNLLCKAEDRVTIFDLQQRLVLGELQAAGVKYVVWSTDMESVALLSKHAVVIASKKLVHRSTLHETIRVKSGAWDENGVFVYSTLNHIKYCLPNGDSGIIKTLDVPIYITRVIGNNIFCLDRDGKNKLITVDASEYIFKLALLRKRYDHVMGMIKSSQLCGQAVISYLQQKGFPEVALHFVKDEKTRFNLALESGNIQIAVASAKEIDDKDHWYRLGIEALRQGNVGIVEYAYQRTKNFERLAFLYLITGYLDKVGFMCKIAGQNNNLMGQFHNALYLGDARKRAEILENAGQLPLAYATAATHGLTEIADRLAAELGENVPSLPAGKSRSLLIPPAPLISSVDWPLLRVMRGTFEVGLDATGRAEVEEDDEAAPADWGEEDLDIVDASDAVPNGGGGFDPEEGEANEEDGEDGGWDLEDLELPPEADTPKAAGNARSSVFVAPTPGMPVSQIWTQKSSLAGEHAAAGNFDTAMRLLSRQLGIKNFTPLKPLFLDLHMGSHSYLRALAAAPVISVAVEKGWSESASPNVRGPPALVFSFSQMEDRLKAAYKATTEGKFPEALRQFLSILHTIPLIVVDSRREVDEVKELIEIVREYVLGLRMELKRKELKDNVNRQQELAAYFTNCKLQRVHMRLVLSNAMALCYKQKNFATAEHFARLLLENSPNEVQAKKARQVQQQCSGKQDSCELNYDYRNPFVVCGSTYVPIYRGQKDISCPYCSSRFVPSVEGQLCTICELAVVGADASGLLCSPTQQR

SEQ ID NO: 4121 - protein, 1219 aa, Setaria italica
MLTKFETKSNRVKGLSFHPRRPWILASLHSGVIQMWDYRMGTLLDRFDEHDGPVRGVHFHATQPLFVSGGDDYKIKVWNYKTHRCLFTLHGHLDYIRTVQFHHEYPWIVSASDDQTIRIWNWQSRTCVAVLTGHNHYVMCASFHPKEDLVVSASLDQTVRVWDIGALRKKTVSPADDILRLTQMNTDLFGGVDAVVKYVLEGHDRGVNWASFHPSLPLIVSGADDRQVKLWRMNDTKAWEVDTLRGHMNNVSCVMFHAKQDIIVSNSEDKSIRIWDATKRTGIQTFRREHDRFWILAAHPEMNLLAAGHDSGMIVFKLERERPAFCVSGDTVFYVKDRFLRFFEYSTQKEVQVAPIRRPGSVSLNQSPRTLSYSPTENAVLICSDADGGSYELYIVPKDSAGRSDYLQEAKKGAGGSAVFVARNRFAVLEKSSNQVLVKNLKNEIVKKSPLPIATDAIYYAGTGNLLCKAEDRVAIFDLQQRLVLGELQTPAVKYVAWSTDMESVALLSKHAVVIASKKLVHRCTLHETIRVKSGAWDENGVFIYTTLNHMKYCLPNGDSGIIKTLDVPIYITRVVGNNIFCLDRDGKNKLIAVDASEYIFKLALLRKRYDHVMSMIKNSQLCGQAVISYLQQKGFPEVALHFVKDEKTRFNLALESGNIQIAVASAKEIDDKDHWYRLGIEALRQGNVGIVEYAYQRTKNFERLAFLYLITGYLDKVGFMCKIAGQNNNLMGQFHNALYLGDAKKRVEILENAGQLPLAYVTAVTHGLTEIAERIAAELGENAPSLPEGKSHSLLIPPAPLTACGDWPLLRVMRGIFEGGLDATGRAELEEDDEAAGADWGDEDLDIIDASEVVANGGDSFVEAEEGEPNEEDGEEGGWDLEDLELPPETETPKAVGNARSAVFVAPTPGIPVSQIWTQRSSLAGEHAAAGNFDTAMRLLSRQLGIKNFTPLKPLFLDLHMGSHTYLRALAAAPVISVAVEKGWNESASPNVRGPPALVFSFSQLEDRLKAAYKATTEGKFPEALRQFLNILHTIPVIVVDSRREVDEVKELIEIVKEYVLGLKMELKRKELRDDVTRQQELAAYFTNCKLQRVHMRLVLASAMALCFKQRNYATAAHFARMLLENSPQEAQAKKARQVMQACQDKNDSHQLNYDFRNPFVVCGATYVPIYRGQKDVSCPYCGSRFVPSIEGQLCTICELATVGADASGLLCSPTQLR

SEQ ID NO: 4122 - protein, 1219 aa, Pennisetum glaucum
MLTKFETKSNRVKGLSFHPRRPWILASLHSGVIQMWDYRMGTLLDRFDEHDGPVRGVHFHATQPLFVSGGDDYKIKVWNYKTHRCLFTLHGHLDYIRTVQFHHEYPWIVSASDDQTIRIWNWQSRTCVAVLTGHNHYVMCASFHPKEDLVVSASLDQTVRVWDIGALRKKTVSPADDILRLTQMNADLFGGVDAVVKYVLEGHDRGVNWASFHPSLPLIVSGADDRQVKLWRMNDTKAWEVDTLRGHMNNVSCVMFHAKQDIIVSNSEDKSIRIWDATKRTGIQTFRREHDRFWILAAHPEMNLLAAGHDSGMIVFKLERERPAFCVSGDTVFYVKDRFLRFFEYSTQKEVQVAPIRRPGSVSLNQSPRTLSYSPTENAVLICSDADGGSYELYIVPKDSAGRSDYLQEAKKGAGGSAVFVARNRFAVLEKSSNQVLVKNLKNEIVKKSPLPIATDAIYYAGTGNLLCKAEDRVAIFDLQQRLILGELQTPAVKYVAWSTDMESVALMSKHAVVIASKKLVHRCTLHETIRVKSGAWDENGVFIYTTLNHMKYCLPNGDSGIIKTLDVPIYITRVAGNNIFCLDRDGKNKLIAVDASEYIFKLALLRKRYDHVMSMIKSSQLCGQAVISYLQQKGFPEVALHFVKDEKTRFNLALESGNIQIAVASAKEIDDKDHWYRLGIEALRQGNVGIVEYAYQRTKNFERLAFLYLITGYLDKVGFMCKIAGQNNNLMGQFHNALYLGDAKKRVEILENAGQLPLAYVTAVTHGLTEIAERIAAELGENVPSLPEGKSHSLLIPPAPLTACGDWPLLRVMRGIFEGGLDATGRAEVEEDDEAAGADWGDEDLDIIDASEVVANGGDSFVEAEEGEPNEEDGEEGGWDLEDLELPPETETPKAVGNARSAVFVAPTPGIPVSQIWTQRSSLAGEHAAAGNFDTAMRLLSRQLGIKNFTPLKPLFLDLHMGSHTYLRALAAAPVISVAVEKGWNESASPNVRGPPALVFSFSQLEDRLKAAYKYTTEGKFPEALRQFLNILHTIPVIVVDSRREVDEVKELIEIVREYVLGLKMELKRKELRDDVTRQQELAAYFTNCKLQRVHMRLVLASAMALCFKQRNYATAAHFARMLLENSPPEAQAKKARQVVQACQDKNDSHQLNYDFRNPFVVCGATYVPIYRGQKDVSCPYCGSRFVPSIEGQLCTICELATVGADASGLLCSPTQLR

SEQ ID NO: 4123 - protein, 1217 aa, Zea mays
MLTKFETKSNRVKGLSFHPRRPWILASLHSGVIQMWDYRMGTLLDRFDEHDGPVRGVHFHATQPLFVSGGDDYKIKVWNYKTHRCLFTLHGHLDYIRTVQFHHEYPWIVSASDDQTIRIWNWQSRTCVAVLTGHNHYVMCASFHPKEDLVVSASLDQTVRVWDIGALRKKTVSPADDILRLTQMNTDLFGGVDAVVKYVLEGHDRGVNWASFHPTLPLIVSGADDRQVKLWRMNDTKAWEVDTLRGHMNNVSCVMFHAKQDIIVSNSEDKSIRIWDATKRTGIQTFRREHDRFWILAAHPEMNLLAAGHDSGMIVFKLERERPAFCVSGDTVFYVKDRFLRFFEYSTQKEVQVAPIRRPGSVSLNQSPRMLSYSPTENAVLICSDADGGSYELYIVPKDSAGRSDYLQEAKKGAGSSAVFVARNRFAVLEKSSNQVLVKNLKNEIVKKSPLPIATDAIYYAGTGNLLCKAEDRVAIFDLQQRLVLGELQTPAIKYVVWSSDMESVALLSKHAVVIATKKLVHRCTLHETIRVKSGAWDENGVFIYTTLNHMKYCLPNGDSGIIKTIDVPIYITRVVGNNIFCLDRDGKNKLVAVDASEYIFKLALLRKRYDHVMSMIKNSQLCGQAVISYLQQKGFPEVALHFVKDEKTRFNLALESGNIQIAVASAKEIDDKDHWYKLGIEALRQGNVGIVEYAYQRTKNFERLAFLYLITGYLDKVGFMCKIAGQNNNLMGQFHNALYLGDAKKRVEILENAGQLPLAYVTAATHGLTEFAERIAAELGENVPSLPEGKPKSLLIPPAPLTACGDWPLLRVMRGIFEGGLDATGRADLEEDDEAAGADWGDEELDIVDASEVVANGDGFDVEEGEPNEEGGEEGGWDLEDLELPPETETPKAVGNARSALFVAPTPGIPVSQIWTQRSSLAGEQAAAGNFDTAMRLLSRQLGIKNFVPLMPLFLDLHMGSHTYLRGLAAAPVISVAVEKGWNESASPNVRGPPALVFSFSRMEDRLKAAYKATTEGKFPEALRQFLSILHTIPVIVVDSRREVDEVKELIEIVREYVLGLRMELKRKELRDDVTRQQELAAYFTNCKLQRVHMRLVLASAMALCFKQKNYATAAHFARMLLENSPQEAQAKKARQVLQACHDKDDSHQLNYDFRNPFVVCGATYVPIYRGQKDVSCPYCGSRFVPSIEGQLCTICELAAVGADASGLLCSPTQSR

SEQ ID NO: 4124 - protein, 1218 aa, Zea mays
MLTKFETKSNRVKGLSFHPRRPWILASLHSGVIQMWDYRMGTLLDRFDEHDGPVRGVHFHATQPLFVSGGDDYKIKVWNYKTHRCLFTLHGHLDYIRTVQFHHEYPWIVSASDDQTIRIWNWQSRTCVAVLTGHNHYVMCASFHPKEDLVVSASLDQTVRVWDIGALRKKTVSPADDILRLTQMNTDLFGGVDAVVKYVLEGHDRGVNWASFHPTLPLIVSGADDRQVKLWRMNDTKAWEVDTLRGHMNNVSCVMFHAKQDIIVSNSEDKSIRIWDATKRTGIQTFRREHDRFWILAAHPEMNLLAAGHDSGMIVFKLERERPAFCVSGDTVFYLKDRFLRFFEYSTQKEVQVAPIRRPGSVSLNQSPRTLSYSPTENAVLICSDADGGSYELYIVPKDSAGRSDYLQEAKKGAGGSAVFVARNRFAVLEKSSNQVLVKNLKNEILKKSPLPIATDAIYYAGTGNLLCKGEDRVAIFDLQQRLVLGELQTPAIKYVVWSSDMESVALLSKHAVVIASKKLVHKCTLHETIRVKSGAWDENGVFIYTTLNHMKYCLPNGDSGIIKTLDVPIYITRVVGNNIFCLDRDGKNKLIAVDASEYIFKLALLRKRYDHVMSMIKNSQLCGQAVISYLQQKGFPEVALHFVKDEKTRFNLALESGNIQIAVASAKEIDDKDHWYKLGIEALRQGNVGIVEYAYQRTKNFERLAFLYLITGYLDKVGFMCKIAGQNNNLMGQFHNALYLGDAKKRVEILENAGQLPLAYVTAVTHGLTEIAERIASELGENVPSLPEGKSHSLLIPPAPLTACGDWPLLRVVRGIFEGGLDATGRADLEEDDEAAGADWGDEDLDIVDVSEVVANGGDGVDVEEGEPNEEDGEEGGWDLEDLELPPETETPKAVGNARSALFVAPTPGIPVSQIWTQRSSLAGEQAAAGNFDTAMRLLSRQLGIKNFVPLKPLFIDLHMGSHTYMCAFAAAPVISVAVEKGWNESASPNVRGPPALVFSFSQMEDRLKAAYKATTEGKFPEALRQFLSILHTIPVIVVDSRREVDEVKELIEIVREYVLGLRMELKRKELRDDVTRQQELAAYFTNCKLQRVHMRLVLASAMALCFKQKNYATAAHFARMLLENSPQEAQAKKARQVLQACQDKDDSHQLNYDFRNPFVVCGATYVPIYRGQKDVSCPYCGSRFVPSIEGQLCTICELGAVGADASGLLCSPTQSR

SEQ ID NO: 4125 - protein, 1218 aa, Sorghum bicolor
MLTKFETKSNRVKGLAFHPRRPWILSSLHSGVIQMWDYRMGTLLNRFDEHDGPVRGVHFHATQPLFVSGGDDYKIKVWNYKTQRCLFTLHGHLDYIRTVQFHHECPWIVSASDDQTIRIWNWQSRTCVAVLTGHNHYVMCASFHPKEDLVVSASLDQTVRVWDIGALRKKSASPADDILRLTQMNTDLFGGIDAVVKYVLEGHDRGVNWASFHPSLPLIVSGADDRQVKIWRMNDTKAWEVDTLRGHMNNVSCVLFHAKQDIIVSNSEDKSIRIWDATKRTGIQTFRREHDRFWILAAHPEMNLLAAGHDSGMIVFKLERERPAFCVSGDTVFYVKDRFLRFFEYSTQKEVQLAPIRRPGSVSLNQSPRTLSYSPTENAVLICSDADGGSYELYIVPKDSAGRSDYLQEAKKGAGGSAVFVARNRFAVLERSSNQVLVKNLKNEIMKKSPLPIATDAIYYAGTGNLLCKAEDRVAIFDLQQRLVLGELQTPAVKYVVWSSDMESVALLSKHAVVIASKKLVHQCTLHETTRVKSGAWDENGVFIYTTLNHMKYCLPNGDSGIIKTLDVPIYVTRVIGNNIFCLDRDGKNKLIAVDASEYIFKLALLRKRYDHVMSMIKNSQLCGQAVISYLQQKGFPEVALHFVKDEKTRFNLALESGNIQIAVASAKEIDDKDHWYRLGIEALRQGNVGIVEYAYQRTKNFERLAFLYLITGYLDKVGFMCKIAGQNNNLMGQFHNALYLGDAKKRIEILENAGQLPLAYVLAVTHGLTEIAERIAAELGENVPCLPEGKSHSLLIPPAPLTACGDWPLLRVMRGIFEGGLDATGRAELEEDDEASGADWGDEDLDIVDASEVVANGGDYFDAEEGEPNEEDGEEGGWDLEDLELPPDTETPKSAGNARSAVFVAPTAGIPVSQIWTQKSSLAGEHAAAGNFDTAMRLLSRQLGIKNFAPLKPLFLDLHMGSHSYLRALAAAPVISVAVEKGWNESASPNVRGPPALIFSFSQMEDRLKAAYKATTEGKFPEALRQFLNILHTIPVIVVDSRREVDEVKELIEIVREYILGLKMELKRKELRDDVTRQQELAAYFTNCKLQRIHMRLVLASAMALCFKQKNYATAKHFARMLLENSPQEAQARKARQVLQACQDKDDSHQLNYDFRNPFVVCGATYVPIYRGQKDISCPYCGSRFVPSIEGQLCTICELAIVGADASGLLCSPTQLK

SEQ ID NO: 4126 - protein, 1217 aa, Zea mays
MLTKFETKSNRVKGLAFHPRRPWILSSLHSGVVQMWDYRMGTLLNRFDEHDGPVRGVHFHATQPLFVSGGDDYKIKVWNYKTQRCLFTLHGHLDYIRTVQFHHECPWIVSASDDQTIRIWNWQSRTCVAVLTGHNHYVMCASFHPKEDLVVSASLDQTVRVWDIGALRKKSASPADDILRLTQMNTDLFGGIDAVVKYVLEGHDRGVNWASFHPTLPLIVSGADDRQVKIWRMNDTKAWEVDTLRGHMNNVSCVMFHAKQDIIVSNSEDKSIRVWDATKRTGIQTFRREHDRFWILAAHPEMNLLAAGHDSGMIVFKLERERPAFCVSGDTVFYVKDRFLKFFEYSTQKEVQLAPIRRPGSVSLNQSPRTLSYSPTENAVLICFDADGGSYELYIAPKDSAGKADYLQEAKKGAGGSAVFVARNRFAVLERSSNQVLVKNLKNEIMKKSPLPIATDAIYYAGTGNLLCKAEDRVAIFDLQQRLVLGELQTPAVKYIVWSSDMESVAFLSKHVVVIASKKLVHQCTLHETTRVKSGAWDENGVFIYTTLNHMKYCLPNGDSGIIKTLDVPIYITRVIGNNIFCLDRDGKNKLIAVDATEYIFKLALLRKRYDHVMSMIKNSQLCGQAVISYLQQKGFPEVALHFVKDEKTRFNLALESGNIQIAVASAKEIDDKDHWYRLGIEALRQGNVGIVEYAYQRTKSFERLAFLYLITGYLDKVGFMYKIAGQNNNLMGQFHNALYLGHVNKRVEILENAGQLPLAYVLAVTHGLTEIAERIAAELGEHVPLLPEGKSHSLLIPPAPLTACGDWPLLRVVRGIFEGGLDSTGRAELEEDDEASGADWGDEDLDIVDASEVVANGGDYFDAEGEPNEEEGEEGGWDLEDLELPPDTETPKSAGNARSPVFVTPTAGIPVSQIWTQKSSLAGEHAAAGNFDTAMRLLSRQLGIKNFAPLKPLFLDLHMGSHSYLRALAAAPVISVAVEKGWNESASPNVRGPPALIFSFSQMEDRLKAAYKATTEGRFPEALRQFLSILHTIPVIVVDSRREVDEVKELIEIVREYILGLKMELKRKELRDDVTRQQELAAYFTNCKLQRIHMRLVLSSAMALCFKQKNYATAAHFARMLLENSPQEAQARKARQVLQACQDKDDSHQLNYDFRNPFIVCGATYVPIYRGQKDISCPYCGSRFAPSIEGQLCTICELAIVGADASGLVCSPTQMK

SEQ ID NO: 4127 - protein, 1170 aa, Hordeum vulgare
DEHDGPVRGVHFHATQPLFVSGGDDYKIKVWNYKTHRCLFTLTGHLDYIRTVQFHHEYPWIVSASDDQTIRIWNWQSRTCVAVLTGHNHYVMCASFHPKEDLVVSASLDQTVRVWDIGALRKKTVSPADDIMRLTQMNTDLFGGVDAVVKYVLEGHDRGVNWASFHPTLPLIVSGADDRQVKLWRMNDTKAWEVDTLRGHMNNVSCVMFHAKQDIIVSNSEDKSIRIWDATKRTGIQTFRREHDRFWILAAHPEMNLLAAGHDSGMIVFKLERERPAFSVSADTVFYVKDRFLRFFEYSTQKEVQVAPIRRPGSVSLNQSPRTLSYSPTENAVLICSDVDGGSYDLYIVPKDSAGRADYLQEAKKGAGGSAVFVARNRFAVLEKSSNQVLVKNLKNEIVKKSPLPIATDAIYYAGTGSLLCKAEDRVTIFDLQQRLVLGELQAPGVKYVVWSGDMEYVALLSKHAVVIASKKLVHRSTLHETIRVKSGAWDENGVFIYSTLNHIKYCLPNGDSGIIKTLDVPVYITRVIGNNIFCLDRDGKNKLITVDASEYIFKLALLRKRYDHVMSMIKSSQLCGQAVISYLQQKGFPEVALHFVKDEKTRFNLALESGNIQIAVASAKEIDDKDHWYRLGIEALRQGNVGIVEYAYQRTKNFERLTFLYLITGYMDKVGFMCKIAGQNNNLMGQFHNALYLGDARKRAEILENAGQLPLAYVTAATHGLTEIAERLAAELGENVPSLPEGKTRSLLIPPAPLISSVDWPLLRVMRGIFEGGLDATGRAEVEEDDEAAGADWGDEDLDIVDASDALANGGDGFDPEEGEANEEDGEEGGWDLEDLELPESETPKAAGNARSTVFVAPAPGMPVSQIWTQKSSLAGEHAAAGNFDTAMRLLSRQLGIKNFAPLKPLFLDLHMGSHSYLRALATAPVISIAVEKGWSESSSPNVRGPPALIFTFSQMEDRLKAAYKATTEGKFPEALRQFLSILHTIPLIVVDSRREVDEVKELIEIVREYVLGLRMELKRKELKDNVNRQQELAAYFTNCKLQRVHMRLVLSNAMALCYKQKNFATAEHFARLLLENSPNEVQAKKARQVQQQCNGKQDSHELNYDYRNPFVVCGSTYVPIYRGQKDISCPYCGSRFVPATEGQLCTICELAVVGADASGLLCSPTQTR

SEQ ID NO: 4128 - protein, 1173 aa, Avena sativa
LLDRFDEHDGPVRGVHFHATQPLFVSGGDDYKIKVWNYKTHRCLFTLTGHLDYIRTVQFHHEYPWIVSASDDQTIRIWNWQSRTCVAVLTGHNHYVMCASFHPKEDLVVSASLDQTVRVWDIGALRKKTVSPADDIMRLTQMNTDLFGGVDAVVKYVLEGHDRGVNWASFHPTLPLIVSGADDRQVKLWRMNDTKAWEVDTLRGHMNNVSCVMFHAKQDIIVSNSEDKSIRIWDATKRTGIQTFRREHDRFWILAAHPEMNLLAAGHDSGMIVFKLERERPAFSVSADTVFYVKDRFLRFFEYSTQKEVQVAPIRRPGSVSLNQSPRTLSYSPTENAVLICSDVDGGSYDLYIVPKDSTGNLQEAKKGAGGSAVFVARNRFAVLEKSSNQVLVKNLKNEIVKKSPLPIATDAIYYAGTGNLLCKAEDRVTIFDLQQRLVLGELQAAGVKYVVWSTDMESVALLSKHAVVIASKKLVHRSTLHETIRVKSGAWDENGVFVYSTLNHIKYCLPNGDSGIIKTLDVPIYITRVIGNNIFCLDRDGKNKLITVDASEYIFKLALLRKRYDHVMSMIKSSQLCGQAVISYLQQKGFPEVALHFVKDEKTRFNLALESGNIQIAVASAKEIDDKDHWYRLGIEALRQGNVGIVEYAYQRTKNFERLAFLYLITGYLDKVGFMCKIAGQNNNLMGQFHNALYLGDARKRAEILENAGQLPLAYATAATHGLTEIADRLAAELGENIPSLPAGKSRSLLIPPAPLISSVDWPLLRVMRGTFEVGLDATGRAEVEEDDEAAPADWGEEDLDIVDASDAVPNGGGGFDPEEGEANEEDGEDGGWDLEDLELPPEADTPKAAGNARSSVFVAPTPGMPVSQIWTQKSSLAGEHAAAGNFDTAMRLLSRQFGIKNFTPLKPLFLDLHMGSHSYLRALAAAPVISVAVEKGWSESASPNVRGPPALVFSFSQMEDRLKAAYKATTEGKFPEALRQFLSILHTIPLIVVDSRREVDEVKELIEIVREYVLGLRMELKRKELKDNVNRQQELAAYFTNCKLQRVHMRLVLSNAMALCYKQKNFATAEHFARLLLENSPNEVQAKKARQVQQQCSGKQDSYELNYDYRNPFVVCGSTYVPIYRGQKDISCPYCSSRFVPSVEGQLCTICELAVVGADASGLLCCPTQQR

SEQ ID NO: 4129 - protein, 1218 aa, Brachypodium distachyon
MLTKFETKSNRVKGLSFHPRRPWILASLHSGVVQMWDYRMGTLLDRFDEHDGPVRGVHFHKTQPLFVSGGDDYKIKVWNYKTHRCLFTLHGHLDYIRTVQFHDEHPWIVSASDDQTIRIWNWQSRTCVAVLTGHNHYVMCASFHPKEDLVVSASLDQTVRVWDIGALRKKSSSPADDIMRLTQMNTDLFGGIDAVVKYVLEGHDRGVNWASFHPTLPLIISGADDRQVKLWRMNDTKAWEVDTLRGHMNNVSCVLFHAKQDIIVSNSEDKSIRVWDATKRTGIQTFRREHDRFWVLAAHPEMNLLAAGHDSGMIVFKLERERPAFSVSGDTVFYVKDRFLRFYEYSTQKEVQVAPIRRPGSVSLNQSPRTLSYSPTENAVLICSDVDGGSYELYIVPKDSAGRADYLQDAKKGAGGSAVFIARNRFAVLEKSSNQVLVKSLKNEIVKKSPLPIATDTIYYAGTGNILCKAEDRVAIFDLQQRLVIGELQASAVKYVVWSSDMESVALLSKHAVVIANKKLVHRCTLHETIRVKSGAWDENGVFIYSTLNHIKYCLPNGDSGIIRTLDVPIYITKVTGNNICCLDRDGKNKIIIVDASEYIFKLALLRKRYDHVMSMIKNSQLCGQAVISYLQQKGFPEVALHFVKDEKTRFNLALESGNIQIAVASAKELDDKDHWYRLGIEALRQGNVGIVEYAYQRTKNFDRLAFLYLLTGYLDKVGFMSKIAGQNNNLMGQFHNALYLGDVRKRVEILESAGQVPLAYVTAATHGLTEIADRLASELGENVPSLPEGKDRSLLIPPAPLTACGDWPLLRVMRGIFEGGLDATGRAEHEEDDEDIAGDWGDEDLEIVDVSNVVENGDVTGHVEGSEANEEDGEEEGGWDLEDLELPEAETPKATGPARSTLFVAPTPGMPVSQIWTQKSSLAGEHAAAGNYDTAMRLLSRQLGIRNFAPLKSLFLDAHMGSHTFLRAFASAPVIPVAVEKGWSESASPNVRGPPALVFSFSQMDDKLKAAYKATTEGKFPEALRQFLNILYTIPLLVVDSRREVDEVKELIEIVREYVLGLRMEVKRKELKDDATRQQELAAYFTNCKLQKVHMRLVLTSAMGLCFKGGNYATAANFARMLLENSPNEAQAKKARQVLQACGDRKDGHQLNYDFRNPFVVCGATFVPIYRGQKDISCPYCASRFVPSVEGQLCSICELSVVGADASGLLCSPTQSR

SEQ ID NO: 4130 - protein, 1218 aa, Hordeum vulgare
MLTKFETKSNRVKGLAFHPRRPWILASLHSGVVQMWDYRMGTLLDRFDEHDGPVRGVHFHKTQPLFVSGGDDYKIKVWNYKTHRCLFTLHGHLDYIRTVQFHDEHPWIVSASDDQTIRVWNWQSRTCVAVLTGHNHYVMCASFHPKEDLVVSASLDQTVRVWDIGALRKKSSSPADDIMRLTQMNTDLFGGIDAVVKYVLEGHDRGVNWASFHPTLPLIVSGADDRQVKLWRMNDTKAWEVDTLRGHMNNVSCVLFHAKQDIIVSNSEDKSIRVWDATKRTGIQTFRREHDRFWVLAAHPEMNLLAAGHDSGMIVFKLERERPAFAVSGDTVFYVKDRFLRFYEYSTQKEVQVAPIRRPGSVSLNQSPRTLSYSPTENAVLICSDVDGGSYELFIVPKDSAGRADYLQDAKKGSGGSAVFIARNRFAVLEKSSNQVLVKSLKNEIVKKSPLPIATDVIYYAGTGNILCRAEDRVAIFDLQQRLVLGELQASAVKYVIWSNDMESVALLSKHAVVIANKKLVHRCTLHETIRVKSGAWDENGVFIYSTLNHIKYCLPNGDSGIIKTLDVPIYITKVAGNTIAFLDRDGKNKIITVDASEYIFKLALLRKRYDHVMSMIKNSQLCGQAVISYLQQKGFPEVALHFVKDEKTRFNLALESGNIQIAVASAKELDDKDHWYRLGIEALRQGNVGIVEYAYQRTKNFDRLAFLYLLTGYLDKVGFMSKIAGQNNNLMGQFHNALYLGDAKKRVEILENAGQLPLAYVTAATHGLTEIADRLAGELGEDVPSLPEGKTRSLLIPPAPLTSCGDWPLLRVMRGIFEGGLDATGRAEQEEDYDDAGGDWGDEDLEIVDASAVIENGDAGHADESETNEEDGEEEGGWDLEDLELPPEADTPKATGAARSALFVAPTPGMPVSQIWTQKSSLAGEHAAAGNFDTAMRLLSRQLGIKNFAPLKALFLDAHMGSHTFLRAFASAPVIPVAVEKGWSESASPNVRGPPALVFSFAQMDDKLKAAYKATTEGKFPEALRQFLNILYTIPLLVVDSRREVDEVKELIEIVREYVLGLRMEVKRKELKNDATRQQELAAYFTNCKLQKVHMRLVLTSAMGLCFKGGNYATAANFARMLLDNGPNEAQAKKARQVLQACGDRKDAHQLNYDFRNPFVVCGATFVPIYRGQKDVSCPYCASRFVPSVEGQLCSICELSVVGADASGLLCSPTQSR

SEQ ID NO: 4131 - protein, 1218 aa, Secale cereale
MLTKFETKSNRVKGLAFHPRRPWILASLHSGVVQMWDYRMGTLLDRFDEHDGPVRGVHFHKTQPLFVSGGDDYKIKVWNYKTHRCLFTLHGHLDYIRTVQFHDEHPWIVSASDDQTIRVWNWQSRTCVAVLTGHNHYVMCASFHPKEDLVVSASLDQTVRVWDIGALRKKSSSPADDIMRLTQMNTDLFGGIDAVVKYVLEGHDRGVNWASFHPTLPLIVSGADDRQVKLWRMNDTKAWEVDTLRGHMNNVSCVLFHAKQDIIVSNSEDKSIRVWDATKRTGIQTFRREHDRFWVLAAHPEMNLLAAGHDSGMIVFKLERERPAFAVSGDTVFYVKDRFLRFYEYSTQKEVQVAPIRRPGSVSLNQSPRTLSYSPTENAVLICSDVDGGSYELFIVPKDSAGRADYLQDAKKGSGGSAVFIARNRFAVLEKSSNQVLVKSLKNEIVKKSPLPIATDVIYYAGTGNILCRAEDRVAIFDLQQRLVLGELQASAVKYVIWSNDMESVALLSKHAVVIANKKLVHRCTLHETIRVKSGAWDENGVFIYSTLNHIKYCLPNGDSGIIKTLDVPIYITKVAGNTIAFLDRDGKNKIITVDASEYIFKLALLRKRYDHVMSMIKNSQLCGQAVISYLQQKGFPEVALHFVKDEKTRFNLALESGNIQIAVASAKELDDKDHWYRLGIEALRQGNVGIVEYAYQRTKNFDRLAFLYLLTGYLDKVGFMSKIAGQNNNLMGQFHNALYLGDAKKRVEILENAGQLPLAYVTAATHGLTEIADRLAGELGEDVPSLPEGKTRSLLIPPAPLTACGDWPLLRVMRGIFEGGLDATGRAEQEEDYDDAGGDWGDEDLEIVDASNVIENGDAGHADESETNEEDGDEEGGWDLEDLELPPEADTPKARGPERSALFVAPTPGMPVSQIWTQKSSLAGEHAAAGNFDTAMRLLSRQLGIKNFAPLKALFLDAHMGSHTFLRAFASAPVIPVAVEKGWSESASPNVRGPPALVFSFAQMDDKLKAAYKATTEGKFPEALRQFLNILYTIPLLVVDSRREVDEVKELIEIVREYVLGLRMEVKRKELKNDATRQQELAAYFTNCKLQKVHMRLVLTSAMGLCFKGGNYATAANFARMLLDNGPNEAQAKKARQVLQACGDRKDAHQLNYDFRNPFVVCGATFVPIYRGQKDVSCPYCASRFVPSVEGQLCSICELSVVGADASGLLCSPTQSR

SEQ ID NO: 4132 - protein, 1218 aa, Triticum aestivum
MLTKFETKSNRVKGLAFHPRRPWILASLHSGVVQMWDYRMGTLLDRFDEHDGPVRGVHFHKTQPLFVSGGDDYKIKVWNYKTHRCLFTLHGHLDYIRTVQFHDEHPWIVSASDDQTIRVWNWQSRTCVAVLTGHNHYVMCASFHPKEDLVVSASLDQTVRVWDIGALRKKSSSPADDIMRLTQMNTDLFGGIDAVVKYVLEGHDRGVNWASFHPTLPLIVSGADDRQVKLWRMNDTKAWEVDTLRGHMNNVSCVLFHAKQDIIVSNSEDKSIRVWDATKRTGIQTFRREHDRFWVLAAHPEMNLLAAGHDSGMIVFKLERERPAFAVSGDTVFYVKDRFLRFYEYSTQKEVQVAPIRRPGSVSLNQSPRTLSYSPTENAVLICSDVDGGSYELFIVPKDSAGRADYLQDAKKGSGGSAVFIARNRFAVLEKSSNQVLVKSLKNEIVKKSPLPIGTDVIYYAGTGNVLCRAEDRVAIFDLQQRLVLGELQASAVKYVIWSNDMESVALLSKHAVVIANKKLVHRCTLHETIRVKSGAWDENGVFIYSTLNHIKYCLPNGDSGIIKTLDVPIYITKVAGNTIAFLDRDGKNKIITVDASEYIFKLALLRKRYDHVMSMIKNSQLCGQAVISYLQQKGFPEVALHFVKDEKTRFNLALESGNIQIAVASAKELDDKDHWYRLGIEALRQGNVGIVEYAYQRTKNFDRLAFLYLLTGYLDKVGFMSKIAGQNNNLMGQFHNALYLGDAKKRVEILENAGQLPLAYVTAATHGLTEIADRLAGELGEDVPSLPEGKTRSLLIPPAPLTACGDWPLLRVMRGIFEGGLDATGRAEQEEDYDDAGGDWGDEDLEIVDASNVIENGDAGHADESETNEEDGEEEGGWDLEDLELPPEADTPKARGPERSALFVAPTPGMPVSQIWTQKSSLAGEHAAAGNFDTAMRLLSRQLGIKNFAPLKALFLDAHMGSHTFLRAFASAPVIPIAVEKGWSESASPNVRGPPALVFSFAQMDDKLKAAYKATTEGKFPEALRQFLNILYTIPLLVVDSRREVDEVKELIEIVREYVLGLRMEVKRKELKNDATRQQELAAYFTNCKLQKVHMRLVLTSAMGLCFKGGNYATAANFARMLLDNGPNEAQAKKARQVLQACGDRKDAHQLNYDFRNPFVVCGATFVPIYRGQKDVSCPYCASRFVPSVEGQLCSICELSVVGADASGLLCSPTQSR

SEQ ID NO: 4133 - protein, 1220 aa, Avena sativa
MLTKFETKSNRVKGLAFHPRRPWILASLHSGVVQMWDYRMGTLLDRFDEHDGPVRGVHFHKTQPLFVSGGDDYKIKVWNYKTHRCLFTLHGHLDYIRTVQFHDEHPWIVSASDDQTIRVWNWQSRTCVAVLTGHNHYVMCASFHPKEDLVVSASLDQTVRVWDIGALRKKSSSPADDIMRLTQMNTDLFGGIDAVVKYVLEGHDRGVNWASFHPTLPLIVSGADDRQVKLWRMNDTKAWEVDTLRGHMNNVSCVLFHAKQDIIVSNSEDKSIRVWDATKRTGIQTFRREHDRFWVLAAHPEMNLLAAGHDSGMIVFKLERERPAFSVSGDTVFYVKDRFLRFYEYSAQKEVQVAPIRRPGSVTLNQSPRSLSYSPTENAVLICSDVDGGSYELYIVPKDSAGRADYLQDAKKGAGGSAVFIARNRFAVLEKSSNQVLVKSLKNEIVKKSPLPIATDAIYYAGTGNILCKAEDRVAIFDLQQRLVLGELQASAVKYVVWSSDMESVALLSKHAVVIANKKLVHRCTLHETIRVKSGAWDENGVFIYSTLNHIKYCLPNGDNGIIKTLDVPIYITRVAGNIICCLDRDGKNKMITIDASEYIFKLALLRKRYDHVMSMIKNSQLCGQAVISYLQQKGFPEVALHFVKDEKTRFNLALESGNIQIAVASAKELDDKDHWYRLGIEALRQGNVGIVEYAYQRTKNFDRLAFLYLITGYLDKVGFMSKIAGQNNNLMGQFHNALYLGDVRKRVEILENAGQLPLAYVTAATHGLPEIADRLANELGENVPALPEGKNSSLLIPPAPLIASSDWPLLRVMRGIFDGGLDATGRAEQEEDYEDAGAGGDWGDEDLEIVDVSNVVENGDAGHGEGSEANEEDGEEEGGWDLEDLELPPEADTPKATGPARSALFVAPTPGMPVSQIWTQKSSLAGEHAAAGNFDTAMRLLSRQLGIRNFAPLKTLFLDAHMGSHTFLRAFASAPVIPVAVEKGWTETASPNVRGPPALVFSFSQMDDKLKAAYKATTEGKFPEALRQFLNILYTIPLLVVDSRREVDEVKELIEIVREYVLGLRMEVKRKELKNDATRQQELAAYFTNCKLQKVHMRLVLTSAMGLCFKGGNYATAANFARMLLENSPNEAQAKKARQVLQACGDRKDAHQLNYDFRNPFVVCGATFVPIYRGQKDVSCPYCTSRFMPSVEGQLCTICELSVVGADASGLLCSPTQSR

SEQ ID NO: 4134 - protein, 1220 aa, Avena sativa
MLTKFETKSNRVKGLAFHPRRPWILASLHSGVVQMWDYRMGTLLDRFDEHDGPVRGVHFHKTQPLFVSGGDDYKIKVWNYKTHRCLFTLHGHLDYIRTVQFHDEHPWIVSASDDQTIRVWNWQSRTCVAVLTGHNHYVMCASFHPKEDLVVSASLDQTVRVWDIGALRKKSSSPADDILRLTQMNTDLFGGIDAVVKYVLEGHNRGVNWASFHPTLPLIVSGADDRQVKLWRMNDTKAWEVDTLRGHMNNVSCVLFHAKQDIIVSNSEDKSIRVWDATKRTGIQTFRREHDRFWVLAAHPEMNLLAAGHDSGMIVFKLERERPAFSVSGDTVFYVKDRFLRFYEYSAQKEVQVAPIRRPGSVTLNQSPRSLSYSPTENAVLICSDVDGGSYELYIVPKDSAGRADYLQDAKKGAGGSAVFIARNRFAVLEKSSNQVLVKSLKNEIVKKSPLPIATDAIYYAGTGNILCKAEDRVAIFDLQQRLVLGELQASAVKYVVWSSDMESVALLSKHAVVIANKKLVHRCTLHETIRVKSGAWDENGVFIYSTLNHIKYCLPNGDNGIIKTLDVPIYITRVAGNIICCLDRDGKNKMITIDASEYIFKLALLRKRYDHVMSMIKNSQLCGQAVISYLQQKGFPEVALHFVKDEKTRFNLALESGNIQIAVASAKELDDKDHWYRLGIEALRQGNVGIVEYAYQRTKNFDRLAFLYLITGYLDKVGFMSKIAGQNNNLMGQFHNALYLGDVRKRVEILENAGQLPLAYVTAATHGLPEIADRLASELGENVPALPEGKNSSLLIPPAPLIASSDWPLLRVMRGIFDGGLDATGRAEQEEDYEDAGAGGDWGDEDLEIVDVSNVVENGDAGHGEGSEANEEDGEEEGGWDLEDLELPPEADTPKATGPARSALFVAPTPGMPVSQIWTQKSSLAGEHAAAGNFDTAMRLLSRQLGIRNFAPLKTLFLDAHMGSHTFLRAFASAPVIPVAVEKGWTETASPNVRGPPALVFSFSQMDDKLKAAYKATTEGKFPEALRQFLNILYTIPLLVVDSRREVDEVKELIEIVREYVLGLRMEVKRKELKNDATRQQELAAYFTNCKLQKVHMRLVLTSAMGLCFKGGNYATAANFARMLLENSPNEAQAKKARQVLQACGDRKDAHQLNYDFRNPFVVCGATFVPIYRGQKDVSCPYCTSRFMPSVEGQLCTICELSVVGADASGLLCSPTQSR

SEQ ID NO: 4135 - protein, 986 aa, Secale cereale
MNDTKAWEVDTLRGHMNNVSCVLFHAKQDIIVSNSEDKSIRVWDATKRTGIQTFRREHDRFWVLAAHPEMNLLAAGHDSGMIVFKLERERPAFAVSGDTVFYVKDRFLRFYEYSTQKEVQVAPIRRPGSVSLNQSPRTLSYSPTENAVLICSDVDGGSYELFIVPKDSAGRADYLQDAKKGSGGSAVFIARNRFAVLEKSSNQVLVKSLKNEIVKKSPLPIATDVIYYAGTGNILCRAEDRVAIFDLQQRLVLGELQASAVKYVIWSNDMESVALLSKHAVVIANKKLVHRCTLHETIRVKSGAWDENGVFIYSTLNHIKYCLPNGDSGIIKTLDVPIYITKVAGNTIAFLDRDGKNKIITVDASEYIFKLALLRKRYDHVMSMIKNSQLCGQAVISYLQQKGFPEVALHFVKDEKTRFNLALESGNIQIAVASAKELDDKDHWYRLGIEALRQGNVGIVEYAYQRTKNFDRLAFLYLLTGYLDKVGFMSKIAGQNNNLMGQFHNALYLGDAKKRVEILENAGQLPLAYVTAATHGLTEIADRLAGELGEDVPSLPEGKTRSLLIPPAPLTACGDWPLLRVMRGIFEGGLDATGRAEQEEDYDDAGGDWGDEDLEIVDASNVIENGDAGHADESETNEEDGDEEGGWDLEDLELPPEADTPKARGPERSALFVAPTPGMPVSQIWTQKSSLAGEHAAAGNFDTAMRLLSRQLGIKNFAPLKALFLDAHMGSHTFLRAFASAPVIPVAVEKGWSESASPNVRGPPALVFSFAQMDDKLKAAYKATTEGKFPEALRQFLNILYTIPLLVVDSRREVDEVKELIEIVREYVLGLRMEVKRKELKNDATRQQELAAYFTNCKLQKVHMRLVLTSAMGLCFKGGNYATAANFARMLLDNGPNEAQAKKARQVLQACGDRKDAHQLNYDFRNPFVVCGATFVPIYRGQKDVSCPYCASRFVPLVEGQLCSICELSVVGADASGLLCSPTQSR

SEQ ID NO: 4136 - protein, 710 aa, Secale cereale
MLTKFETKSNRVKGLAFHPRRPWILASLHSGVVQMWDYRMGTLLDRFDEHDGPVRGVHFHKTQPLFVSGGDDYKIKVWNYKTHRCLFTLHGHLDYIRTVQFHDEHPWIVSASDDQTIRVWNWQSRTCVAVLTGHNHYVMCASFHPKEDLVVSASLDQTVRVWDIGALRKKSSSPADDIMRLTQMNTDLFGGIDAVVKYVLEGHDRGVNWASFHPTLPLIVSGADDRQVKLWRMNDTKAWEVDTLRGHMNNVSCVLFHAKQDIIVSNSEDKSIRVWDATKRTGIQTFRREHDRFWVLAAHPEMNLLAAGHDSGMIVFKLERERPAFAVSGDTVFYVKDRFLRFYEYSTQKEVQVAPIRRPGSVSLNQSPRTLSYSPTENAVLICSDVDGGSYELFIVPKDSAGRADYLQDAKKGSGGSAVFIARNRFAVLEKSSNQVLVKSLKNEIVKKSPLPIATDVIYYAGTGNILCRAEDRVAIFDLQQRLVLGELQASAVKYVIWSNDMESVALLSKHAVVIANKKLVHRCTLHETIRVKSGAWDENGVFIYSTLNHIKYCLPNGDSGIIQTLDVPIYITKVAGNTIAFLDRDGKNKIITVDASEYIFKLALLRKRYDHVMSMIKNSQLCGQAVISYLQQKGFPEVALHFVKDEKTRFNLALESGNIQIAVASAKELDDKDHWYRLGIEALRQGNVGIVEYAYQRTKNFDRLAFLTC

SEQ ID NO: 4137 - protein, 1220 aa, Avena sativa
MLTKFETKSNRVKGLAFHPRRPWILASLHSGVVQMWDYRMGTLLDRFDEHDGPVRGVHFHKTQPLFVSGGDDYKIKVWNYKTHRCLFTLHGHLDYIRTVQFHDEHPWIVSASDDQTIRVWNWQSRTCVAVLTGHNHYVMCASFHPKEDLVVSASLDQTVRVWDIGALRKKSSSPADDILRLTQMNTDLFGGIDAVVKYVLEGHNRGVNWASFHPTLPLIVSGADDRQVKLWRMNDTKAWEVDTLRGHMNNVSCVLFHAKQDIIVSNSEDKSIRVWDATKRTGIQTFRREHDRFWVLAAHPEMNLLAAGHDSGMIVFKLERERPAFSVSGDTVFYVKDRFLRFYEYSAQKEVQVAPIRRPGSVTLNQSPRSLSYSPTENAVLICSDVDGGSYELYIVPKDSAGRADYLQDAKKGAGGSAVFIARNRFAVLEKSSNQVLVKSLKNEIVKKSPLPIATDAIYYAGTGNILCKAEDRVAIFDLQQRLVLGELQASAVKYVVWSSDMESVALLSKHAVVIANKKLVHRCTLHETIRVKSGAWDENGVFMYSTLNHIKYCLPNGDNGIIKTLDVPIYITRVAGNIICCLDRDGKNKMITIDASEYIFKLALLRKRYDHVMSMIKNSQLCGQAVISYLQQKGFPEVALHFVKDEKTRFNLALESGNIQIAVASAKELDDKDHWYRLGIEALRQGNVGIVEYAYQRTKNFDRLAFLYLITGYLDKVGFMSKIAGQNNNLMGQFHNALYLGDVRKRVEILENAGQLPLAYVTAATHGLPEIADRLANELGENVPALPEGKNSSLLIPPAPLIASSDWPLLRVMRGIFDGGLDATGRAEQEEDYEDAGAGGDWGDEDLEIVDVSNVVENGDAGHGEGSEANEEDGEEEGGWDLEDLELPPEADTPKATGPARSALFVAPTPGMPVSQIWTQKSSLAGEHAAAGNFDTAMRLLSRQLGIRNFAPLKTLFLDAHMGSHTFLRAFASAPVIPVAVEKGWTETASPNVRGPPALVFSFSQMDDKLKAAYKATTEGKFPEALRQFLNILYTIPLLVVDSRREVDEVKELIEIVREYVLGLRMEVKRKELKNDATRQQELAAYFTNCKLQKVHMRLVLTSAMGLCFKGGNYATAANFARMLLENSPNEAQAKKARQVLQACGDRKDAHQLNYDFRNPFVVCGATFVPIYRGQKDVSCPYCTSRFMPSVEGQLCTICELSVVGADASGLLCSPTQSR

SEQ ID NO: 4138 - protein, 1219 aa, Brachypodium distachyon
MLTKFETKSNRVKGLAFHPRRPWILASLHSGVVQMWDYRMGTLLDRFDEHDGPVRGVHFHKTQPLFVSGGDDYKIKVWNYKTHRCLFTLHGHLDYIRTVQFHDEHPWIVSASDDQTIRIWNWQSRTCVAVLTGHNHYVMCASFHPKEDLVVSASLDQTVRVWDIGALRKKSASPADDIMRLTQMNTDLFGGIDAVVKYVLEGHDRGVNWASFHPTLPLIVSGADDRQVKLWRMNDTKAWEVDTLRGHMNNVSCVLFHAKQDIIVSNSEDKSIRVWDATKRTGIQTFRREHDRFWILAAHPEMNLLAAGHDSGMIVFKLERERPAFSVSGDTVFYVKDRFLRFYEYSTQKEVQVAPIRRPGSVSLNQSPRTLSHSPTENAVLICSDVDGGSYELYIVPKDSAGRADYLQDTKKGAGGSAVFIARNRFAVLEKSSNQVLVKSLKNEIVKKTPVPIATDAIYYAGTGNVLCKAEDRVAIFDLQQRLVIGELQVSAVKYVVWSSDMESVALLSKHAVVIANKKLVHRCTLHETIRVKSGAWDENGVFIYSTLNHIKYCLPNGDSGIIRTVDVPIYITRVAGNNICSLDRDGKNKIIMVDASEYIFKLALLRKRYDHVMSMIKSSQLCGQAVISYLQQKGFPEVALHFVKDEKTRFNLALESGNIQIAVASAKELDDKDHWYRLGIEALRQGNVGIVEYAYQRTKNFDRLAFLYLLTGYLDKVGFMSKIAGQNNNLMGQFHNALYLGDVRKRVEILESAGQVPLAYVTAATHGLTEIADRLASELGENVPSLPEGKGRSLLIPPAPLTACGDWPLLRVMRGIFEGGLDATGRAEQDEDYEDAGGDWGDEDLEIVDVSNVVENGDITVHVEENGTNEEDGEEEGGWDLEDLELPPEAETPKATGPSRSALFVVPTPGMPVSQIWTQKSSLAGEHAAAGNYDTAMRLLSRQLGIRNFAPLKALFLDAHMGSHTFLRAFASAPVIPVAVEKGWSESASPNVRGPPALVFSFSQMDDKLKAAYKATTEGKFPEALRQFLNILYTIPLLVVDSRREVDEVKELIEIVREYVLGLKMEVKRKELKDDATRQQELAAYFTNCKLQKVHMRLVLTSAMGLCFKGGNYATAANFARMLLENSPNEAQAKKARQVLQACGDRKDGHQLNYDFRNPFVVCGATFVPIYRGQKDVSCPYCASRFVPSVEGQLCSICELSVVGADASGLLCSPTQSR

SEQ ID NO: 4139 - protein, 1215 aa, Setaria italica
MLTKFETKSNRVKGLAFHPRRPWILASLHSGVIQMWDYRMGTLLDRFDEHDGPVRGVHFHATQPLFVSGGDDYKIKVWNYKTHRCLFTLHGHLDYIRTVQFHAEYPWIVSASDDQTIRIWNWQSRTCVAVLTGHNHYVMCASFHPKEDLVVSASLDQTVRVWDIGALRKKAVSPADDIMRLTQMNTDLFGGIDAVVKYVLEGHDRGVNWASFHPTLPLIVSGADDRQIKLWRMNDTKAWEVDTLRGHMNNVSCVMFHAKQDIIVSNSEDKSIRIWDATKRTGIQTFRREHDRFWILAAHPEMNLLAAGHDSGMIVFKLERERPAFSVSGDTVFYVKDRFLRYYEYSTQKEVQVAPIRRPGTVSLNQSPRTLSYSPTENAILICSDVDGGSYELYIVPKDSAGRSDYLQEARKGAGSSAVFIARNRFAVLEKSSNNVLVKNLKNEIVKKTSLPIATDGIYYAGTGNILCKAEDRVVIFDLQQRLVLGELQAPSVKYVVWSSDMECVALLSKHAIIIANKKLVHRCTLHETIRVKSGAWDENGVFIYTTLNHIKYCLPNGDSGIIRTLDVPIYITKVIGNNIFCIDRDGKNKLITVDASEYIFKLALFRKRYDHVMSMIKNSQLCGQAVISYLQQKGFPEVALHFVKDEKTRFNLALESGNIQIAVASAKELDDKDHWYRLGIEALRQGNVGIVEYAYQRTKNFDRLAFLYLITGYLDKVGFMCKIAGQNNNFMGQFHNALYLGDVRKRVEILENAGQLALAYVTAVTHGLTEIADRLSAELGENVPSVSDGKTSSLLIPPAPLMSCGDWPLLRVMRGIFDAGLDATGRADQEEDYDDAGGDWGDEDLEIVDVNNVVENGDVVDHNEEEEVNEEEGGWDLEDLELPPEAETPKAVGVARSTLFVAPTPGMPVSQIWTQKSSLAGEHAAAGNFDTAMRLLSRQLGIKNFAPLKPLFLDALMGSHTFLRAFASAPVIPVAVEKGWSESASPNVRGPPALVFTFSQMDDKLKAAYKATTEGKFPEALRQFLSILHTIPLLVVDSRREVDEVKELIQIAREYVLGLKMEVKRKELKEDPIRQQELAAYFTNCNLQKVHTRLVLTSAMGLCFKGGNYATAANFARMLLENNPNEAQAKKARQVVQACGDRKDGRQLNYDFRNPFVVCGATFVPIYRGQKDVSCPYCGSRFMPSVEGELCSICELSVVGADASGLLCSPTQSR

SEQ ID NO: 4140 - protein, 1190 aa, Secale cereale
HSGVVQMWDYRMGTLLDRFDEHDGPVRGVHFHKTQPLFVSGGDDYKIKVWNYKTHRCLFTLHGHLDYIRTVQFHDEHPWIVSASDDQTIRVWNWQSRTCVAVLTGHNHYVMCASFHPKEDLVVSASLDQTVRVWDIGALRKKSSSPADDIMRLTQMNTDLFGGIDAVVKYVLEGHDRGVNWASFHPTLPLIVSGADDRQVKLWRMNDTKAWEVDTLRGHMNNVSCVLFHAKQDIIVSNSEDKSIRVWDATKRTGIQTFRREHDRFWVLAAHPEMNLLAAGHDSGMIVFKLERERPAFAVSGDTVFYVKDRFLRFYEYSTQKEVQVAPIRRPGSVSLNQSPRTLSYSPTENAVLICSDVDGGSYELFIVPKDSAGRADYLQDAKKGSGGSAVFIARNRFAVLEKSSNQVLVKSLKNEIVKKSPLPIATDVIYYAGTGNILCRAEDRVAIFDLQQRLVLGELQASAVKYVIWSNDMESVALLSKHAVVIANKKLVHRCTLHETIRVKSGAWDENGVFIYSTLNHIKYCLPNGDSGIIKTLDVPIYITKVAGNTIAFLDRDGKNKIITVDASEYIFKLALLRKRYDHVMSMIKNSQLCGQAVISYLQQKGFPEVALHFVKDEKTRFNLALESGNIQIAVASAKELDDKDHWYRLGIEALRQGNVGIVEYAYQRTKNFDRLAFLYLLTGYLDKVGFMSKIAGQNNNLMGQFHNALYLGDAKKRVEILENAGQLPLAYVTAATHGLTEIADRLAGELGEDVPSLPEGKTRSLLIPPAPLTACGDWPLLRVMRGIFEGGLDATGRAEQEEDYDDAGGDWGDEDLEIVDASNVIENGDAGHADESETNEEDGDEEGGWDLEDLELPPEADTPKARGPERSALFVAPTPGMPVSQIWTQKSSLAGEHAAAGNFDTAMRLLSRQLGIKNFAPLKALFLDAHMGSHTFLRAFASAPVIPVAVEKGWSESASPNVRGPPALVFSFAQMDDKLKAAYKATTEGKFPEALRQFLNILYTIPLLVVDSRREVDEVKELIEIVREYVLGLRMEVKRKELKNDATRQQELAAYFTNCKLQKVHMRLVLTSAMGLCFKGGNYATAANFARMLLDNGPNEAQAKKARQVLQACGDRKDAHQLNYDFRNPFVVCGASFVPIYRGQKDVSCPYCASRFVPSVEGQLCSICELSVVGADASGLLCSPTQSR

SEQ ID NO: 4141 - protein, 1200 aa, Avena sativa
MLTKFETKSNRVKGLAFHPRRPWILASLHSGVVQMWDYRMGTLLDRFDEHDGPVRGVHFHKTQPLFVSGGDDYKIKVWNYKTHRCLFTLHGHLDYIRTVQFHDEHPWIVSASDDQTIRVWNWQSRTCVAVLTGHNHYVMCASFHPKEDLVVSASLDQTVRVWDIGALRKKSSSPADDIMRLTQMNTDLFGGIDAVVKYVLEGHDRGVNWASFHPTLPLIVSGADDRQVKLWRMNDTKAWEVDTLRGHMNNVSCVLFHAKQDIIVSNSEDKSIRVWDATKRTGIQTFRREHDRFWVLAAHPEMNLLAAGHDSGMIVFKLERERPAFSVSGDTVFYVKDRFLRFYEYSAQKEVQVAPIRRPGSVTLNQSPRSLSYSPTENAVLICSDVDGGSYELYIVPKDSAGRADYLQDAKKGAGGSAVFIARNRFAVLEKSSNQVLVKSLKNEIVKKSPLPIATDAIYYAGTGNILCKAEDRVAIFDLQQRLVLGELQASAVKYVVWSSDMESVALLSKHAVVIANKKLVHRCTLHETIRVKSGAWDENGVFIYSTLNHIKYCLPNGDNGIIKTLDVPIYITRVAGNIICCLDRDGKNKMITIDASEYIFKLALLRKRYDHVMSMIKNSQLCGQAVISYLQQKGFPEVALHFVKDEKTRFNLALESGNIQIAVASAKELDDKDHWYRLGIEALRQGNVGIVEYAYQRTKNFDRLAFLYLITGYLDKVGFMSKIAGQNNNLMGQFHNALYLGDVRKRVEILENAGQLPLAYVTAATHGLPEIADRLANELGENVPALPEGKNSSLLIPPAPLIASSDWPLLRVMRGIFDGGLDATGRAEQEEDYEDAGAGGDWGDEDLEIVDVSNVVENGDAGHGEGSEANEEDGEEEGGWDLEDLELPPEADTPKATGPARSALFVAPTPGMPVSQIWTQKSSLAGEHAAAGNFDTAMRLLSRQLGIRNFAPLKTLFLDAHMGSHTFLRAFASAPVIPVAVEKGWTETASPNVRGPPALVFSFSQMDDKLKAAYKATTEGKFPEALRQFLNILYTIPLLVVDSRREVDEVKELIEIVREYVLGLRMEVKRKELKNDATRQQELAAYFTNCKLQKVHMRLVLTSAMGLCFKGGNYATAANFARMLLENSPNEAQAKKARQVLQACGDRKDAHQLNYDFRNPFVVCGATFVPIYRGQKDVSCPYCTSRFHALRRGPALHHL

SEQ ID NO: 4142 - protein, 1148 aa, Triticum aestivum
GDDYKIKVWNYKTHRCLFTLHGHLDYIRTVQFHDEHPWIVSASDDQTIRVWNWQSRTCVAVLTGHNHYVMCASFHPKEDLVVSASLDQTVRVWDIGALRKKSSSPADDIMRLTQMNTDLFGGIDAVVKYVLEGHDRGVNWASFHPTLPLIVSGADDRQVKLWRMNDTKAWEVDTLRGHMNNVSCVLFHAKQDIIVSNSEDKSIRVWDATKRTGIQTFRREHDRFWVLAAHPEMNLLAAGHDSGMIVFKLERERPAFAVSGDTVFYVKDRFLRFYEYSTQKEVQVAPIRRPGSVSLNQSPRTLSYSPTENAVLICSDVDGGSYELFIVPKDSAGRADYLQDAKKGSGGSAVFIARNRFAVLEKSSNQVLVKSLKNEIVKKSPLPIGTDVIYYAGTGNVLCRAEDRVAIFDLQQRLVLGELQASAVKYVIWSNDMESVALLSKHAVVIANKKLVHRCTLHETIRVKSGAWDENGVFIYSTLNHIKYCLPNGDSGIIKTLDVPIYITKVAGNTIAFLDRDGKNKIITVDASEYIFKLALLRKRYDHVMSMIKNSQLCGQAVISYLQQKGFPEVALHFVKDEKTRFNLALESGNIQIAVASAKELDDKDHWYRLGIEALRQGNVGIVEYAYQRTKNFDRLAFLYLLTGYLDKVGFMSKIAGQNNNLMGQFHNALYLGDARKRAEILENAGQLPLAYVTAATHGLTEIAERLAAELGENVPSLPEGKTRSLLIPPAPLISSVDWPLLRVMRGIFEGGLDATGRAEVEEDDEAAGADWGDEDLDIVDASDAVANGGDGFDPEEGEANEEDGEEGGWDLEDLELPEPETPKAAGNARSTVFVAPTPGMPVSQIWTQKSSLAGEHAAAGNFDTAMRLLSRQLGIKNFAPLKPMFLDLHMGSHSYLRALATAPVISIAVEKGWSESSSPNVRGPPSLVFTFSQMEDRLKAAYKATTEGKFPEALRQFLSILHTIPLIVVDSRREVDEVKELIEIVREYVLGLRMELKRKELKDNVNRQQELAAYFTNCKLQRVHMRLVLSNAMALCYKQKNFATAEHFARLLLENSPNEVQAKKARQVQQQCNGKQDSHELNYDYRNPFVVCGSTYVPIYRGQKNISCPYCGSRFVPSIEGQLCTICELAVVGADASGLLCSPTQMR

SEQ ID NO: 4143 - protein, 1116 aa, Secale cereale
HHEYPWIVSASDDQTIRIWNWQSRTCVAVLTGHNHYVMCASFHPKEDLVVSASLDQTVRVWDIGALRKKTVSPADDIMRLTQMNTDLFGGVDAVVKYVLEGHDRGVNWASFHPTLPLIVSGADDRQVKLWRMNDTKAWEVDTLRGHMNNVSCVMFHAKQDIIVSNSEDKSIRIWDATKRTGIQTFRREHDRFWILAAHPEMNLLAAGHDSGMIVFKLERERPAFSVSADTVFYVKDRFLRFFEYSTQKEVQVAPIRRPGSVSLNQSPRTLSYSPTENAVLICSDVDGGSYDLYIVPKDSAGRADYLQEAKKGAGGSAVFVARNRFAVLEKSSNQVLVKNLKNEIVKKSPLPIATDAIYYAGTGNLLCKAEDRVTIFDLQQRLVLGELQSAGVKYVVWSSDMEHVALLSKHAVVIASKKLVHRSTLHETIRVKSGAWDENGIFIYSTLNHIKYCLPNGDSGIIKTLDVPVYITRVIGNNIFCLDRDGKNKLITVDASEYIFKLALLRKRYDHVMSMIKSSQLCGQAVISYLQQKGFPEVALHFVKDEKTRFNLALESGNIQIAVASAKEIDDKDHWYRLGIEALRQGNVGIVEYAYQRTKNFERLTFLYLITGYMDKVGFMCKIAGQNNNLMGQFHNALYLGDARKRAEILENAGQLPLAYVTAATHGLTEIAERLAAELGENVPSLPEGKTRSLLIPPAPLISSVDWPLLRVMRGIFEGGLDATGRAEVEEDDEAAGADWGDEDLDIVDASDAVANGGDGFDPEEGEANEEDGEEGGWDLEDLELPESETPKAAGNARSTVFVAPTLGMPVSQIWTQKSSLAGEHAAAGNFDTAMRLLSRQLGIKNFAPLKPMFLDLHMGSHSYLRALATAPVISIAVEKGWSESSSPNVRGPPSLVFTFSQMEDRLKAAYKATTEGKFPEALRQFLSILHTIPLIVVDSRREVDEVKELVEIVREYVLGLRMELKRKELKDNVNRQQELAAYFTNCKLQRVHMRLVLSNAMALCYKQKNFATAEHFARLLLENSPNEVQAKKARQVQQQCNGKQDSHELNYDYRNPFVVCGSTYVPIYRGQKDISCPYCGSRFVPAIEGQLCTICELAVVGADASGLLCSPTQTR

SEQ ID NO: 4144 - protein, 1218 aa, Elaeis guineensis
MLTKFETKSNRVKGLSFHSKRPWILASLHSGVIQLWDYRMGTLIDRFDEHDGPVRGVHFHKSQPLFVSGGDDYKIKVWNYKTHRCLFTLLGHLDYIRTVQFHDEYPWIVSASDDQTIRIWNWQSRTCISVLTGHNHYVMCASFHPKEDLVVSASLDQTVRVWDIGALRKKTVSPADDILRLSQMNTDLFGGVDAVVKYVLEGHDRGVNWASFHPSLPLIVSGADDRQVKLWRMNDTKAWEVDTLRGHMNNVSCVMFHAKQDIIVSNSEDKSIRIWDATKRTGIQTFRREHDRFWILTAHPEMNLLAAGHDSGMIVFKLERERPAFSVSGDTLFYVKDRFLRFYEFSSQKDNQVVPIRRPGSVSLNQGPRTLSYSPTENAVLLCSDVDGGSYELYIVPKDSAGRGDYMQEAKKGAGGSAVFVARNRFAVLDKSNNQALVKNLKNEIVKKSLLPVVTDAIFYAGTGNLLCRAEDRVVIFDLQQRLILGELQTPSVKYIVWSSDMESIALLSKHAIVIASKKLVHRCTLHETIRVKSGAWDENGVFLYTTLNHIKYCLPNGDSGIVRTLDVPVYITKVSGSNIYCLDRDGRNRVISIDATEYIFKLALLRKRYDHVMSMIRNSQLCGQAVIAYLQQKGFPEVALHFVKDERTRFNLALESGNIQIAVASAKEIDEKDYWYRLGIEALRQGNTSIVEYAYQRTKNFERLSFLYLVTGNMEKLSKMLRIAEIKNDVMGQFHNAMYLGDIEERVKILENAGHLPLAYVTAATHGLTDVADRLAAELGDNIPSIPEGKVSSLLMPPRPLMCSGDWPLLRVMRGIFEGGLDSLGRTGNEEEEEASGADWGDEDLDIVDVEGVIQNGDIVAEVEDGEANEENDEEGGWDLEDLELPPDVDTPKANPNARSSLFVAPTPGMPVSQIWIQKSSLAGEHVAAGNFDTAMRLLSRQLGIKNFAPLKPLFMDLYVGSHTYLRAFATVPVISTAVEKGWNESASPNVRGPPALVFKFSQMDEKLKAAYRVTTEGKFPEALRQFLSILHTIPLMVVDSRREVDEVKELIEIAREYVLGLKIEVKRKEMKDNAIRQQELAAYFTNCKLQKIHMRLVLASAMSSCYRGGSFATAANFARMLLENSPPEAQAKKARQVLQACGDKKDTNQLNYDFRNPFVVCGATFVPIYRGQKDVSCPYCGARFVPAIEGQICAVCELAVVGADASGLLCSPTQTR

SEQ ID NO: 4145 - protein, 1219 aa, Ananas comosus
MLTKFETKSNRVKGLSFHSKRPWILASLHSGVIQLWDYRMGTLIDRFDEHDGPVRGVHFHKTQPLFVSGGDDYKIKVWNYKTHRCLFTLLGHLDYIRTVQFHDEYPWIVSASDDQTIRIWNWQSRTCISVLTGHNHYVMCASFHPKEDLVVSASLDQTVRVWDIGALRKKTVSPADDMLKLSQMNADLFGGVDVVVKYVLEGHDRGVNWASFHPTLPLIVSGADDRQVKLWRMNDTKAWEVDTLRGHMNNVSCVMFHAKQDIIVSNSEDKSIRIWDATKRTGIQTFRREHDRFWILAAHPEMNLLAAGHDSGMIVFKLERERPAFSLSGDTLYYVKDRFLRVYEFSTQKDTQVVPIRRPGSVCLNQAPRTLSYSPTENAVLICSDVDGGSYELYIVPKEVAGRADYIQEAKKGAGASAVFVARNRFAVLEKSNNQVLVKNLKNEIVKKSALPFATDAIFYAGTGSLLCRAEDRVLIFDLQQRMVLGELQTPAVKYVVWSSDMESVALLSKHAIVITNKKLVHRCTLHETIRVKSGAWDENGVFIYTTLNHIKYCLPNGDSGIIKTLDVPIYLTRVSGNVIYCLDRDGKSRVISIDASEYIFKLALLRKRYDHVMGMIKNSQLCGQAVIAYLQQKGFPEVALHFVKDERTRFNLAVESGNIQIAVASAKEIDEKDYWYRLGIEALRQGNTSIVEYAYQRTKNFERLSFLYLVTGNMDKLSKMLKIAEIKNDVMGQFHNAMYLGDIRERVKILENVGHFPLAYVTAATHGLNEEAERLKAELGDNVPSIPEGKTSSLLMPPLPLMCSGDWPLLRVMRGIFEGGLDTLGRAGHDEEEEEADGAEWGDAELDIADVEGMIQNGDVTAEADEDEVNEENDEEGGWDLEDLELPPELETPKASANSRSTLFVAPTPGMPVSQIWTQKSSLAGEHAAAGNYDTAMCLLSRQLGIKNFAPLKPLFLDLYTGSHTYLQAFATAPVFSLPVEKGWTESASPNVRNPPALPFKFSQMDEKLKLAYRATTEGKFPEALRQFLNILHTMPLIVVDSRREVDEVKELIEIAREYVLGLKIEVKRKEIKDNVIRQQELAAYFTNCKLQKIHMRLVLTSAMTICFKGGNYATAANFARMLLENSPSEAQAKKARQVLQACGDKKDANQLNYDYRNPFVVCGATFVPIYRGQKDISCPYCGSRFMPAIEGQICTVCELAVVGADASGLLCSPSQSR

SEQ ID NO: 4146 - protein, 1219 aa, Ananas comosus
MLTKFETKSNRVKGLSFHSKRPWILASLHSGVIQLWDYRMGTLIDRFDEHDGPVRGVHFHKTQPLFVSGGDDYKIKVWNYKTHRCLFTLLGHLDYIRTVQFHDEYPWIVSASDDQTIRIWNWQSRTCISVLTGHNHYVMCASFHPKEDLVVSASLDQTVRVWDIGALRKKTVSPADDMLKLSQMNADLFGGVDVVVKYVLEGHDRGVNWASFHPTLPLIVSGADDRQVKLWRMNDTKAWEVDTLRGHMNNVSCVMFHAKQDIIVSNSEDKSIRIWDATKRTGIQTFRREHDRFWILAAHPEMNLLAAGHDSGMIVFKLERERPAFSLSGDTLYYVKDRFLRVYEFSTQKDTQVVPIRRPGSVCLNQAPRTLSYSPTENAVLICSDVDGGSYELYIVPKEAAGRADYIQEAKKGAGASAVFVARNRFAVLEKSNNQVLVKNLKNEIVKKSALPFATDAIFYAGTGSLLCRAEDRVLIFDLQQRMVLGELQTPAVKYVVWSSDMESVALLSKHAIVITNKKLVHRCTLHETIRVKSGAWDENGVFIYTTLNHIKYCLPNGDSGIIKTLDVPIYLTRVSGNVIYCLDRDGKSRVISIDASEYIFKLALLRKRYDHVMGMIKNSQLCGQAVIAYLQQKGFPEVALHFVKDERTRFNLAVESGNIQIAVASAKEIDEKDYWYRLGIEALRQGNTSIVEYAYQRTKNFERLSFLYLVTGNMDKLSKMLKIAEIKNDVMGQFHNAMYLGDIRERVKILENVGHFPLAYVTAATHRLNEEAERLKAELGDNVPSIPEGKTSSLLMPPLPLMCSGDWPLLRVMRGIFEGGLDTLGRAGHDEEEEEADGAEWGDAELDIADVEGMIQNGDVTAEADEDEVNEENDEEGGWDLEDLELPPELETPKASANSRSTLFVAPTPGMPVSQIWTQKSSLAGEHAAAGNYDTAMCLLSRQLGIKNFAPLKPLFLDLYTGSHTYLQAFATAPVFSLPVEKGWTESASPNVRNPPALPFKFSQMDEKLKLAYRATTEGKFPEALRQFLNILHTMPLIVVDSRREVDEVKELIEIAREYVLGLKIEVKRKEIKDNVVRQQELAAYFTNCKLQKIHMRLVLTSAVTICFKGGNYATAANFARMLLENSPSEAQAKKARQVLQACGDKKDANQLNYDYRNPFVVCGATFVPIYRGQKDISCPYCGSRFMPAIEGQICTVCELAVVGADASGLLCSPSQSR

SEQ ID NO: 4147 - protein, 1216 aa, Musa acuminata
MLTKFETKSNRVKGLSFHSKRPWVLASLHSGVIQLWDYRMGTLIDRFDEHDGPVRGVHFHKSQPLFVSGGDDYKIKVWNYKTHRCLFTLLGHLDYIRTVQFHDEHPWIVSASDDQTIRIWNWQSRTCISVLTGHNHYVMCASFHPKEDLVVSASLDQTIRVWDIGALRKKVAPADDILRLSQMNTDLFGGIDAVVKYVLEGHDRGVNWASFHPTLPLIVSGADDRQVKLWRMNDSKAWEVDTLRGHTNNVSCVMFHAKMEVIVSNSEDKSIRIWDANKRTGIQTIRREHDRFWILSAHPEMNLLAAGHDSGMIVFKLERERPAFSVSGDTLFYVKDRFLRLYEFSTQKDNQVVPIRKPGSVSLNQGPRTLSYSPTENAVLICSDVDGGTYELYIVPKDASGRSDYMQEAKKGAGGSAVFIARNRFAVLDRSSNQVVVKNLKNEIVKKGLLPVASDAIFYAGTGNVLCRAEDRVAIFDLQQRVVLGELQTPSVKYVIWSSDMESVALLSKHAIVIANKKLVHRCTLHETIRIKSGAWDDNGVFIYTTLNHIKYCLPNGDSGIIRTLEIPIYITKVSGSNIYCLDRDGKNQVISIDATEYIFKLSLLRKRYDLVMSMIRNSQLCGQAVIAYLQQKGFPEVALHFVKDEKTRFNLALESGNIQIAVASAKEIDDKDHWYKLGIEALRQGNTSIVEYAYQRTKNFERLSFLYLITGNTEKLSKMLKIAEIKNDIMGQFHNALYLGDIQERVKILENAGHLPLAYVTAATHGLKEVADRLATELGENVPSLPEGKPRSLLLPPAPLMCCGDWPLLRVMRGIFDNGLDLGRAGQEEEEDAPGADWGDEELDIVDIEGAMQNGDIVADIEDGEAIEENEEEGGWDLEDLELPADVDTPKAAGNSRSSLFVAPTPGMPVSQIWIQKSSLAGEHVAAGNFDTAMRLLSRQLAIKNFAPLKPSFMDLHAGSHTYLRALSTAPVISFAVEKGWSESASPNVRGPPALVFKFSQMDEKLKAAYRATTEGKFPDALRQFLNILHTIPLIVVDSRREVDEVKELIEIAREYVLGLKIELQRKEIKDNLVRQQELAAYFTNCKLQKIHMRLVLTSAMTICYKGGNCSTAANFARMLLENSPTEVQAKKARQLLQHCGDKKDVNQLNYDYRNPFVVCGATFVPIYRGQKDVSCPYCGARFVPTIEGQLCAVCELAVVGADASGLLCSPTQIR

SEQ ID NO: 4148 - protein, 1217 aa, Cocos nucifera
MLTKFETKSNRVKGLSFHSKRPWILASLHSGVIQLWDYRMGTLIDRFDEHDGPVRGVHFHKSQPLFVSGGDDYKIKVWNYKTHRCLFTLLGHLDYIRTVQFHDEYPWIVSASDDQTIRIWNWQSRTCISVLTGHNHYVMCASFHPKEDLVVSASLDQTVRVWDIGALRKKTVSPADDILRLSQMNTDLFGGVDAVVKYVLEGHDRGVNWASFHPSLPLIVSGADDRQVKLWRMNDTKAWEVDTLRGHMNNVSCVMFHAKQDIIVSNSEDKSIRIWDATKRTGIQTFRREHDRFWILTAHPEMNLLAAGHDSGMIVFKLERERPAFSVSGDTLFYVKDRFLRFYEFSSQKDNQVVPIRRPGSVSLNQGPRTLSYSPTENAVLLCSDVDGGSYELYIVPKDSAGRGDYMQEAKKGAGGSAVFVARNRFAVLDKSNNQALVKNLKNEIVKKSLLPIATDAIFYAGTGNLLCRAEDRVVIFDLQQRLILGELQTPSVKYIVWSSDMESVALLSKHAIVIASKKLVHRCTLHETIRVKSGAWDENGIFLYTTLNHIKYCLPNGDSGIVRTLDVPVYITKVSGSNIYCLDRDGRNRVISIDATEYIFKLALLRKRYDHVMSMIRNSQLCGQAVIAYLQQKGFPEVALHFVKDERPRFNLALESGTIQIAVASAKEIDEKDYWYRLGIEALRQGNTSIGEYAYQRTKNFERLSFLYLVTGNVEQLSKMLRIAEIKNDVMGQFHNAMYLGDVEERVKILENAGHLPVAYVTAAPHGLAEVADRLAAELGDNVPSIPEGKDSSLLMPPQPLMCSGDWPLLRVMQGIFEGELDNLGRAGHEEEEATGADWGDEDLDIVDVESMIPNGDIVAEVEDGEVNEENDEEGGWDLEDLELPPDMETPKASTNVHSPLFVAPTPGMPVSQIWIQKSSLAGEHVAAGNFDTAMHLLNRQLGIKNFAPLKPLFVDLYEGSHTYLRAFATAPVISIAVEKGWTESAGPNVRGPPALVFKFSQMDEKLKAAYRVTTEGKFPEALRQFLGILYTIPLLVVDSRREVDEVKELIEIAREYVLGLKMEVKRKEIKDNAIRQQELAAYFTNCKLQKIHMRLVLASAMSSCYKGGNFATAANFARMLLENSPTEAQSKKARQVLQACSDKKDANQLNFDYRNPFVVCGATFVPIYRGQKDISCPYCGARFVQATEGQICAVCELAVVGADASGLLCSPIQAR

SEQ ID NO: 4149 - protein, 1217 aa, Elaeis guineensis
MLTKFETKSNRVKGLTFHSKRPWILASLHSGVIQLWDYRMGTLIDRFDEHDGPVRGVHFHKSQPLFVSGGDDYKIKVWNYKTHRCLFTLLGHLDYIRTVQFHDEYPWIVSASDDQTIRIWNWQSRTCISVLTGHNHYVMCASFHPKEDLVVSASLDQTVRVWDIGALRKKTVSPADDILRLSQMNTDLFGGVDAVVKYVLEGHDRGVNWASFHPSLPLIVSGADDRQLKLWRMNDTKAWEVDTLRGHMNNVSCVMFHAKQDVIVSNSEDKSIRIWDATKRTGIQTFRREHDRFWILAAHPELNLLAAGHDSGMIVFKLERERPAFSVSGDTLYYVKDRFLRFYEFSAQKDNQVVPIRRPGSVSLNQGPRTLSYSPTENAVLLCSDADGGSYELYIVPRDSAGRADYVQEARKGSGGSAVFVARNRFAVLDKSNNQALVKNLKNEIVKKSPLPVATDAIFYAGTGNLLCRAEDRVVIFDLQQRLVLGELQTPSVKYVVWSSDMESIALLSKHAIVIASKKLTHRCTLHETIRVKSGAWDENGVFIYTTLNHIKYCLPNGDSGIVRTLDVPIYITKVSGSSIYCLDRDGKNRVISIDATEYIFKLALLRKRYDHVMSMIRHSQLCGQAVIAYLQQKGFPEVALHFVKDERTRFNLALESGNIQIAVASAKEIDEKDYWYRLGIEALRQGNTSIMEYAYQRTKNFERLSFLYLVTGNMEKLSKMLRIAEIKNDVMGQFHNAMYLGDVQERVTILERAGQLPLAYVTAATHGLAEVADRLAAELGDNVPFIPEGKVSSLLMPSKPLMCSGDWPLLRVMRGIFEGELDNLGRAEHEEEEATGADWGDEDLDIVDVEGVIQNGDVVAEVEDGEANEENDEEGGWDLEDLELPPDMETPKASTNARSSLFVAPTPGMPVSQIWIQKSSLAGEHVAAGNFDTAVRLLSRQLGIKNFAPLRPLFVDLYEGSHTYLHAFATAPVISIAVEKGWTESASPNVRGPPALVFKFSQMDEKLKAAYRVTTEGKFPEALRQFLNILHTIPLLVVDSRREVDEVKELIQIAREYVLGLKMEVKRKEIKDNAIRQQELAAYFTNCKLQKIHMRLVVASAMSSCYRGGNFATAANFARMLLENSPTEAQAKKARQVLQACGDKKDTSQLNYDYRNPFVVCGATFVPIYRGQKDISCPYCAARFMPATEGQICAVCELSVVGADASGLLCSPTQTR

SEQ ID NO: 4150 - protein, 492 aa, Cocos nucifera
MLTKFETKSNRVKGLSFHSKRPWILASLHSGVIQLWDYRMGTLIDRFDEHDGPVRGVHFHKSQPLFVSGGDDYKIKVWNYKTHRCLFTLLGHLDYIRTVQFHDEYPWIVSASDDQTIRIWNWQSRTCISVLTGHNHYVMCASFHPKEDLVVSASLDQTIRVWDIGALRKKTVSPADDILRLSQMNTDLFGGVDAVVKYVLEGHDRGVNWASFHPSLPLIVSGADDRQLKIWRMNDTKAWEVDTLRGHMNNVSCVMFHAKQDIIVSNSEDKSIRIWDATKRTGIQTFRRDHDRFWILAAHPELNLLAAGHDGGMIVFKLERERPAFSVSGDTLYYVKDRFLRFYEFSTQKDNQVVPIRRPGSVNLNQGPRTLSYSPTENAVLLCSDADGGSYELYIVPRDSAGRGDYMQEARKGSGGSAVFVARNRFAVLDKSNNQALVKNLKNEIVKKALFLLLLMRYSMPGQAICCVGLMIGWSSLISNRGWFLGNFRPHL

SEQ ID NO: 4151 - protein, 1217 aa, Elaeis guineensis
MLTKFETKSNRVKGLSFHSKRPWILASLHSGVIQLWDYRMGTLIDRFDEHDGPVRGVHFHKSQPLFVSGGDDYKIKVWNYKTHRCLFTLLGHLDYIRTVQFHDEYPWIVSASDDQTIRIWNWQSRTCISVLTGHNHYVMCASFHPKEDLVVSASLDQTVRVWDIGALRKKTVSPADDILRLSQMNTDLFGGVDAVVKYVLEGHDRGVNWASFHPSLPLIVSGADDRQLKLWRMNDTKAWEVDTLRGHMNNVSCVMFHAKQDIIVSNSEDKSIRIWDATKRTGIQTFRREHDRFWILAAHPEMNLLAAGHDSGLIVFKLERERPAFSVSGDTLYYVKDRFLRFYEFSAHKDNQVVPIRRPGSVSLNQGPRTLSYSPTENAVLLCSDVDGGSYELYIVPKDSAGRGDCVLEARKGSGASAVFIARNRFAVLDKSNNQALVKNLKNEIVKKSSLPVATDAIFYAGTGNLLCRAEDRVVIFDLQQRLVLGELQTPSVKYVVWSSDMESVALLSKHAIVIASKKLTHRCMLHETIRVKSGAWDENGVFIYTTLNHIKYCLPNGDSGIVRTIDVPIYITNVSGSSIYCLDRDGKNRVISIDATEYIFKLALLRKRYDHVMSMIRHSQLCGQAVIAYLQQKGFPEVALHFVKDERTRFNLALESGNIQIAVASAKEIDEKDYWYRLGIEALRQGNTSIMEYAYQKTKNFERLSFLYLVTGNMEKLSKMLRIAEIKNDVMGQFHNAMYLGDVQERVTILERTGHLPLAYVTAATHGLAEVADRLAAELGDNVPSVPEGKVSSLLMPPQPLMCSGDWPLLRVMRGIFEGELENLGRAGHEEEEATGADWGDEDLDIVDVEGLIPNGDIVAEVEDGEAHEENDEEGGWDLEELELPPDMETPKASTNARSPLFVAPTPGMPVSQIWVQKSSLAGDHVAAGNFDTAMRLLSRQLGIKNFAPLKPSFVDLYEGSHTYLRAFPTAPVILIAVEKGWTESASPNVRGPPELVFKFSQMDEKLKAAYRVTTEGKFPEALRQFLGILHTIPLLVVDSRREVDEVKELIEIVREYVLGLKMEVQRKEIKDDAIRQQELAAYFTNCKLQKIHMRLVLASAMSSCYRGGNFATAANFARMLLENSPTEAQSKKARQVLQACSDKKDTNQLNYDYRNPFVVCGATFVPIYRGQKDICCPYCGARFVPATEGQICAVCELAVVGADASGLLCSPMQTR

SEQ ID NO: 4152 - protein, 1216 aa, Musa acuminata
MLTKFETKSNRVKGLSFHSKRPWILASLHSGVIQLWDYRMGTLIDRFDEHDGPVRGVHFHKSQPLFVSGGDDYKIKVWNYKTHRCLFTLLGHLDYIRTVQFHDEHPWIVSASDDQTIRIWNWQSRTCISVLTGHNHYVMCALFHPKEDLVVSASLDQTVRVWDISALRKRVSPAEDILRLSQMNTDLFGGTDAVVKYVLEGHDRGVNWASFHPTLPLIVSGADDRQVKLWRMNDSKAWEVDTLRGHMNNVSCVMFHAKQDIIVSNSEDKSIRIWDATKRTGIQTFRREHDRFWILAAHPEMNLLAAGHDSGMIVFKLERERPAFSVSGDALYYVKDRFLRFYEFSSQKDSQVVPIRRPGSVSLNQGPRTLSFSPTENAVLICSDADGGSYELYIVPKDTSGRGDYMQDARKGAGASAVFVARNRFAVLDKSNNQAIVKNLKNEIVKKSPLPVGTDAIFYAGTGNLLCRAEDRVAIFDLQQRIVLGELQTPSIKYIVWSSDMESVALLAKHAIVIANKKLVHRYTLHETIRVKSGAWDDNGVFIYTTLNHIKYCLPNGDSGIIKTLDVLIYITKVSGSNIYCLDRDGKNRVISIDSTEYIFKLSLFRKRYDHVMSMIRNSQLCGQAVISYLQQKGFPEVALHFVKDEKTRFNLALESGNIQIAVAAAKEIDDKDHWYRLGIEALRQGNTSIVEYAYQRTKNFERLSFLYLVTGNMEKLSKMLKIAEMKNDVMGQFHNAMYLGDVQERVNILENSGHLPLAYVTAVTHGLKEVADRLSAELGENVPSLPEGKVRSLLMPPASLMCCGDWPLLRVMRGIFDNGLDTVRAGNEEEEEATGADWGDEELDIVDMEAVMQNADDVVAELEEGVANEDNEEGGWDLEDLELPPDADTPKAAGNARSSLFVAPTPGMPVSQIWIQKSSLAGEHVAAGNFDTAMRLLSRQLGIRNFAPMKPLFMDVFVGSHTYMHAFATTPAISTAVEKGWSESDSPNVRGPPALVFKFSQMDEKLKAAYRATTDGKFPEALRQFLNILHTIPLIVVESRREVDEVKELIEIAREYVLGLKMEVQRKEIKVNSVQQQELAAYFTNCKLQKIHMRLVLTNAMTICYKGGNYATAANFARMLLENRPTEIQAKKARQVLQHAGDKNDANQLNYDYRNPFVVCGATFVPIYRGQKDVSCPYCGARFVPAIEGQLCSVCELAVVGSDASGLLCSPTQAR

SEQ ID NO: 4153 - protein, 1216 aa, Musa acuminata
MLTKFETKSNRVKGLSFHSKRPWILASLHSGVIQLWDYRMGTLIDRFDEHDGPVRGVHFHKSQPLFVSGGDDYKIKVWNYKTHRCLFTLLGHLDYIRTVQFHDEHPWIVSASDDQTIRIWNWQSRTCISVLTGHNHYVMCALFHPKEDLVVSASLDQTVRVWDISALRKRVSPAEDILRLSQMNTDLFGGTDAVVKYVLEGHDRGVNWASFHPTLPLIVSGADDRQVKLWRMNDSKAWEVDTLRGHMNNVSCVMFHAKQDIIVSNSEDKSIRIWDATKRTGIQTFRREHDRFWILAAHPEMNLLAAGHDSGMIVFKLERERPAFSVSGDALYYVKDRFLRFYEFSSQKDSQVVPIRRPGSVSLNQGPRTLSFSPTENAVLICSDADGGSYELYIVPKDTSGRGDYMQDARKGAGASAVFVARNRFAVLDKSNNQAIVKNLKNEIVKKSPLPVGTDAIFYAGTGNLLCRAEDRVAIFDLQQRIVLGELQTPSIKYIVWSSDMESVALLAKHAIVIANKKLVHRYTLHETIRVKSGAWDDNGVFIYTTLNHIKYCLPNGDSGIIKTLDVLIYITKVSGSNIYCLDRDGKNRVISIDSTEYIFKLSLFRKRYDHVMSMIRNSQLCGQAVISYLQQKGFPEVALHFVKDEKTRFNLALESGNIQIAVAAAKEIDDKDHWYRLGIEALRQGNTSIVEYAYQRTKNFERLSFLYLVTGNMEKLSKMLKIAEMKNDVMGQFHNAMYLGDVQERVNILENSGHLPLAYVTAVTHGLKEVADRLSAELGENVPSLPEGKVRSLLMPPASLMCCGDWPLLRVMRGIFDNGLDTVRAGNEEEEEATGADWGDEELDIVDMEAVMQNADDVVAELEEGVANEDNEEGGWDLEDLELPPDADTPKAAGNARSSLFVAPTPGIPVSQIWIQKSSLAGEHVAAGNFDTAMRLLSRQLGIRNFAPMKPLFMDVFVGSHTYMHAFATTPAISTAVEKGWSESDSPNVRGPPALVFKFSQMDEKLKAAYRATTDGKFPEALRQFLNILHTIPLIVVESRREVDEVKELIEIAREYVLGLKMEVQRKEIKVNSVQQQELAAYFTNCKLQKIHMRLVLTNAMTICYKGGNYATAANFARMLLENRPTEIQAKKARQVLQHAGDKNDANQLNYDYRNPFVVCGATFVPIYRGQKDVSCPYCGARFVPAIEGQLCSVCELAVVGSDASGLLCSPTQAR

SEQ ID NO: 4154 - protein, 1219 aa, Amorphophallus konjac
MLTKFETKSNRVKGLSFHNKRPWILASLHSGVIQLWDYRMGTLIDRFDEHDGPVRGVHFHKSQPLFVSGGDDYKIKVWNYKTHRCLFTLLGHLDYIRTVHFHHEYPWIVSASDDQTIRIWNWQSRICISVLTGHNHYVMCASFHPKEDLVVSASLDQTVRVWDIGALRKKTVSPADDISRLSQMNTDLFGGVDAVVKYVLEGHDRGVNWASFHPSLPLIVSGADDRQIKLWRMNDTKAWEVDTLRGHMNNVSCVMFHAKQDIIVSNSEDKSIRVWDVTKRTGVQTFRREHDRFWILAAHPEMNLLAAGHDSGMIVFKLERERPAFSVSGDSLYYVKDRFLRFYEFSSQKDNQVIPVRRPGSVSLNQGPKTLSYSPTENAVLICSDADCGSYELYIISKDVIGRSDSVQDARKGPGASAIFVARNRFAVLDKATNQAIVKNLKNEIVKKSALPIAADAIFYAGTGNVLCRAEDRVAIFDLQQRLVLGELQAPSVKYVVWSSDMESVALLSKHAIVIASKKLVHRCTLHETIRVKSGAWDDNGVFIYTTLNHIKYCLPNGDSGIIRTLDVPIYITKVSGNNIYCLDRDGKNRLITIDATEYIFKLSLMRKRYDQVMSMIKNSQLCGQAVIAYLQQKGFPEVALHFVKDERTRFNLALESGNIQIAVASAKEIDEKDYWYKLGIEALRQGNTSIVEYAYQRTKNFERLSFLYLITGNMEKLSKMLRIAEIKNDVMGQFHNALYLGDIQERVKILENAGQLPLAYITASIHGLTDVADRLAVELGDNVPAVPQGKVPSLLIPHPPLVCSGDWPLLRVMRGIFEGGLDGVGRAGHDEDEEATAPDWGDEDLDIVDVERALQNGDIGAAGEEGEVNEEDDEEGGWDVEDLELPPDVDTPKAAVVSRSSLFVAPTPGMPVSQIWIQKSSLAGEHAAAGNFDTAMRLLSRQLGIKNFTPLKSSFMDLYVGSHSYLRAFASATVISLAVEKGWSESASPNVRGPPALVFKFSQLEEKLKLAYKATTEGKFPEALRLFLSILHTIPLVVVDQRREVDEVKELIEIAREYVLGLKMEVKRKETKDNLVRQQELAAYFTNCKLQKGHLRLVLINAMTVCFKGSNFSTAANFARMLLDTNPTSEAHAKKARQVLQACSDKQDSTQLNYDFRNPFVVCGATFVPIYRGQRDVSCPFCGARFVPAIEGQICAVCEIAVVGADASGLLCSPSQTR

SEQ ID NO: 4155 - protein, 1060 aa, Triticum aestivum
TVRVWDIGALRKKTVSPADDILRLTQMNTDLFGGVDAVVKYVLEGHDRGVNWASFHPTLPLIVSGADDRQVKLWRMNDTKAWEVDTLRGHMNNVSCVMFHAKQDIIVSNSEDKSIRIWDATKRTGIQTFRREHDRFWILAAHPEMNLLAAGHDSGMIVFKLERERPAFSVSADTVFYVKDRFLRFFEYSTQKEVQVAPIRRPGSVSLNQAPRTLSYSPTENAVLICSDVDGGSYDLYIVPKDSAGRADYLQEAKKGAGGSAVFVARNRFAVLEKSSNQVLVKNLKNEIVKKSPLPIATDAIYYAGTGNLLCKAEDRVTIFDLQQRLVLGELQSAGVKYVVWSSDMEYVALLSKHAVVIASKKLVHRSTLHETIRVKSGAWDENGVFIYSTLNHIKYCLPNGDSGIIKTLDVPVYITRVIGNNIFCLDRDGKNKLITVDASEYIFKLALLRKRYDHVMSMIKSSQLCGQAVISYLQQKGFPEVALHFVKDEKTRFNLALESGNIQIAVASAKEIDDKDHWYRLGIEALRQGNVGIVEYAYQRTKNFERLTFLYLITGYMDKVGFMCKIAGQNNNLMGQFHNALYLGDARKRAEILENAGQLPLAYVTAATHGLTEIAERLAAELGENVPSLPEGKTRSLLIPPAPLISSVDWPLLRVMRGIFEGGLDATGRAEVEEDDEAAGADWGDEDLDIVDASDAVANGGDGFDPEEGEANEEDGEEGGWDLEDLELPEAETPKAAGNARSTVFVAPTPGMPVSQIWTQKSSLAGEHAAAGNFDTAMRLLSRQLGIKNFAPLKPMFLDLHMGSHSYLRALATAPVISIAVEKGWSESSSPNVRGPPSLVFTFSQMEDRLKAAYKATTEGKFPEALRQFLSILHTIPLIVVDSRREVDEVKELIEIVREYVLGLRMELKRKELKDNVNRQQELAAYFTNCKLQRVHMRLVLSNAMALCYKQKNFATAEHFARLLLENSPNEVQAKKARQVQQQCNGKKDSHELNYDYRNPFVVCGSTYVPIYRGQKDISCPYCGSRFVPAIEGQLCTICELAVVGADASGLLCSPTQTR

SEQ ID NO: 4156 - protein, 1215 aa, Musa acuminata
MLTKFETKSNRVKGLSFHSKRPWILASLHSGVIQLWDYRMGTLIDRFDEHDGPVRGVHFHKSQPLFVSGGDDYKIKVWNYKTHRCLFTLLGHLDYIRTVQFHDEHPWIVSASDDQTIRIWNWQSRNCISVLTGHNHYVMCASFHPKEDLIVSASLDQTVRVWDISSLRKKVSPADDILRLGQMNADLFGGVDAVVKYVLEGHDRGVNWASFHPTLPLIVSGADDRQVKLWRMNDSKAWEVDTLRGHMNNVSSVMFHAKQDIIVSNSEDKSIRIWDATKRTGIQTFRREHDRFWILAAHPEMNLLAAGHDSGMIVFKLERERPAFSVSGDALYYVKDRFLRFYEFSTQKDTQVVPIRRPGSVSLNQGPRTLSFSSTENAVLICSDVDGGSYELYIVPKDTAGRGDYMQDAKKGAGASAVFVARNRFAVLDKTSNQAIVKNLKNEIVKKCPLPSGTDSIFYAGTGNLLCRAEDKVAIFDLQQRIVLGELQIPPVKYVVWSSDMESIALLGKHAIVIANKKLVHRCTLHETIRVKSGAWDDNGVFIYTTLNHIKYCLPNGDSGIIKTLDVPIYITRVSGRTIYCLDRDGKNCVISIDSTEYIFKLSLFRKRYDHVMSMIRNSQLCGQAVIAYLQQKGFPEVALHFVKDEKTRFNLALESGNIEIAVASANVIDDKDHWYRLGVEALRQGNTSIVEYAYQRTKNFERLSFLYLVTGNKEKLSKMLKISELKNDIMGQFHNAMYLGDIQERVKILENAGHLPLAYVTAVTHGLKEVADRLTAELGENIPSLPKGKVCSLLMPPASLVCRGDWPLLKVMRGIFDNGLDVGRAGNEEEEEATGAEWGDEELDIVEMEGMLQNADIVAELEDGVVNEDSEEGGWDLEDLELPPDADTPKAAGNVRTSLFVAPTPGMPVSQIWIQKSSLAGEHVAAGNFDTAMRLLRRQLGIKNFAPMKPLFMDLLVGSHTYMHAFASAPAISIAVEKGWSEASSPNVRAPPALVFNFSQMDEKLKAAYRATTEGKFPEALRQFLNILHTIPLIVVDSRREVDEVKELIEIAREYVLGLKMEVKRKEIKDNAVRQQELAAYFTNCKLQNIHMRLVLINAMTICYKGGNYATAANFARMLLENSPTEIQAKKARQVLQHAGDKQDANQLNYDYRNPFVVCGTTYVPIYRGQKDVSCPYCGARFVPAIEGQLCSVCELAMVGADASGLRCSPTQAK

SEQ ID NO: 4157 - protein, 1216 aa, Musa acuminata
MLTKFETKSNRVKGLSFHSKRPWILASLHSGVIQLWDYSMGTLIDRFDEHDGPVRGVHFHKSQPLFVSGGDDYKIKVWNYKTRRCLFTLLGHLDYIRTVQFHDEHPWIVSASDDQTIRIWNWQSRTCISVLTGHNHYVMCASFHPKEDLVVSASLDQTVRVWDIGALRQKVVPADDILRLSQMNTDLFGGIDAVVKYVLEGHDRGVNWASFHPTLPLIVSGADDRQVKLWRMNDSKAWEVDTLRGHTNNVSSVMFHMKMDIIVSNSEDKSIRVWDATKRTGVQTFRREHDRFWILAVHPAMNLLAAGHDSGMIIFKLERERPAFSVSGDTLYYVKDRFLWLYEFSTQKDIQVVPIRKPGSVSLNQGPRTLSYSPTENAVLICSDVDGGSYELYIVPKDISLRSDYMQEAKRGAGGSAVFIARNRFAVLDRSTNQVVVKNLKNEIVKKSLLPIATDAIFYAGTGNVLCRAEDRVAIFDLQQRIVIGELQTPSVKYIVWSSDMESVALLSKHAIVIANKKLVLRCTMHETIRVKSGAWDDNGVFIYATLNHIKYCLSNGDTGIVRTLDEPIYITKISGSNIFCLDRDGKTRVISIDATEYIFKLSLMQKRYDHVMGMIRNSQLCGQAVIAYLQQKGFPEVALHFVKDEKTRFNLALESGNIQIAVASAKEIDDKDHWYRLGIEALRQGNTNIVEYAYQRTKNFERLSFLYLVTGNMEKLSKMLRIAEIKNDIMGQFHNALYLGDIQERVKILENAGHLPLAYVTAATHGLQEVADRLATELGDNVPSLPEGKTHSLLMPPAPLMCGGDWPLLRVMRGIFDNGSDMGRAGQEEEEDAAGADWGDEELDIVDMEGVMQNGEIIADLEDGEGNIENEEEGGWDLEDLELPADVDTPKAAGNSRHSLFVAPTPGMPVSQIWIQKSSLAGEHVAAGNFDTAMRLLSRQLAIKNFAPLKPLFMDIHMGSHSYLYALATAPIISIAVEKGWNESASSNGGGPPALVFRFSQMDEKLKAAYRATTEGKFPDALRHFLNILHTIPLIVVDSRREVDEVKELIDIAREYVLGLKIELKRKEIKDNLVRQQELAAYFTNCKLQKIHMRLVLTSAMTICYKGGNCSTAANFARMLLESSPTEVQAKKARQLLQHCGDKKDVNQLNYDYRNPFVVCGATFVPIYRGQKDVSCPYCGARFVPTIEGHLCAVCELAVVGADASGLLCSPTQIR

SEQ ID NO: 4158 - protein, 1219 aa, Citrus sinensis
MLTKFETKSNRVKGLSFHSKRPWILASLHSGVIQLWDYRMGTLIDRFDEHDGPVRGVHFHKSQPLFVSGGDDYKIKVWNYKMHRCLFTLLGHLDYIRTVQFHHEYPWIVSASDDQTIRIWNWQSRTCISVLTGHNHYVMCASFHPKEDLVVSASLDQTVRVWDIGALRKKTVSPADDILRLSQMNTDLFGGVDAVVKYVLEGHDRGVNWAAFHPTLPLIVSGADDRQVKLWRMNETKAWEVDTLRGHMNNVSCVMFHAKQDIIVSNSEDKSIRVWDVTKRTGVQTFRREHDRFWILASHPEMNLLAAGHDSGMIVFKLERERPAFAVSGDSLFYAKDRFLRYYEFSTQKDTQVIPIRRPGSTSLNQSPRTLSYSPTENAVLICSDVDGGSYELYVIPKDSIGRGDSVQDAKKGLGGSAIFIARNRFAVLDKSSNQVLVKNLKNEVVKKSILPIAADAIFYAGTGNLLCRAEDRVVIFDLQQRLVLGDLQTPFVKYVVWSNDMESVALLSKHAIIIASKKLVHQCTLHETIRVKSGAWDDNGVFIYTTLNHIKYCLPNGDSGIIRTLDVPIYITKVSGNTIFCLDRDGKNRAIVIDATEYIFKLSLLRKRYDHVMSMIRNSQLCGQAMIAYLQQKGFPEVALHFVKDERTRFNLALESGNIQIAVASAKEIDEKDHWYRLGVEALRQGNAGIVEYAYQRTKNFERLSFLYLITGNMDKLSKMLKIAEVKNDVMGQFHNALYLGDVKERVKILESAGHLPLAYITASVHGLQDVAERLAAELGDNVPSVPEGKAPSLLMPPSPVVCSGDWPLLRVMKGIFEGGLDNIGRGAVDEEEEAVEGDWGEELDMVDVDGLQNGDVAAILEDGEVAEEGEEEEGGWDLEDLELPPEAETPKAPVNARSAVFVAPTPGMPVSQIWIQRSSLAAEHAAAGNFDTAMRLLNRQLGIRNFAPLKSMFLDLHSGSHTYLRAFSSAPVIPLAVERGWNESASPNVRGPPALVFNFSQLEEKLKASYKATTTGKFTEALRLFLSILHTIPLIVVDSRREVDEVKELITIVKEYVLGLQLELKRRELKDDPVRQQELAAYFTHCNLQMPHLRLALLNAMSVCFKNKNLATAGNFARRLLETNPTIESQSKTARQVLQAAERNPTDATQLNYDFRNPFVICGATHVPIYRGQKDVSCPYCTTRFVPSQEGQLCSVCDLAVVGVDASGLLCSPTQIR

SEQ ID NO: 4159 - protein, 1215 aa, Musa acuminata
MLTKFETKSNRVKGLSFHSKRPWILASLHSGVIQLWDYRMGTLIDRFDEHDGPVRGVHFHKSQPLFVSGGDDYKIKVWNYKTHRCLFTLLGHLDYIRTVQFHDEHPWIVSASDDQTIRIWNWQSRNCISVLTGHNHYVMCASFHPKEDLIVSASLDQTIRVWDISSLRKKVSPADDILRLGQMNADLFGGVDAVVKYVLEGHDRGVNWASFHPTLPLIVSGADDRQVKLWRMNDSKAWEVDTLRGHMNNVSSVMFHAKQDIIVSNSEDKSIRIWDATKRTGIQTFRREHDRFWILAAHPEMNLLAAGHDSGMIVFKLERERPAFSVSGDALYYVKDRFLRFYEFSTQKDTQVVPIRRPGSVSLNQGPRTLSFNSTENAVLICSDVDGGSYELYIVPKDTAGRGDYMQDAKKGAGASAVFVARNRFAVLDKTSNQAIVKNLKNEIVKKCPLPSGTDSIFYAGTGNLLCRAEDKVAIFDLQQRIVLGELQIPPVKYVVWSSDMESIALLGKHAIVIANKKLVHRCTLHETIRVKSGAWDDNGVFIYTTLNHIKYCLPNGDSGIIKTLDVPIYITRVSGRTIYCLDRDGKNCVISIDSTEYIFKLSLFRKRYDHVMSMIRNSQLCGQAVIAYLQQKGFPEVALHFVKDEKTRFNLALESGNIEIAVASANVIDDKDHWYRLGVEALRQGNTSIVEYAYQRTKNFERLSFLYLVTGNKEKLSKMLKISELKNDIMGQFHNAMYLGDIQERVKILENAGHLPLAYVTAVTHGLKEVADRLTAELGENIPSLPKGKVCSLLMPPASLVCRGDWPLLKVMRGIFDNGLDVGRAGNEEEEEATGAEWGDEELDIVEMEGMLQNADIVAELEDGVVNEDSEEGGWDLEDLELPPDADTPKAAGNVRTSLFVAPTPGMPVSQIWIQKSSLAGEHVAAGNFDTAMRLLRRQLGIKNFAPMKPLFMDLLVGSHTYMHAFASAPAISIAVEKGWSEASSPNVRALPALVFNFSQMDEKLKAAYRATTEGKFPEALRQFLNILHTIPLIVVDSRREVDEVKELIEIAREYVLGLKMEVKRKEIKDNAVRQQELAAYFTNCKLQNIHMRLVLINAMTICYKGGNYATAANFARMLLENSPTEIQAKKARQVLQHAGDKQDANQLNYDYRNPFVVCGTTYVPIYRGQKDVSCPYCGARFVPAIEGQLCSVCELAMVGADASGLRCSPTQAK

SEQ ID NO: 4160 - protein, 1219 aa, Citrus clementina
MLTKFETKSNRVKGLSFHSKRPWILASLHSGVIQLWDYRMGTLIDRFDEHDGPVRGVHFHKSQPLFVSGGDDYKIKVWNYKMHRCLFTLLGHLDYIRTVQFHHEYPWIVSASDDQTIRIWNWQSRTCISVLTGHNHYVMCASFHPKEDLVVSASLDQTVRVWDIGALRKKTVSPADDILRLSQMNTDLFGGVDAVVKYVLEGHDRGVNWAAFHPTLPLIVSGADDRQVKLWRMNETKAWEVDTLRGHMNNVSCVMFHAKQDIIVSNSEDKSIRVWDVTKRTGVQTFRREHDRFWILASHPEMNLLAAGHDSGMIVFKLERERPAFAVSGDSLFYAKDRFLRYYEFSTQKDTQVIPIRRPGSTSLNQSPRTLSYSPTENAVLICSDVDGGSYELYVIPKDSIGRGDSVQDAKKGLGGSAIFIARNRFAVLDKSSNQVLVKNLKNEVVKKSILPIAADAIFYAGTGNLLCRAEDRVVIFDLQQRLVLGDLQTPFVKYVVWSNDMESVALLSKHAIIIASKKLVHQCTLHETIRVKSGAWDDNGVFIYTTLNHIKYCLPNGDSGIIRTLDVPIYITKVSGNTIFCLDRDGKNRAIVIEATEYIFKLSLLRKRYDHVMSMIRNSQLCGQAMIAYLQQKGFPEVALHFVKDERTRFNLALESGNIQIAVASAKEIDEKDHWYRLGVEALRQGNAGIVEYAYQRTKNFERLSFLYLITGNMDKLSKMLKIAEVKNDVMGQFHNALYLGDVKERVKILESAGHLPLAYITASVHGLQDVAERLAAELGDNVPSVPEGKAPSLLMPPSPVVCSGDWPLLRVMKGIFEGGLDNIGRGAVDEEEEAVEGDWGEELDMVDVDGLQNGDVAAILEDGEVAEEGEEEEGGWDLEDLELPPEAETPKAPVNARSAVFVAPTPGMPVSQIWIQRSSLAAEHAAAGNFDTAMRLLNRQLGIRNFAPLKSMFLDLHSGSHTYLRAFSSAPVIPLAVERGWNESASPNVRGPPALVFNFSQLEEKLKASYKATTTGKFTEALRLFLSILHTIPLIVVDSRREVDEVKELITIVKEYVLGLQLELKRRELKDDPVRQQELAAYFTHCNLQMPHLRLALLNAMSVCFKNKNLATAGNFARRLLETNPTIESQSKTARQVLQAAERNPTDATQLNYDFRNPFVICGATHVPIYRGQKDVSCPYCTTRFVPSQEGQLCSVCDLAVVGVDASGLLCSPTQIR

SEQ ID NO: 4161 - protein, 1216 aa, Musa acuminata
MLTKFETKSNRVKGLSFHSKRPWILASLHSGVIQLWDYSMGTLIDRFDEHDGPVRGVHFHKSQPLFVSGGDDYKIKVWNYKTRRCLFTLLGHLDYIRTVQFHDEHPWIVSASDDQTIRIWNWQSRTCISVLTGHNHYVMCASFHPKEDLVVSASLDQTIRVWDIGSLRQKVVPADDILRLSQMNTDLFGGIDAVVKYVLEGHDRGVNWASFHPTLPLIVSGADDRQVKLWRMNDSKAWEVDTLRGHTNNVSSVMFHTKMDIIVSNSEDKSIRVWDATKRTGVQTFRREHDRFWILAVHPAMNLLAAGHDSGMIIFKLERERPAFSVSGDTLYYVKDRFLWLYEFSTQKDIQVVPIRKPGSVSLNQGPRTLSYSPTENAVLICSDVDGGSYELYIVPKDISLRSDYMQEAKRGAGGSAVFIARNRFAVLDRSTNQVVVKNLKNEIVKKSLLPIATDAIFYAGTGNVLCRAEDRVAIFDLQQRIVIGELQTPSVKYTVWSSDMESVALLGKHAIVIANKKLVLRCTMHETIRVKSGAWDDNGVFIYATLNHIKYCLSNGDTGIVRTLDEPIYITKISGSNIFCLDRDGKSRVISIDATEYIFKLSLMQKRYDHVMGMIRNSQLCGQAVIAYLQQKGFPEVALHFVKDEKTRFNLALESGNIQIAVASAKEIDDKDHWYRLGIEALRQGNTNIVEYAYQRTKNFERLSFLYLVTGNMEKLSKMLRIAEIKNDIMGQFHNALYLGDIQERVKILENAGHLPLAYVTAATHGLQEVADRLANELGDNVPSLPEGKTHSLLMPPAPLMCGGDWPLLRVMRGIFDNGSDMGRAGQEEEEDAAGADWGDEELDIVDMEGVMQNGEIIADLEDGEGNIENEEEGGWDLEDLELPADVDTPKAAGNSRHSFFVTPTPGMPVSQIWIQKSSLAGEHVAAGNFDTAMRLLSRQLAIKNFAPLKPLFMDIHMGSHSYLYALATAPIISIAVEKGWNESASSNGGGPPALVFRFSQMDEKLKAAYRATTEGKFPDALRHFLNILHAIPLIVVDSRREVDEVKELIDIAREYVLGLKIELKRKEIKDNLVRQQELAAYFTNCKLQKIHMRLVLTSAMTICYKGGNCSTAANFARMLLESSPTEVQAKKARQLLQHCGDKKDVNQLNYDYRNPFVVCGATFVPIYRGQKDVSCPYCGARFVPTIEGHLCAVCELAVVGADASGLLCSPTQIR

SEQ ID NO: 4162 - protein, 1218 aa, Castanea mollissima
MLTKFETKSNRVKGLSFHSKRPWILASLHSGVIQLWDYRMGTLIDRFDEHDGPVRGVHFHKSQPLFVSGGDDYKIKVWNYKLHRCLFTLLGHLDYIRTVQFHHEYPWIVSASDDQTIRIWNWQSRTCISVLTGHNHYVMCASFHPKEDLVVSASLDQTVRVWDIGALRKKTVSPADDILRLSQMNTDLFGGVDAVVKYVLEGHDRGVNWAAFHPSLPLIVSGADDRQVKLWRMNDTKAWEVDTLRGHMNNVSCVMFHAKQDIIVSNSEDRSIRVWDVTKRTGVQTFRREHDRFWILASHPEMNLLAAGHDSGMIVFKLERERPAFAVSGDSLFYTKDRFLRFYEFSAQKDTQVMPIRRPGSTSLNQSPRTLSYSPTENAVLICSDVDGGSYELYFIPKDSIGRGDSLQEAKRGPGGSAVFVARNRFTVLEKSNNQVLVKNLKNEIVKKSALPIAADAIFYAGTGNLLCRAEDRVVIFDLQQRLVLGELQTPFVKYVVWSHDMESVALLSKHAIIIASKKLVHQCTLHETIRVKSGAWDDNGVFIYTTLNHIKYCLSNGDSGIIRTLDVPIYITKVSGNTIFCLDRDGKNRSIVIDATEYIFKLSLLKKRYDHVMSMIRNSQLCGEAVIAYLQQKGFPDVALHFVKDERTRFNLAIESGNIQIAVASATAIDEKDYWYRLGVEALRQGNAGIVEYAYQRTKNFERLSFLYLITGNNEKLSKMMKIAEVKNDVMGQFHNALYLGDVRERVKILENVGHLPLAYITASTHGLQDVAERLAAKLGDNVPSLPEGKTASLLMPRAPVMCSGDWPLLRVMKGIFEGGLDNIGRGAADEEDEAADGDWGEELDMVDVDGLQNGDVTAILEDGEVTAENEEEAGWELEDLELPPEADTPRASVNARSSVFVAPTPGMPVSQIWVQRSSLAAEHAAAGNFDTAMRLLSRQLGIRNFTPLRSMFLDLHTGSHSYLRAFSSAPVISLAVERGWNESASPNVRGPPALVFSFSQLEEKLKAGYKATTTGKFTEALRLFISILHTIPLIVVESRREVDEVKELIIIVKEYVLGLQIELKRREVKDDPVRQQELAAYFTHCNLQMPHLRLALQNAMTVCFKAKNLATAANFARRLLETNPTLESQARTARQVLQAAERNMTDSAQLNYDFRNPFVTCGATYVPIYRGQKDVSCPYCSSRFVPSQEGQLCTVCDLAVVGADASGLLCSPSQIR

SEQ ID NO: 4163 - protein, 1224 aa, Allium cepa
MLTKFETKSNRVKGLSFHPKRPWILASLHSGVIQLWDYRMGTLIDRFDEHDGPVRGVHFHKSQPLFVSGGDDYKIKVWNYKTHRCLFTLLGHLDYIRTVQFHDENPWIVSASDDQTIRIWNWQSRTCISVLTGHNHYVMCASFHPKEDLLVSASLDQTVRVWDIGALRKKTVSPADDILRLTQMNSDLFGGVDAVVKYVLEGHDRGVNWASFHPSLPLIVSGADDRQVKLWRMNDTKAWEVDTLRGHMNNVSCVMFHAKQDIIVSNSEDKSIRVWDATKRTGIQTFRREHDRFWILTAHPEMNLLAAGHDSGMIVFKLERERPAFSVSGDVLYYVKDRFLRFYEFSSERDNQVVPIRRPGSVSLNQSPRTLSYSPTENAVLICSDIDGGSYELHIVPKDTSGRGGDFMQDAKKGAGASAIFVARNRFAVLDKSTNQVLVKNLKNEVVKKSALPIATDAIFYAGTGSLLCRAEDRVVIFDLQQRIVLGELQTPSVKYIVWSTDMESVALLSKHAIVIANKKLSHRCTLHETIRVKSGAWDENGVFIYTTLNHIKYCLPNGDNGIIKTLDVPIYLTKVIGNTLFCLDRDGKNRAITIDATEYIFKLALLKKRYDHVMSMIRNSQLCGQAVIAYLQQKGFPEVALHFAKDERTRFNLALESGNIQIAVASAKEIDEKDHWYRLGIEALRQGNTSIVEYAYQRTKNFERLSFLYLITGNREKLSKMLKIAEMKNDVMGQFHNAMYLGDVEERVKILENAGHLPLAYVTAKTHGLSEIADKLGAELESKGIVPTIPEGKTSSLLMPPAPLLCSGDWPLLRVMRGIFEGGLDSNVGRGGDEDEYEGANADWGEEDLDIVDVADAVQDGDVNAEVDDIEGHGEEDDVEGGWDLEDLELPADVDASRASNARASSVFVAPTAGMPVSQIWIQKSSFAGEHAAAGNFDTAMRLLSRQLGIRNFAPLKPLFKEMHLGSHTYLDAFASAPQLSTALERGWSESASPNVRGPPALVFKFSQMDEKLKAAYRATTEGKFPEALRLFLSILHTIPLIVVDSRREVDEIKELIDIAKEYVLGLKIEVNRKELPREDVVRQQELAAYFTNCKLQKGHARLVLTSAMNICYKGGSYSNAANFARMLLENNPPGNQAERIRRVLAACSDKVDTVQLNYDFRNPFVVCGATFVPIYRGQKDVSCPYCGAHFVPAYEGQICAICELAMVGADVSGLLCSPTQRR

SEQ ID NO: 4164 - protein, 1216 aa, Amborella trichopoda
MLTKFETKSNRVKGLSFHSKRPWILASLHSGVIQLWDYRMGTLIDRFDEHDGPVRGVHFHKTQPLFVSGGDDYKIKVWNYKMHRCLFTLLGHLDYIRTVQFHNEYPWIVSASDDQTIRIWNWQSRTCISVLTGHNHYVMCASFHPKEDLVVSASLDQTVRVWDIGALRKKTVSPADDILRLTQMNTELFGGVDAVVKYVLEGHDRGVNWAAFHPSLPLIVSGADDRQVKLWRMNDTKAWEVDTLRGHTNNVSCVMFHARQDIIVSNSEDKSIRVWDVTKRTGVQTFRREHDRFWILAAHPEMNLLAAGHDSGMIVFKLERERPAFAVSGDSLYYIKDRFLRCYEFSSQKDNQVIPIRRPGSTSLNQSPRTLSYSPTENALLVCSDVEGGSYELYIVPKDSMGRGDTSQEAKRGVGGSAVFVARNRFAVLDKSNNQALVKNLKNEVVKKSILPIAADAIYYAGTGNLLCRAEDRVVIFDLQQRTIIGDLQTPFIKYVVWSNDMESVALLSKHAIVIANKKLLHRCTLHETIRVKSGAWDDNGVFIYTTLNHIKYCLPNGDSGIIRTLDVPIYITKVSGNTINCLDRDGKNRVIAIDATEYVFKLSLLRKRYDHVMSMIRNSQLCGQAVIAYLQQKGFPEVALHFVRDEKTRFNLALESGNIQIAVASAKEIDEKDHWYRLGVEALRQGNASIVEYAYQRTKNFERLSFLYLITGNMDKLSKMLRIAEIKNDVMGQFHNALYLGDIHERVKILENSGHLPLAYVTAAIHGLTEVTERLAVELGDNVPSLPEGKKASLLIPPPPISCGGDWPLLRVMKGIFEGGLDNTGRGGDEEEEEAAVADWGEDLDIVESSGQNGHVDAEVEGGGEQEEKSEEGGWDLEDLELPPEVESANASTNVRSTVFVAPTPGMPVSQIWTQKSSLAGEHAAAGNFDTAMRLLSRQLGIKNFAPLKPFFLDLHMGSHSYLRAFASAPVVPIAVEKGWSESASPNVRAPPQLVYRFSMLDDKLRSAYKATTEGKFTEALRLFLNILHIIPVVVVDSRRDADEVKELIVIAKEYVLGLRMEVRRREVRDDLKKQQELAAYFTHCNLQRIHLRLALMTAMGACFKGGNYITAANFARRILETDPPANQATKARQLLQACERNMKDANELNYDFRNPFVVCGATFVPIYRGQKDVACPYCMARFVPVLEGQLCPICDLAMVGSDASGLLCSPSQVR

SEQ ID NO: 4165 - protein, 1218 aa, Eucalyptus grandis
MLTKFETKSNRVKGLSFHSKRPWILASLHSGVIQLWDYRMGTLIDRFDEHDGPVRGVHFHKSQPLFVSGGDDYKIKVWNYKTCRCLFTLLGHLDYIRTVQFHHEHPWIVSASDDQTIRIWNWQSRTCISVLTGHNHYVMCASFHPKEDLVVSASLDQTVRVWDISALKNKTASPGDDLLRLGQMNTDLFGGVDVVVKYVLEGHDRGVNWASFHPNLPLIVSGADDRQVKLWRMNDTKAWEVDTLRGHMNNVSCVMFHAKQDIIVSNSEDKSIRIWDATKRTGIQTFRREHDRFWILSAHPEMNLLAAGHDSGMIVFKLERERPAFAVSGDIIFYTKERFLRCYEFSSQRDTQVIPIRRPGSTSLNQSPKTLSYSPTENAVLICSDVDGGSYELYVIPKDSAGRGDSGQEAKRGTGGSAVFVARNRFAVLDKSSNQVLVKNLKNEIVKKSGLPFPADAIFYAGTGNLLCRAEDRVYIFDLQQRLVIGDLQTPFIKYVVWSNDMESVALLSKHAIVIASKKLVHQCTLHETIRVKSGAWDDNGVFIYTTLNHIKYCLPNGDSGIIRTLDVPIYITKVSGNTIFCLDRDGKNRAIVIDATEYVFKLSLLRKRYDHVMSMIRNSQLCGQAMIAYLQQKGFPEVALHFVKDERTRFNLALESGNIQIAVASAKEIDERDHWYRLGVEALRQGNAGIVEYAYQRTKNFERLSFLYLITGNMDKLTKMLKIAEVKNDVMGQFHNALYLGDVRERIKILENAGHLPLAYITATTHGLQDVAERLAAELGDSVPSLPEGKQPSLLMPPMPVMCGGDWPLLRVMKGIFEGGLDNVGRGTAHEEEEEVEGDWGDELDMVDVNGLANGDVTAIMEDGEVGEENEEEGGWDLEDLELPPEAETPRASVNAHSAVFVAPTPGMPVSQIWTQRSSLAAEHAAAGNFDTAMRLLNRQLGIRNFIPLRSMFLDLHTGSHTYLRAFSSAPVVSLAVERGWNESASPNVRGPPALVYNFSQMEEKLRAGYRATTAGKFTEALRLFLSILHTIPLIVVESRREVDEVKELIVIVKEYVLGLQMELKRREIRDDPVRQQELAAYFTHCNLQMPHLRLALLNAMTVCYKAKNLATAANFARRLLETNPTVENQAKMARQVLQAAERNMIDASELNYDFRNPFVVCGATYVPIYRGQKDVSCPYCSSRFVPSQEGQLCTVCDLAVVGADASGLLCSPSQVR

SEQ ID NO: 4166 - protein, 1220 aa, Populus trichocarpa
MLTKFETKSNRVKGLSFHSKRPWILASLHSGVIQLWDYRMGTLIDRFDEHDGPVRGVHFHKSQPLFVSGGDDYKIKVWNYKLHRCLFTLLGHLDYIRTVQFHHEYPWIVSASDDQTIRIWNWQSRTCISVLTGHNHYVMCASFHPKEDLVVSASLDQTVRVWDIGALRKKTVSPADDIMRLTQMNTDLFGGVDAVVKYVLEGHDRGVNWAAFHPTLPLIVSGADDRQVKLWRMNDTKAWEVDTLRGHMNNVSCVMFHAKQDIIVSNSEDKSIRVWDVTKRTGVQTFRREHDRFWILASHPEMNLLAAGHDSGMIVFKLERERPAFALSGDSLFYTKDRFLRFFEFSTQRDTQVIPIRRPGTTSLNQSPRTLSYSPTENAVLICSDVDGGSYELYVIPKDSIARGDAVPEAKRGAGGSAVFVARNRFAVLDKSSNQVLVKNLKNEVVKKSGLPISCDAIFYAGTGNLLCRAEDRVVIFDLQQRLVLGELQTPFVKYVVWSNDMESVALLSKHAIIIASKKLVHQCTLHETIRVKSGAWDDNGVFIYTTLNHIKYCLPNGDSGIIRTLDVPIYITKISGNTIFCLDRDGKNRAIVIDATEYIFKLSLLKKRYDHVMSMIRNSQLCGQAMIAYLQQKGFPEVALHFVKDERTRFNLALESGNIQIAVASAKEIDEKDHWYRLGVEALRQGNAGIVEYAYQRTKNFERLSFLYLITGNLEKLSKMLRIAEVKNDVMGQFHNALYLGDVRERVKILENAGHLPLAYAAAKVHGLEDVVERLAAELGDDIPSFPKGKEPSLLMPPAPIMCGGDWPLLRVMKGIFEGGLDNMVRGGADEDEEEAADGDWGEELDMVDAVGLQNGDVTAILEDGEAAEENEEEEGGWDLEDLELPPEADTPRASVSARSSVFVAPTPGMPVSQIWIQRSSLAAEHAAAGNFDTAMRLLNRQLGIKNFVPLKPMFLDLHSGSHTYLRAFSSTPVISLAVERGWNKSASPNVRAPPALVFNFSQLEEKLKAGYKATTAGKFTEALKLFLSILHTIPLIVVDSRREVDEVKELIIIVKEYVLGLQMELKRREMKDNPVRQQELAAYFTHCNLQAPHLRLALQNAMTVCFKNKNLATAANFARRLLETNPPNENQARSARQVLAASERNMTDAAQLNYDFRNPFVVCGATYVPIYRGQKDVSCSYCGSRFVPSHEGQLCTVCDLAVVGADASGLLCSPSQIR

SEQ ID NO: 4167 - protein, 1218 aa, Populus trichocarpa
MLTKFETKSNRVKGLSFHSKRPWILASLHSGVIQLWDYRMGTLIDRFDEHDGPVRGVHFHKSQPLFVSGGDDYKIKVWNYKLHRCLFTLLGHLDYIRTVQFHHEYPWIVSASDDQTIRIWNWQSRTCISVLTGHNHYVMCASFHPKEDLVVSASLDQTVRVWDIGALRKKTVSPADDIMRLTQMNSDLFGGVDAVVKYVLEGHDRGVNWAAFHPTLPLIVSGADDRQVKLWRMNDTKAWEVDTLRGHMNNVSCVMFHAKQDIIVSNSEDKSIRVWDVTKRTGVQTFRREHDRFWILASHPEMNLLAAGHDSGMIVFKLERERPAFAVSGDSLFYAKDRFLRFFEFSTQRDTQVIPIRRPGTTSLNQSPRTLSYSPTENAVLICSDVDGGSYELYVIPRDSIARGDAVPEAKRGVGGSAVFVARNRFAVLDKSSNQVLVKNLKNEVVKKSSLPISADAIFYAGTGNLLCRTEDRVVIFDLQQRLVLGELQTPFIKYVIWSNDMESVALLSKHAIIIASKKLVHQCTLHETIRVKSGAWDDNGVFIYTTLNHIKYCLPNGDSGIIRTLNVPIYITKISGNTIFCLDRDGKNKAIVIDATEYIFKLSLLKKKYENVMSMIRNSQLCGQAMIAYLQQKGFPEVALHFVKDERTRFNLALESGNIQIAVASAKEIDEKDHWYRLGVEALRQGNAGIVEYAYQRTKNFERLSFLYLVTGNLEKLSKMLRIAEVKNDVMGQFHNALYLGDVRERVKILENAGHLPLAYATAKVHGLEDVVERLAAELGDDIPSLPEGKTPSLLMPPAPIMCGGDWPLLRVMKGIFEGGLDNMGRGGADEDEEAADGDWGEELDMVDVDGLQNGDVSAILEDGEAAEENEEEGGWDLEDLELPPEADTPRASVSARSSVFVAPTPGMPVSQIWIQRSSLAAEHAAAGNFDTAMRLLNRQLGIKNFVPLKSMFLDLYSGSHTYLRAFSSTPVISLAVERGWNESASPNVRGPPALVFNFSQLEEKLKAGYKATTTGKFTEALRLFLGILHTIPLIVVDSRREVDEVKELIIIVKEYVLGLQMELKRREMKDNPVRQQELAAYFTHCNLQAPHLRLALQNAMTVCFKNKNLATAANFARRLLETNPPNENQARAARQVLAAAERSMTDAAQLNYDFRNPFVVCGATYVPIYRGQKDVSCPYCGSRFVPSQEGQLCTVCDLAVVGADASGLLCSPSQIR

SEQ ID NO: 4168 - protein, 1217 aa, Prunus persica
MLTKFETKSNRVKGLSFHSKRPWILASLHSGVIQLWDYRMGTLIDRFDEHDGPVRGVHFHTSQPLFVSGGDDYKIKVWNYKLHRCLFTLLGHLDYIRTVQFHHEYPWIVSASDDQTIRIWNWQSRTCISVLTGHNHYVMCALFHPKEDLVVSASLDQTVRVWDIGALRKKTVAPADDILRLSQMNADFFGGVDAVVKYVLEGHDRGVNWASFHPTLPLIVSGADDRQVKLWRMNDTKAWEVDTLRGHMNNVSCVLFHARQDIIVSNSEDRSIRVWDATKRTGLQTFRREHDRFWILAAHPEMNLLAAGHDSGMIVFKLERERPAFSVSGDSMFYVKDRFLRFFEFSTQRDTQVIPIRRPGSSTLNQGAKTLSYSPTENAVLICSETEGGSYELYIIPKDSFGRGDIVQEAKRGIGGPAVFVARNRFAVLEKSSNQVIVKNLKNEIVKKSALPIIADAIFYAGTGNLLCRAEDRVIIFDLQQRIILGELQTPFVRYVVWSNDMESIALLSKHSIVIANKKLVHQCTLHETIRVKSGAWDDNGVFIYTTLNHIKYCLPNGDNGIIRTLDVPVYITKVYGSTIHCLDRDGKNCAIVVDATEYVFKLSLLKKRYDQVMSMIKSSELCGQAMIAYLQQKGFPEVALHFVKDERTRFNLALGSGNIQIAVASAKEIDEKDHWYRLGVEALRQGNAGIVEYAYQKTKNFERLSFLYLVTGNLDKLSKMLKIAEVKNDVMGQFHNALYLGDIRERVKILENAGHLPLAYSTAVIHGLHDIAERLAAELGDNVPILPKGKSPSLLMPPTPIICGGDWPLLRVMRGIFEGGLDNVGRNAEEEYEEATDADWGEDLDIVDVENIPNGDISAVLEDEEEHEENEEGGWDLEDLELPPEIDTPKTASNARSSVFVAPTPGMPVSQIWTQKSSLAAEHAAAGNFDIAMRLLNRQLGIKNFAPLRQLFLDLHMGSHTYLRAFSSAPVISVAVERGWSESATPNVRGPPALVFKFSELEEKLKAGYKATTTGKFTEALRLLLGILHTIPLIVVDSRREVDEVKELIIIVKEYVLGLKMELKRRELKDNPVRQQELAAYFTHCNLQMPHLRLALLNAMSVCFKAGNLNTAANFARRLLETNPTTENHAKTARQVLQAAEKNMNDATQLNYDFRNPFVVCGATYVPIYRGQKDVSCPYCSSRFVLAQEGQLCTVCDLAVVGADASGLLCSPTQIR

SEQ ID NO: 4169 - protein, 1217 aa, Ricinus communis
MLTKFETKSNRVKGLSFHSKRPWILASLHSGVIQLWDYRMGTLIDRFDEHDGPVRGVHFHKSQPLFVSGGDDYKIKVWNYKMHRCLFTLLGHLDYIRTVQFHHEYPWIVSASDDQTIRIWNWQSRTCISVLTGHNHYVMCASFHPKEDLVVSASLDQTVRVWDIGALRKKTVSPADDILRLSQMNTDLFGGVDAVVKYVLEGHDRGVNWAAFHPNLPLIVSGADDRQVKLWRMNDTKAWEVDTLRGHMNNVSCVMFHAKQDIIVSNSEDKSIRVWDVTKRTGVQTFRREHDRFWILASHPEMNLLAAGHDSGMIVFKLERERPAFAVSGDSLFYAKDRFLRFYEFSTQRDTQVIPIRRPGTTSLNQSPRTLSYSPTENAVLICSDVDGGTYELYVIPKDSISRGDTVQEAKRGAGGSAIFVARNRFAVLDKSSNQVLVKNLKNEVVKKSSLPIAADAIFYAGTGNLLCRAEDRVVIFDLQQRIVLGDLQTPFVKYVVWSNDMESVALLSKHAIIIASKKLVHQCTLHETIRVKSGAWDDNGVFIYTTLNHIKYCLPNGDSGIIRTLDVPIYVTKVSGNTIFCLDRDGKSRHIDIDATEYMFKLSLLRKKYDHVMSMIRNSQLCGQAMIAYLQQKGFPEVALHFVKDERTRFNLALESGNIQIAVASAKEIDEKDHWYRLGVEALRQGNSGIVEYAYQRTKNFERLSFLYLITGNLEKLSKMLKIAEVKNDVMGQFHNALYLGDIQERVKILENSGHLPLAYITAKVHGLEDVAERLAAELGDNVPSLPEGKVPSLLIPPAPIMSGSDWPLLRVMRGIFQGGLDDTGKGAVDEDEEAAEGDWGGDLDIDDVDGLQNGDVSGILEDGEVADENGEGGWDLEDLELPPEADTPRASVSARSSVFVAPTPGMPVSQIWIQRSSLAAEHAAAGNFDTAMRLLNRQLGIRNFAPLRSMFLDLHTGSHTYLRAFSSTPVISLAVERGWSESASPNVRGPPALVFNFSQLEEKLKAGYRATTAGKFTEALRLFLSILHTVPLIVVESRREVDEVKELIIIVKEYVLASKMELKRREMKDNPIRQQELAAYFTHCNLQMPHLRLALQNAMTVCFKAKNLATAANFARRLLETNPTIENQAKMARQVLQAAERNMTDASELNYDFRNPFVTCGATYVPIYRGQKDISCPFCSSRFVPSQEGQLCSVCDLAVVGADASGLLCSPTQIR

SEQ ID NO: 4170 - protein, 1219 aa, Chelidonium majus
MLTKFETKSNRVKGLSFHSKRPWILASLHSGVIQLWDYRMGTLIDRFDEHDGPVRGVHFHKSQPLFVSGGDDYKIKVWNYKMHRCLFTLLGHLDYIRTVQFHNEYPWIVSASDDQTIRIWNWQSRTCVSVLTGHNHYVMCATFHPKEDLVVSASLDQTVRVWDIGALRKKTVSPADDILRLSQMNTDLFGGVDAIVKYVLEGHDRGVNWASFHPSLPLIVSGADDRQVKLWRMNDTKAWEVDTLRGHMNNVSCVMFHARQDIIVSNSEDKSIRVWDVTKRTGVQTFRREHDRFWILALHPEMNLLAAGHDSGMIVFKLERERPAFSVSGDSLFYVKDRFLRFYEFSTQKDTQVIPIRRPGSTTLNQGPRTMSYSPTENAVLICSDVDGGSYELYVVPKDSLGRGDTVQEAKRGLGGSAIFVARNRFAVLDKSNNQVLVKNLKNEIVKKSGLPVATDAIFYAGTGNLLCRSEDRVVIFDLQQRLVLGDLQTPFVKYVIWSNDMESVALLSKHAIIIASKKLVHRCTLHETIRVKSGAWDDNGVFIYTTLNHIKYCLPNGDNGIIRTLDVPIYMTKVSGNVIFCLDRDGKNRAIAIDPTEYVFKLSLLKKKFDQVMNMIRSSQLCGQAMIAYLQQKGFPEVALHFVKDERTRFNLALESGNIQIAVASAKEIDEKDHWYRLGVEALRQGNAGIVEYAYQRTKNFERLSFLYLITGNVDKLSKMLKIAEVKNDVMGQFHNALYLGDIRERVKILENAGHLPLAYITASVHGLQDVAERLAEELGDNVPSLPEGKAPSLLMPPNPIMCGGDWPLLRVMKGIFEGGLDNLGRGAEEEEEDAADGDWGEDLDIVDGDHHMQNGDVEVVDEDGEANEGNDEEGGWDLEDLELPPEIDTPKHAVNARSSVFVCPTPGMPVSQIWVQKSSLAGEHAAAGNFDTAMRLLSRQLGIKNFGPLKPMFLDLHSGSHTYLRAFSSAPVISLAVERGWTESASPNVRGPPALVFRLSELDDRLKAGYKATTSGKFSEALRLFLSILHCIPMIVVESRREVDEVKELIIITKEYVLGLQMELKRRELKDNPVRQQELAAYFTHCNLQMPHLRLALLNAMSVCYKAKNFNTAANFARRLIETNPTIENHMKTARQVLTASERNMRDESPLNYDFRNPFVVCGATYVPIYRGQKDVACPYCCSRFVPAQEGQLCTVCDLAVVGADASGLLCSPSQIR

SEQ ID NO: 4171 - protein, 1217 aa, Vitis vinifera
MLTKFETKSNRVKGLSFHTKRPWILASLHSGVIQLWDYRMGTLIDRFDEHDGPVRGVHFHKSQPLFVSGGDDYKIKVWNYKLHRCLFTLFGHLDYIRTVQFHHEYPWIVSASDDQTIRIWNWQSRTLMSVLTGHNHYVMCASFHPKEDLVVSASLDQTVRVWDIGALRKKTSSPADDILRLSQMNTDFFGGVDAVVKYVLEGHDRGVNWASFHPTLPLIVSGADDRQVKLWRMNDTKAWEVDTLRGHMNNVSCVFFHARQDVIVSNSEDKSIRVWDATKRTGIQTFRREHDRFWILTAHPEMNLLAAGHDSGMIVFKLERERPAFSVSGDCLYYVKDRFLRLYEFSTQKDAQVIPIRRPGSAALNQGPRTLSYSPTENAVLICSDVDGGSYELYIVPRDSIGRGDTVQDAKRGVGGSAVFVARNRFAVLEKSSNQVLVKNLKNEIVKKSVLPVAADAIFYAGTGNLLCRAEDRVVVFDLQQRLVLGELQTSFIRYVVWSNDMENVALLSKHTIIIASKKLEHRCTLHETIRVKSGAWDDNGVFIYTTLNHIKYCLPNGDNGIIRTLDVPVYITKVSQNTVYCLDRDGKNLAVAIDATEYVFKLSLLKKRFDQVMSMIRSSELCGQAMIAYLQQKGFPEVALHFVKDERTRFNLALESGNIQIAVASAKEIDKKDHWYRLGVEALRQGNAGIVEYAYQRTKNFERLSFLYLVTGNIDKLSKMLKIAEVKNDVMGQFHNALYLGDIRERVKILENAGHLPLAYITAAVHGLHDIAERLAADLGDNVPSLPEGKSHSLLIPPSPIMCGGDWPLLRVMKGIFEGGLDNVGRNAQEEDEEAADADWGEDLDIVDGENMQNGDIGMVLEDGEVHEENEEGGWDLEDLELPPELDTPKTSSHARSSVFIAPTPGMPVNLIWTQRSSLAAEHAAAGNFDTAMRLLSRQLGIRNFAPLKPLFFDLHMGSHTYLRALSSSPVISVAVERGWSESSSPNVRGPPALVFKFSQLEEKLKAGYRATTAGKFTEALRIFLSILHTIPLIVVESRREVDEVKELIIIVKEYALGLQMEVKRREVKDDPVRQQELAAYFTHCNLQLPHLRLALLNAMTVCYKARNLNTAANFARRLLETNPTNENHAKTARQVLQAAERNMTDASPLNYDFRNPFVVCGATYIPIYRGQKDVSCPFCSSRFVPSQEGQLCTVCDLAVIGSDASGLLCSPSQIR

SEQ ID NO: 4172 - protein, 1219 aa, Manihot esculenta
MLTKFETKSNRVKGLSFHSKRPWILASLHSGVIQLWDYRMGTLIDRFDEHDGPVRGVHFHKSQPLFVSGGDDYKIKVWNYKMHRCLFTLLGHLDYIRTVQFHHEYPWIVSASDDQTIRIWNWQSRTCISVLTGHNHYVMCASFHPKEDLVVSASLDQTVRVWDIGALRKKTVSPADDILRLSQMNTDLFGGVDAVVKYVLEGHDRGVNWAAFHPTLPLIVSGADDRQVKLWRMNDTKAWEVDTLRGHMNNVSCVMFHAKQDIIVSNSEDKSIRVWDVTKRTGVQTFRREHDRFWILASHPEMNLLAAGHDSGMIVFKLERERPAFAVSGDSLFYAKDRFLRFFEFSTQRDTQVIPIRRPGTTSLNQSPRTLSYSPTENAVLICSDVDGGSYELYVIPKDSIGRGDTVQEAKRGAGGSAIFVARNRFAVLDKSSNQVLVKNLKNEVVKKSSLPIAADAIFYAGTGNLLCRAEDRVVIFDLQQRLVLGDLQTPFVKYVVWSNDMESVALLSKHAIIIASKKLVHQCTLHETIRVKSGAWDDNGVFIYTTLNHIKYCLPNGDSGIIRTLDVPIYITKVSGNTIFCLERDGKNRAIVIDATEYIFKLSLLRKRYDHVMSMIRNSQLCGQAMIAYLQQKGFPEVALHFVKDERTRFNLALESGNIQIAVASAKEIDEKDHWYRLGVEALRQGNSGIVEYAYQRTKNFERLSFLYLITGNLEKLSKMLKIAEVKNDVMGQFHNSLYLGDVQERVKILENAGHLPLAYITAKVHGLDDVAERLAADLGDDVPSVPEGKVPSLLMPPVPVMCGGDWPLLRVMKGVFEGGLDNMGRGGADEDEDTGEGGEGDWGGLDIVDDDGLQNGDVTAILEDGKVAEENEEGGWELEDLELPPEADTPRASVSARSSVFVAPTPGMPVSQIWIQRSSLAAEHAAAGNFDTAMRLLNRQLGIRNFSPLRSMFLDLHSGSHSYLRAFSSTPVISLAVERGWNESASPNVRGPPALVFNFSQLEEKLKAGYRATTGGKFTEALRLFLSILHTVPLIVVESRREVDEVKELIVIVKEYVLGLQMELKRREMKDNPVRQQELAAYFTHCNLQMPHLRLALLNAMTVCYKAKNLATAANFARRLLETNPTIENQAKTARQVLQAAERNMRDAAELNYDFRNPFVTCGATYVPIYRGQKDVSCPYCSSRFVPSQDGKLCTVCDLAVVGADASGLLCSPSQIR

SEQ ID NO: 4173 - protein, 1217 aa, Aristolochia fimbriata
MLTKFETKSNRVKGLSFHSKRPWILASLHSGVIQLWDYRMGTLIDRFDEHDGPVRGVHFHKSQPLFVSGGDDYKIKVWNYKMHRCLFTLLGHLDYIRTVQFHNEYPWIVSASDDQTIRIWNWQSRTCISVLTGHNHYVMCASFHPKEDLVVSASLDQTVRVWDIGALRKKTVSPADDILRLSQMNSDLFGGVDAVVKYVLEGHDRGVNWAAFHPNLPLIVSGADDRQVKLWRMNDTKAWEVDTLRGHMNNVSCVMFHARQDIIVSNSEDKSIRVWDVTKRTGVQTFRREHDRFWILAAHPEMNLLAAGHDSGMIVFKLERERPAFSVSGDSLYYVKDRFLRFFEFSSQKDNQVIPIRRPGSTSLNQGPRTLSYSPTENAVLICSDVDGGSYELYVVPRESAGRGDNMQDAKRGLGGSAVFVARNRFAVLDKSSNQVLVKNLKNEIVKKSTLPVAADAIFYAGTGSLLCRAEDRVVIFDLQQRTVLGDLQTPFVKYIVWSNDMESVALLSKHAIIIASKRLVHRCTLHETIRVKSGAWDDNGVFIYTTLNHIKYCLPNGDSGIIRTLDVPIYITKVSGNTIYCLDRDGRNRVIAIDATEYVFKLALIKERFDHVMSMIRNSQLCGQAMIAYLQQKGFPEVALHFVRDERTRFNLALESGNIQIAVASAKEIDEKDHWYRLGVEALRQGNASIVEYAYQRTKNFERLSFLYLVTGNIEKLSKMLRIAEIKNDVMGQFHNALYLGDVRERVKILENVGHLPLAYVTAAVHGLTEDAERIAAELGDNVPSLPEGRVPSLLVPPPPIMCGGDWPLLRVTRGIFGGGLDNVGRAGPEEDEEASRADWGDDLDLGVDGLDNGDVSMIVEDGDVNEGDEEGGWELEDIELPPEVDTPKTALVSRSTVFVAPTPGMPVSQIWIQKSSLAGEHAAAGNFDTAMRLLSRQLGIKNFAPLKPVFLDLHTGSHTYLRAFTSAPVIPLAVEKGWSENSSPNVRNPPALVYKFSQLDDKLRSAYKLTTEGKFGEALKLFLSILHNIPVVVVESRREVDEVKELITIAKEYVLGLRMELKRKELKDDPVRQQELAAYFTHCNLQRVHLRLVLVSAMTLCFKGGNYNAAANFARRLLETDPTIEAQVKRARQVLQACTERNMKDANQLNYDFRNPFVVCGSTFVPIYRGQKDVACSYCGSRFVPSIEGQICSVCDLAVVGADASGLLCSPSQMR

SEQ ID NO: 4174 - protein, 1213 aa, Gossypium raimondii
MLTKFETKSNRVKGLSFHTKRPWILASLHSGVIQLWDYRMGTLIDRFDEHDGPVRGVHFHMSQPLFVSGGDDYKIKVWNYKLHRCLFTLLGHLDYIRTVQFHHEHPWIVSASDDQTIRIWNWQSRTCISVLTGHNHYVMCASFHPKEDLVVSASLDQTVRVWDIGSLKKKGASPADDILRLSQMNTDLFGGVDAVVKYVLEGHDRGVNWAAFHPTLPLIVSGADDRQVKLWRMNDTKAWEVDTLRGHMNNVSCVMFHAKQDIIVSNSEDKSIRVWDATKRTGLQTFRREHDRFWILAAHPEINLLAAGHDSGMIVFKLERERPAFAVSGDSLFYAKDRFLRYYDFSTQKETQIVPIRRPGSTTLNQCPRTLSYSPTENAVLICSDVDGGTYELYQIPKDSIGRNDLQEAKRGPGSSAIFVARNRFAVLDKSNNQVLIKNLKNEVVKKSGLPVPTDAIFYAGTGNLLCRSDDRVVVFDLQQRLVLGDLQTPFVKYVVWSSDMESVALLSKHSIIITSKKLVHQCTFHETIRVKSGAWDENGVFIYTTLNHIKYCLPNGDSGIIRTLDVPIYLTKVSGNKIFCLDRDGKNKTLVIDATEYIFKLSLLRKRYDHVMSMIRNSQLCGEAVIAYLQQKGFPEVALHFVKDEKTRFNLAIESGNIQIAVASAKEIDDKDHWYRLGVEALRQGNAGIVEYAYQRTKNFERLSFLYRINGNLEKLSKMLKIAEVKNDIMGQFHNALYLGDIQERVKILENAGHLPLAYVTASVHGLHDVAERLAAELGDDVPSLPEGKKPSLLMPPAPVICCGDWPLLRVMKGIFEGGFDSTGRGAVEEEEEGADGDWGEDLDMVDADDLQNGDVTAILEDGEVAEDNEEGGWDLEDLELPPEVETPRVNARSSVFVAPTPGMPVNQIWTQRSSLAADHAAAGNFDTAMRLLSRQLGIRNFAPLKSMFLDLHTGSHSYLRAFSSAPVVSLAVERGWSESASPNVRGPPALVFNFSQLDEKLKAGYKATTDGKFTEALRLFLSILHTIPLIVVESRREVDEVKELIIIAKEYVLGLQMELKRRELKDNPVRQQELAAYFTHCNLQMPHLRLALRNAMTICFKAKNLATAANFARRLLETNPNENHSKAARQVLQASERNMTDASQLNYDFRNPFVTCGATYVPIYRGQKDVSCPYCTTRYVPTQEGQLCTICELAVIGADASGLLCSPSQIR

SEQ ID NO: 4175 - protein, 1216 aa, Gossypium hirsutum
MLTKFETKGNRVKGLSFHAKRPWILASLHSGVIQLWDYRMGTLIDRFDEHDGPVRGVHFHMSQPLFVSGGDDYKIKVWNYKLHRCLFTLLGHLDYIRTVQFHHEHPWIVSASDDQTIRIWNWQSRTCISVLTGHNHYVMCASFHPKEDLVVSASLDQTVRVWDIGSLKKKTASPADDILRLSQMNTDLFGGVDAVVKYVLEGHDRGVNWAAFHPTLPLIVSGADDRQVKLWRMNETKAWEVDTLRGHMNNVSCVMFHAKQDIIVSNSEDKSIRVWDVTKRTGLQTFRREHDRFWILSVHPEMNVLAAGHDSGMIVFKLERERPAFAVSGDSLFYAKDRFLRYFDFSSQRETQVIPIRRPGSSSLNQSPRTLSYSPTENAVLICSDVDGGSYELYVVPKDSSARSDSLHEAKKGLGSSAIFVARNRFAVLDKGNNQVLIKNLKNEVVKKSGLPVPTDAIFYAGTGNLLCRSEDRVVIFDLQQRLILGDLQTPFVKYVVWSNDMESVALLSKHTIVITNKKLVHQCTLHETIRVKSGAWDENGVFIYTTLNHVKYCLPNGDSGIIRTLEVPIYITKVSGNTIFCLDRDGKNKTIVIDVTEYIFKLSLLRKRYDHVMSMIRNSQLCGEAMIAYLQQKGFPEVALHFVKDEKTRFNLALESGNIQIAVASAKEIDDKDHWYRLGVEALRQGNAGIVEYAYQRTKNFERLSFLYLVNGNLEKLSKMLKIAEVKNDVMGQFHNALYLGDIQERVKILENAGHLPLAYITASVHGLQDVAERLAAELGDDIPPLPEGKEPSLLIPPTPVTCGGDWPLLRVMKGIFDGGLDSIGRGAADEEEGEEGDWGEDLDVVDVDGIQNGDVSVNFEGAEVAEGSEEEGGWDLEDLELPPEADTPKVSGNARSIFVAPTPGMPVSQIWVQKSSLAAEHAAAGNFDTAMRLLSRQLGIRNFSPLKSLFLDLHTGSHSYLRAFSSAPVVSLAVERGWSESAIPNVRCPPALVFNFSQLDEKLKAGYKATTAGKFTEALRLFLRILHTIPLIVVESRREVDEVKELIIIAKEYVLGLQMELKRREMKDNPVRQQELAAYFTHCNLQLPHLRLALLNAMTVCYKAKNMATAGNFARRLLETNPTNENQAKTARQVLQAAERNMTDASQLNYDFRNPFVTCGATYVPIYRGQKDVSCPYCTSRFVPSQEGQLCTVCDLALVGADASGLLCSASQIR

SEQ ID NO: 4176 - protein, 1216 aa, Gossypium raimondii
MLTKFETKSNRVKGLSFHAKRPWILASLHSGVIQLWDYRMGTLIDRFDEHDGPVRGVHFHMSQPLFVSGGDDYKIKVWNYKLHRCLFTLLGHLDYIRTVQFHHEHPWIVSASDDQTIRIWNWQSRTCISVLTGHNHYVMCASFHPKEDLVVSASLDQTVRVWDIGSLKKKTASPADDILRLSQMNTDLFGGVDAVVKYVLEGHDRGVNWAAFHPTLPLIVSGADDRQVKLWRMNETKAWEVDTLRGHMNNVSCVMFHAKQDIVVSNSEDKSIRVWDVTKRTGLQTFRREHDRFWILAVHPEMNVLAAGHDSGMIVFKLERERPAFAVSGDSLFYAKDRFLRYFDFSSQRETQVIPIRRPGSSSLNQSPRTLSYSPTENAVLICSDVDGGSYELYVVPKDSSARSDSLHEAKKGLGSSAIFVARNRFAVLDKGNNQVLIKNLKNEVVKKSGLPVPTDAIFYAGTGNLLCRSEDRVVIFDLQQRLILGDLQTPFVKYVVWSNDMESVALLSKHTIVITNKKLVHQCTLHETIRVKSGAWDENGVFIYTTLNHVKYCLPNGDSGIIRTLEVPIYITKVSGNTIFCLDRDGKNKTIVIDVTEYVFKLSLLRKRYDHVMSMIRNSQLCGEAMIAYLQQKGFPEVALHFVKDEKTRFNLALESGNIQIAVASAKEIDDKDHWYRLGVEALRQGNAGIVEYAYQRTKNFERLSFLYLVNGNIEKLSKMLKIAEVKNDVMGQFHNALYLGDIQERVKILENAGHLPLAYITASVHGLQDVAERLAAELGDDVPPLPVGKEPSLLIPPTPVTCGGDWPLLRVMKGIFDGGLDSIGRGAADEEEGEEGDWGEDLDVVDVDGIQNGDVSVNFEDGEVAEGSEEEGGWDLEDLELPPEADTPKVSGNARSIFVAPTPGMPVSQIWVQKSSLAAEHAAAGNFDTAMRLLSRQLGIRNFSPLKSLFLDLHTGSHSYLRAFSSAPVVSLAVERGWSESASPNVRCPPALVFNFSQLDEKLKAGYKATTAGKFTEALRLFLSILHTIPLIVVESRREVDEVKELIIIAKEYVLGLQMELKRREMKDNPVRQQELAAYFTHCNLQLPHLRLALLNAMTVCYKAKNLATAGNFARRLLETNPTNENQAKTARQVLQAAERNMTDASQLNYDFRNPFVTCGATYVPIYRGQKDVSCPYCTSRFVPSQEGQLCTVCDLALVGADASGLLCSASQIR

SEQ ID NO: 4177 - protein, 1213 aa, Gossypium raimondii
MLTKFETKSNRVKGLSFHTKRPWILASLHSGVIQLWDYRMGTLIDRFDEHDGPVRGVHFHMSQPLFVSGGDDYKIKVWNYKLHRCLFTLLGHLDYIRTVQFHHEHPWIVSASDDQTIRIWNWQSRTCISVLTGHNHYVMCASFHPKEDLVVSASLDQTVRVWDVSSLKKKGASPADDILRLSQMNTDLFGGVDAVVKYVLEGHDRGVNWAAFHPTLPLIVSGADDRQVKLWRMNDTKAWEVDTLRGHMNNVSCVMFHAKQDIIVSNSEDKSIRVWDATKRTGLQTFRREHDRFWILAAHPEINLLAAGHDSGMIVFKLERERPAFAVSGDSLFYAKDRFLRYYDFSTQKETQIVPIRRPGSTTLNQCPRTLSYSPTENAVLICSDVDGGTYELYQIPKDSIGRSDLQEAKRGPGSSAIFVARNRFAVLDKSNNQVLIKNLKNEVVKKSGLPVPTDAIFYAGTGNLLCRSDDRVVVFDLQQRLVLGDLQTPFVKYVVWSSDMESVALLSKHSIIITSKKLVHQCTFHETIRVKSGAWDENGVFIYTTLNHIKYCLPNGDSGIIRTLDVPIYLTKVSGNKIFCLDRDGKNKTLVIDATEYIFKLSLLRKRYDHVMSMIRNSQLCGEAVIAYLQQKGFPEVALHFVKDEKTRFNLAIESGNIQIAVASAKEIDDKDHWYRLGVEALRQGNAGIVEYAYQRTKNFERLSFLYLINGNLEKLSKMLKIAEVKNDVMGQFHNALYLGDIQERVKILENAGHLPLAYVTASVHGLHDVAERLAAELGDDVPSLPEGKKPSLLMPPAPVICGGDWPLLRVMKGIFEGGFDSTGRGAVDEEEEGADGDWGEDLDMVDADGLQNGDVTAILEDGEVAEDNEEGGWDLEDLELPPEVETPRVNARSSVFVAPTPGMPVSQIWTQRSSLAADHAAAGNFDTAMRLLSRQLGIRNFTPLKSMFLDLHTGSHSYLRAFSSAPVVSLAVERGWSESSSPNVRGPPALIFNFSQLDEKLKAGYKATTDGKFTEALRLFLNILHTIPLIVVESRREVDEVKELIIIAKEYVLGLQMELKRRELKDNPVRQQELAAYFTHCNLQIPHLRLALRNAMTICFKAKNLATAADFARRLLETNPNENHSKAARQVLQASERNMTDASQLNYDFRNPFVTCGATYVPIYRGQKDVSCPYCTTRFVPTQEGQLCTICDLAVIGADASGLLCSPSQIR

SEQ ID NO: 4178 - protein, 1218 aa, Euphorbia peplus
MLTKFETKSNRVKGLSFHSKRPWILASLHSGVIQLWDYRMGTLIDRFDEHDGPVRGVHFHKSQPLFVSGGDDYKIKVWNYKMHRCLFTLLGHLDYIRTVQFHHEYPWIVSASDDQTIRIWNWQSRNCISVLTGHNHYVMCASFHPKEDLVVSASLDQTVRVWDIGALRKKTVSPADDILRLSQMNTDLFGGVDAVVKYVLEGHDRGVNWAAFHPTLPLIVSGADDRQVKLWRMNDTKAWEVDTLRGHMNNVSCVMFHAKQDIIVSNSEDKSIRVWDVTKRTGVQTFRREHDRFWILASHPEMNLLAAGHDSGMIVFKLERERPAFAVSGDSLFYAKDRFLRFFEFSTQRDTQVIPIRRPGTTSLNQSPRTLSYSPTENAVLICSDVDGGSYELYVIPKDSIGRGDTVQEARRGTGGSAIFVARNRFAVLDKSSNQVLVKNLKNEVVKKSGLPLAADAIFYAGTGNLLCRAEDRVVIFDLQQRIVLGDLQTPFVKYVVWSNDMESVALLSKHAIIIASKKLVHQCTLHETIRVKSGAWDENGVFIYTTLNHIKYCLPNGDSGIIRTLDVPIYITRVTGNTIFCLDRDGKNRAIVIDATEYIFKLSLLKKRYDHVMNMIRNSQLCGQAMIAYLQQKGFPEVALHFVKDERTRFNLALESGNIQIAVASAKEIDEKDHWYRLGVEALRQGNAGIVEYAYQRTKNFERLSFLYLITGNLEKLSKMLKIAEVKNDVMGQFHNALYLGDVQERVKILENAGHLPLAYITAKTHGLEDVAERLATELGDDIPSLPKGKVPSLLMPPAPIMCGGDWPLLRVMKGIFEGGLDNVGRGAVDEEEDDVDAGDWAQELDDVDDVAPNGDASAISEDVEMAEENNDGGGWELEDLELPPEADTPRASISARSSAFVAPNPGMPVSQIWIQRSSLAAEHAAGGNFDTAMRLLNRQLGIRNFGPLRSMFLDLHAGSHTYLRAASSTPVISLAIERGWSESASPNVRGPPALVFNFSQLEEKLKAGYRATTAGKFTEALRLFISILHTIPLIVVESRREVDEVKELINIVKEYVLGLKMELKRRELKDDPIRQQELAAYFTHCTLQMPHLRLALLNAMTVCYKAKNLATAANFARRLLETNPTVENQAKMARQVLQAAERNMTDVSELNYDFRNPFVTCGATYVPIYRGQKDVPCPFCSSRFVPTQEGQLCAVCDLAVVGADASGLFCSPSQVR

SEQ ID NO: 4179 - protein, 1219 aa, Theobroma cacao
MLTKFETKSNRVKGLSFHSKRPWILASLHSGVIQLWDYRMGTLIDRFDEHDGPVRGVHFHKSQPLFVSGGDDYKIKVWNYKLHRCLFTLLGHLDYIRTVQFHHEYPWIVSASDDQTIRIWNWQSRTCIAVLTGHNHYVMCASFHPKEDLVVSASLDQTVRVWDIGALKKKTVAPADDILRLGQLSQMNTDFFGGVDAVVKYVLEGHDRGVNWASFHPTLPLIVSGADDRQVKLWRMNDTKAWEVDTMRGHMNNVSCVLFHSRQDIIVSNSEDKSIRVWDATKRTGLQTFRREHDRFWILACHPEMNLMAAGHDSGMIVFKLERERPAFSVSGDSMYYVKDRFLRFYEFSTQKDTQVIPIRRPGSTSLNQGARTLSYSPTENAILVCSELDGGSYELYIIPKDSFGRGESVQDAKKGIGGSAVFVARNRFAVLDKSSNQVLVKNLKNEIVKKVAIPIIVDSIFYAGTGNLLCKAEDRVIIFDLQQRMILAELQTSFVRYVVWSNDMESVALLSKHSIIIANKKLVNQCTLHETIRVKSGAWDDNGVFIYTTLTHIKYCLPNGDNGVIRTLDVPVYITKVSGNTMCCLDRDGKNRAIVFDATEYVFKLSLLKKRYDHVMSMIRSSELCGQAMIAYLQQKGFPEVALHFVRDERTRFNLALESGNIQIAVASAKEIDEKDHWYRLGVEALRQGNAGIVEYAYQRTKNFDRLSFLYLITGNMDKLSKMLKIAEVKNDVMGEFHNALYLGDIKERVKILENAGHLPLAYITAAVHGLHDIAERLAADLGDDIPSLPEGRSPSLLTPPSPVLCGGDWPLLRVMRGVFEGGLDNVGRNAQEEDEEAADADWGEDLDIVDVENMPNGDVSMALVEEAHEENDEGGWDLEDLELPPEMGTPKTAGNAHSSVFVAPTPGMPVSQIWIQKSSLAAEHAAAGNFDTAMRLLSRQLGIRNFAPLKQLFLDLQVGSHSYLPTFSSAPVTLVAVERGWTESASPNVRSPPALVFKFYQLEEKLKAGYKATTSGKFTEALRLFLSILHTIPLIVVDSRREVDDVKELIIIVKEYVLGLQMELKRRELKDNPVRQQELAAYFTHCNLQPPHMRLALLNAMTVCYKNGNLMTAANFARRLLETNPTNENQAKTARQVLQAAERNTNDKVQLNYDFRNPFVVCGATYVPIYRGQKDVCCPYCSSRFVPSQEGQLCPVCDLAVVGSDASGLLCSPSQMR

SEQ ID NO: 4180 - protein, 1162 aa, Panax ginseng
MSMMDLFVVFIFTNLSPFLFLEEMTIKLKFWNYKLHRCLFTLLGHLDYIRTVQFHHEHPWIVSASDDQTIRIWNWQSRTCISVLTGHNHYVMCALFHPKDDLVVSASLDQTVRVWDIGALRKKTASPADDILRLSQINTDFFGGVDAVVKYVLEGHDRGVNWASFHPTLPLIVSGADDRQVKLWRMNDTKAWEVDTLRGHMNNVSCVLFHAKQDIIVSNSEDKSIRVWDATKRTAIQTFRREHDRFWILASHPEMNLLAAGHDSGVIVFKLERERPAFSVSGDSMFYAKDRFLRFYEFSTQRETQVIPIRRPGSTSLNQSPRTLSYSPTENAVLICSDIEGGSYELYIIPKDGISRGDTVQEAKRGIGGSAIFVARNRFAVLDKTNNQVLVKNLKNEIVKKSVLPIAADAIFYAGTGNLLCRAEDRVVIFDLQQRIVLGDLQTPFVKYIVWSNDMENIALLSKHAIVVASKKLVHQCTLHETIRVKSGGWDDNGVFIYTTLNHIKYCLPNGDSGIIKTLDVPIYITKVSGNKIYCLDRDGKNKVVVIDATEYIFKLFLLKKKYDNVMSMIRNSQLCGQAMIAYLQQKGFPEVALHFVKDERTRFGLALESGNIQTAVAAAKEIDEKDHWYRLGVEALRQGNTGIVEYAYQRTKNFERLSFLYLITGNIEKLSKMLKIAEVKNDVMGQFHNALYLGDIQERVKILENAGHLPLAYITASVHGLQDGAERLAAKLGDNVPTLPNRKAPSLLMPPIPILCGGDWPLLRVMRGIFEGGLDNIGKGAPEEDDEAADADWGEELDMVDVDDALEDGVAAEENEEDGGWDLEELELPPEADTPKVSVNSCSTFVAPTPGIAVSQIWTQRSSLAAEHSAAGNFDTAMRLLSRQLGIKNFAPLKSMFLELHTGSHTYLRAFASAPVLSVAVERGWTESASPNVRGPPSLVFNFSQLEERLKAGYKATTAGKFSEALRLFLNILHTIPLIVVESRREVDEVKELIIIVKEYVLGLQMELKRKELKDNPIRQQELAAYFTHCNLQVPHLRLALQNAMTVCFRAKNLNTAANFARRLLETNPTNENQAKTARQVLQAAEKNMKDVSQLNYDFRNPFVICGATHVPIYRGQKDVSCPYCSSRFVPSQDGQLCTVCDLAAIGADASGLLCSPSQIR

SEQ ID NO: 4181 - protein, 1213 aa, Gossypium hirsutum
MLTKFETKSNRVKGLSFHTKRPWILASLHSGVIQLWDYRMGTLIDRFDEHDGPVRGVHFHMSQPLFVSGGDDYKIKVWNYKLHRCLFTLLGHLDYIRTVQFHHEHPWIVSASDDQTIRIWNWQSRTCISVLTGHNHYVMCASFHPKEDLVVSASLDQTVRVWDVSSLKKKGASPADDILRLSQMNTDLFGGVDAVVKYVLEGHDRGVNWAAFHPTLPLIVSGADDRQVKLWRMNDTKAWEVDTLRGHMNNVSCVMFHAKQDIIVSNSEDKSIRVWDATKRTGLQTFRREHDRFWILAAHPEINLLAAGHDSGMIVFKLERERPAFAVSGDSLFYAKDRFLRYYDFSTQKETQIVPIRRPGSTTLNQCPRTLSYSPTENAVLICSDVDGGTYELYQIPKDSIGRSDLQEAKRGPGSSAIFVARNRFAVLDKSNNQVLIKNLKNEVVKKSGLPVPTDAIFYAGTGNLLCRSDDRVVVFDLQQRLVLGDLQTPFVKYVVWSSDMESVALLSKHSIIITSKKLVHQCTFHETIRVKSGAWDENGVFIYTTLNHIKYCLPNGDSGIIRTLDVPIYLTKVSGNKIFCLDRDGKNKTLVIDATEYIFKLSLLRKRYDHVMSMIRNSQLCGEAVIAYLQQKGFPEVALHFVKDGKTRFNLAIESGNIQIAVASAKEIDDKDHWYRLGVEALRQGNAGIVEYAYQRTKNFERLSFLYLINGNLEKLSKMLKIAEVKNDVMGQFHNALYLGDIQERVKILENAGHLPLAYVTASVHGLHDVAERLAAELGDDVPSLPEGKKPSLLMPPAPVICGGDWPLLRVMKGIFEGGFDSTGRGVVDEEEEGADGDWGEDLDMVDADGLQNGDVTAILEDGEVAEDNEEGGWDLEDLELPPEVETPRVNARSSVFVAPTPGMPVSQIWTQRSSLAADHAAAGNFDTAMRLLSRQLGIRNFTPLKSMFLDLHTGSHSYLRAFSSAPVVSLAVERGWSESSSPNVRGPPALIFNFSQLDEKLKAGYKATTDGKFTEALRLFLNILHTIPLIVVESRREVDEVKELIIIAKEYVLGLQMELKRRELKDNPVRQQELAAYFTHCNLQMPHLRLALRNAMTICCKAKNLATAANFARRLLETNPNENHSKAARQVLQVSERNMTDASELNYDFRNPFVTCGATYVPIYRGQKDLSCPYCTTRFVPTQEGQLCTICDLAVIGADASGLLCSPSQIR

SEQ ID NO: 4182 - protein, 316 aa, Zea mays
MAFNYHDHALAMDPAAAAAVGAAANPSFVSGGGMAGGPGWEREKAAIAAHPLYERLLEAHVACLRVATPVDQLPRIDAQIAARPPPMEAAAAAAAAGGAHSGGEELDLFMTHYVLLLCSFKEQLQQHVRVHAMEAVMACWELEQTLQSLTGASPGEGTGATMSDDEDNQVDSESNMFDGNEGSDGMGFGPLMLTEGERSLVERVRQELKHELKQGYRDKLVDIREEILRKRRAGKLPGDTASTLKAWWQAHSKWPYPTEEDKARLVQETGLQLKQINNWFINQRKRNWHNNSASSSSDKSKRKRNTAGDGNAEPAW

SEQ ID NO: 4183 - protein, 319 aa, Panicum virgatum
MAFHYPDHALAMDPAAGVGAAVNPSFVSPGGGGVGGGGGGWEREKAAIAAHPLYERLLEAHVACLRVATPVDQLPRIDAQIAARPPPMAAAAAAAAAAAGGAQSGGEELDLFMTHYVLLLCSFKEQLQQHVRVHAMEAVMACWELEQTLQSLTGASPGEGTGATMSDDEDNQVDSESNIFDGNEGSDGMGFGPLMLTEGERSLVERVRQELKHELKQGYREKLVDIREEIMRKRRAGKLPGDTASTLKAWWQAHSKWPYPTEEDKARLVQETGLQLKQINNWFINQRKRNWHSNPASSSSDKSKRKRNTAGDGNAEQSW

SEQ ID NO: 4184 - protein, 318 aa, Panicum virgatum
MAFHYPDHALAMDPAAAAGVGVGAAVNPSFVSPGGGGGGGGWEREKAAIAAHPLYERLLEAHVACLRVATPVDQLPRIDAQIAARPPPMAAAAAAAAAGGAQSGGEELDLFMTHFVLLLCSFKEQLQQHVRVHAMEAVMACWELEQTLQSLTGASPGEGTGATMSDDEDNQVDSESNMFDGNEGSDGMGFGPLMLTEGERSLVERVRQELKHELKQGYREKLVDIREEIMRKRRAGKLPGDTASTLKAWWQAHSKWPYPTEEDKARLVQETGLQLKQINNWFINQRKRNWHSNPASSSSDKSKRKRNTAGDGNAEQSW

SEQ ID NO: 4185 - protein, 317 aa, Setaria italica
MAFHYPDHALAMDPAAAAAAAGVGAAVNPSFVPGGGGVGGPGGWEREKAAIAAHPLYERLLEAHVACLRVATPVDQLPRIDAQIAARPPPMAAAAAAGGAQSGGEELDLFMTHYVLLLCSFKEQLQQHVRVHAMEAVMACWELEQTLQSLTGASPGEGTGATMSDDEDNQVDSESNMFDGNEGSDGMGFGPLMLTEGERSLVERVRQELKHELKQGYREKLVDIREEIMRKRRAGKLPGDTASTLKAWWQAHSKWPYPTEEDKARLVQETGLQLKQINNWFINQRKRNWHSNPASSSSDKSKRKRSTAGDGNAEQSW

SEQ ID NO: 4186 - protein, 311 aa, Oryza sativa
MAFHYQDHALAMDAAAAAAETGGHHHPGFVGAGGVVGGGGGGGWEREKAAIAAHPLYERLLEAHVACLRVATPVDQLPRIDAQIAARPPPLAAATAAAAAAAAGGAPSGGEELDLFMTHYVLLLCSFKEQLQQHVRVHAMEAVMACWELEQTLQSLTGASPGEGSGATMSDDEDNQVDSESNMFDGNDGSDGMGFGPLMLTEGERSLVERVRQELKHELKQGYREKLVDIREEILRKRRAGKLPGDTASTLKAWWQAHSKWPYPTEEDKARLVQETGLQLKQINNWFINQRKRNWHSNPASSSSDKSKRKR

SEQ ID NO: 4187 - protein, 313 aa, Oryza sativa
MAFHYPDHGLAMDPSSAAASSPNPSFSPGGGGGGGVGGGEREKAAVAAHPLYERLLEAHVACLRVATPVDQLPRIDAQIAARPPPLAAASAAAAAGGPSGGEELDLFMTHYVLLLCSFKEQLQQHVRVHAMEAVMGCWELEQSLQSLTGASPGEGTGATMSDDEDNQVDSEANMFDGNDGSDGMGFGPLMLTEGERSLVERVRHELKNELKQGYKEKLVDIREEILRKRRAGKLPGDTASILKAWWQAHSKWPYPTEDDKARLVQETGLQLKQINNWFINQRKRNWHSNPASSGEKTKKKRNVTGDGGAEQSW

SEQ ID NO: 4188 - protein, 307 aa, Secale cereale
MAYQYHHQDHALGMDAAAAAAGNPGGGFAPALGAGGGGWEREKAAIEAHPLYERLLEAHVACLRVATPVDQLPRIDAQIAARAPPPMPPAAAPSGGEELDLFMTHYVLLLCSFKEQLQQHVRVHAMEAVMACWELEQTLQSLTGASPGEGTGATMSDDEDNPVDSESNMFDGNDVSDGMGFGMLTEGERSLVERVRQELKHELKQGYREKLVDIREEILRKRRAGKLPGDTASTLKAWWQAHAKWPYPTEEDKARLVQETGLQLKQINNWFINQRKRNWHSNPTSSSSDKSKRKRNNAGDGNAEQSW

SEQ ID NO: 4189 - protein, 309 aa, Avena sativa
MAYHYHQDHAAAALGMDPAAAAGAGNPSFAAVGGVGGGGWEREKSAIEAHPLYERLLEAHVACLRVATPVDQLPRIDAQIAARAPPPMPNPAGAPSGGEELDLFMTHYVLLLCSFKEQLQQHVRVHAMEAVMACWELEQTLQSLTGASPGEGTGATMSDDEDNPVDSESNMYDGNDVSDGMGFGMLTEGERSLVERVRQELKHELKQGYREKLVDIREEILRKRRAGKLPGDTASTLKAWWQAHAKWPYPTEEDKARLVQETGLQLKQINNWFINQRKRNWHSNPTSSSSDKSKRKRSNAGDGNAEQSW

SEQ ID NO: 4190 - protein, 312 aa, Triticum aestivum
MAYQYHHQDHAAAALGMDAAAAAAAAAGNPGGGGFAPGLGAGGWEREKAAIEAHPLYERLLEAHVACLRVATPVDQLPRIDAQIAARAPPPMPPAAAPAGGEELDLFMTHYVLLLCSFKEQLQQHVRVHAMEAVMACWELEQTLQSLTGASPGEGTGATMSDDEDNPVDSESNMFDGNDVSDGMGFGMLTEGERSLVERVRQELKHELKQGYREKLVDIREEILRKRRAGKLPGDTASTLKAWWQAHAKWPYPTEEDKARLVQETGLQLKQINNWFINQRKRNWHSNPTSSSSDKSKRKRNNAGDGNAEQSW

SEQ ID NO: 4191 - protein, 317 aa, Brachypodium distachyon
MAFHYQDHGAAAAAALAMDAAAAGVNPNSGSSFGTPGGGGVGGVGWEREKAAVEAHPLYERLLEAHVACLRVATPVDQLPRIDAQIAARPPPAPVPPAAAHSGGEELDLFMTHYVLLLCSFKEQLQQHVRVHAMEAVMACWELEQTLQSLTGASPGEGTGATMSDDEDNPIDTESNMFDGNDGSDGMGFGPLMLTEGERSLVERVRQELKHELKQGYREKLIDIREEILRKRRAGKLPGDTASTLKAWWQAHAKWPYPTEEDKARLVQETGLQLKQINNWFINQRKRNWHSNPTSSSSDKSKRKRSNAGDGNTEQSW

SEQ ID NO: 4192 - protein, 311 aa, Triticum aestivum
RPWRTSTTTRTTRWGWTRRGGGGEPRRRLRARFGRGRGRGFWEEGEKAAIEAHPLYERLLEAHVACLRVTTPVDQLPRIDAQIAARAPPPVPPAAAPAGGEELDLFMTHYVLLLCSFKEQLQQHVRVHAMEAVMACWELEQTLQSLTGASPGEGTGATMSDDEDNPVDSESNMFDGNDVSDGMGFGMLTEGERSLVERVRQELKHELKQGYREKLVDIREEILRKRRAGKLPGDTASTLKAWWQAHAKWPYPTEEDKARLVQETGLQLKQINNWFINQRKRNWHSNPTSSSSDKSKRKRNNAGEGNAEQSW

SEQ ID NO: 4193 - protein, 103 aa, Secale cereale
MAYQYHHQDHAAAALGMDPAAAGNPGGGFAPALGAGGGGWEREKAAIEAHPLYERLLEAHVACLRVATPVDQLPRIDAQIAARAPPPMPPAPRPPAARSSTSS

SEQ ID NO: 4194 - protein, 305 aa, Setaria italica
MSFHYPDHGLTMDAAAAAAAAAAAAAAASSPNPSGFSPGGVGGEREKAAIAAHPLYERLLEAHVACLRVATPVDQLPRIDAQIAARPPPLAAAAGAAAAGGPSGGEELDLFMTHYVLLLCSFKEQLQQHVRVHAMEAVMGCWELEQSLQSLTGASPGEGTGATMSDDEDNQVDSEANMFDGNEGSDGMGFGPLMLTEGERSLVERVRQELKNELKQGYKEKLVDIREEILRKRRAGKLPGDTASILKAWWQAHSKWPYPTEDDKARLVQETGLQLKQINNWFINQRKRNWHSNPTSSGEKTKKKR

SEQ ID NO: 4195 - protein, 300 aa, Zea mays
MSFHYPDHGLSMDAAAAAAAAAAASSPNPSGFSPGVGGEREKAAIAAHPLYERLLEAHVACLRVATPVDQLPRIDAQIAARPPPLAAAAGAAAAGGPSGGEELDLFMTHYVLLLCSFKEQLQQHVRVHAMEAVMGCWELEQSLQSLTGASPGEGTGATMSDDEDNQVDSEANMFDGNDGSDGMGFGPLMLTEGERSLVERVRQELKNELKQGYKEKLVDIREEIMRKRRAGKLPGDTASVLKAWWQAHSKWPYPTEDDKARLVQETGLQLKQINNWFINQRKRNWHSNPTSSGEKTKKKR

SEQ ID NO: 4196 - protein, 375 aa, Secale cereale
QRQPRQGRQPTLPSVIHSARPSHPHQPKPTTAEVVAPPLPLPPERPAPASACPPPPRHLTTRRRRTRCRSTTRTTGLQWTRRPPRPLPRRQTLASPPGGGGGEREKAAIAAHPLYERLLEAHVACLRVATPVDQLPRIDAQIAARPPPLAAAAAAGGPSGGEELDLFMTHYVLLLCSFKEQLQQHVRVHAMEAVMGCWELEQSLQSLTGASPGEGTGATMSDDEDNQVDSETNMFDGNDGSDGMGFGPLILTEGERSLIERVRHELKSELKQGYKEKLVDIREEIMRKRRAGKLPGDTAATLKAWWQAHSKWPYPTEDDKARLVQETGLQLKQINNWFINQRKRNWHSSNTASSSEKTKKKRNVTKGNDGTEQSW

SEQ ID NO: 4197 - protein, 304 aa, Brachypodium distachyon
MSFHYPDHGLAMDAAAAAAAAASSPNPSFSPGGGGGLGVGVGGEREKAAIAAHPLYERLLEAHVACLRVATPVDQLPRIDAQIAARPPPLVAAAGSAGGPSGGEELDLFMTHYVLLLCSFKEQLQQHVRVHAMEAVMGCWELEQSLQSLTGASPGEGTGATMSDDEDNQVDSETNLFDGNDGSDGMGFGPLILTEGERSLIERVRHELKSELKQGYKEKLVDIREEIMRKRRAGKLPGDTAATLKAWWQAHSKWPYPTEDDKARLVQETGLQLKQINNWFINQRKRNWHSSNASSSSEKTKKKR

SEQ ID NO: 4198 - protein, 278 aa, Pseudoroegneria spicata
LGAGAGGGGWEREKAAIEAHPLYERLLEAHVACLRVATPVDQLPRIDAQIAARAPPPMPPAGAPSGGEELDLFMTHYVLLLCSFKEQLQQHVRVHAMEAVMACWELEQTLQSLTGASPGEGTGATMSDDEDNPVDSESNMFDGNDVSDGMGFGMLTEGERSLVERVRQELKHELKQGYREKLVDIREEILRKRRAGKLPGDTASTLKAWWQAHAKWPYPTEEDKARLVQETGLQLKQINNWFINQRKRNWHSNPTSSSSDKSKRKRNNAGDGNAEQSW

SEQ ID NO: 4199 - protein, 302 aa, Panicum virgatum
MSFHYPDHGLSMDAAAAAAAAVAAASSPNPSGFSPGGVGGEREKAAIAAHPLYERLLEAHVACLRVATPVDQLPRIDAQIAARPPPLAAAAGAAAAGGPSGGEELDLFMTHYVLLLCSFKEQLQQHVRVHAMEAVMGCWELEQSLQSLTGASPGEGTGATMSDDEDNQVDSEANMFDGNEGSDGMGFGPLILTEGERSLVERVRQELKNELKQGYKEKLVDIREEILRKRRAGKLPGDTASILKAWWQAHSKWPYPTEDDKARLVQETGLQLKQINNWFINQRKRNWHSNPTSSGEKTKKKR

SEQ ID NO: 4200 - protein, 298 aa, Hordeum vulgare
MAYQYHHHQDHALGMDAAAAAAAGGNPGGGGFAPGLSAGGAWEGEKAAVEAHPLYERLLEAHVACLRVATPVDQLPRIDAQIAARAPPPMPPASALSGGEELDLFMTHYVLLLCSFKEQLQQHVRVHAMEAVMACWELEQTLQSLTGASPGEGTGATMSDDEDNPVDSESNMFDGNDVSDGMGFGMLTEGERSLVERVRQELKHELKQGYREKLVDIREEILRKRRAGKLPGDTASTLKAWWQAHAKWPYPTEEDKARLVQETGLQLKQINNWFINQRKRNWHSNPTSSSSDKSKRKR

SEQ ID NO: 4201 - protein, 294 aa, Saccharum officinarum
MSFHYPDHGLSMDAAAASSPNPSGFSSPGVGGEREKAAIAAHPLYERLLEAHVACLRVATPVDQLPRIDAQIAARPPPLAAAAGAAAAGGPSGGEELDLFMTHYVLLLCSFKEQLQQHVRVHAMEAVMGCWELEQSLQSLTGASPGEGTGATMSDDEDNQVDSEANMFDGNDGSDGMGFGPLILTEGERSLVERVRQELKNELKQGYKEKLVDIREEIMRKRRAGKLPGDTASVLKAWWEAHSKWPYPTEDDKARLVQETGLQLKQINNWFINQRKRNWHSNPTSSGEKTKKKR

SEQ ID NO: 4202 - protein, 306 aa, Sorghum bicolor
MSFHYPDHGLSMDAAAAAAAAAAAAAAASSPNPSGFSSSGVVGGEREKAAIAAHPLYERLLEAHVACLRVATPVDQLPRIDAQIAARPPPLAAAAGAAAAGGPSGGEELDLFMTHYVLLLCSFKEQLQQHVRVHAMEAVMGCWELEQSLQSLTGASPGEGTGATMSDDEDNQVDSEANMFDGNDGSDGMGFGPLILTEGERSLVERVRQELKNELKQGYKEKLVDIREEIMRKRRAGKLPGDTASVLKAWWQAHSKWPYPTEDDKARLVQETGLQLKQINNWFINQRKRNWHSNPTSSGEKTKKKR

SEQ ID NO: 4203 - protein, 305 aa, Panicum virgatum
MSFHYPDHGLTMDAAAAAAAAAAAAAAAASSPNPSGFSPGVGGEREKAAIAAHPLYERLLEAHVACLRVATPVDQLPRIDAQIAARPPPLAAAAGAAAAGGPSGGEELDLFMTHYVLLLCSFKEQLQQHVRVHAMEAVMGCWDLEQSLQSLTGASPGEGTGATMSDDEDNQVDSEANMFDGNEGSDGMGFGPLILTEGERSLVERVRRELKNELKQGYKEKLVDIREEILRKRRAGKLPGDTASILKAWWQAHSKWPYPTEDDKARLVQETGLQLKQINNWFINQRKRNWHSNPTSSGEKTKKKR

SEQ ID NO: 4204 - protein, 294 aa, Leymus cinereus x Leymus triticoides
MAYQYHQQDHGLGMDAAAAGNPGGFAPGLGAGGAGGWEREKAAIEAHPLYERLLEAHVACLRVATPVDQLPRIDAQIAARAPPPMPPAGAPSGGEELDLFMTHYVLLLCSFKDQLQQHVRVHAMEAVMACWELEQTFQSLTGASPGEGTGATMSDDEDNPVDSESNMFDGNDVSDGMGFGMLTEGERSFVDRVRQELKHELKQGYRENLVDIRDEILRKRRAGKLPGDTASTLKAWWQAHAKWPYPTEEDKARLVQETGLQLKQINNWFINQRKRNWHSNPTSSSSDKSKRKRN

SEQ ID NO: 4205 - protein, 304 aa, Zea mays
MSFHYHDHGLSMDAAAAAAAAAASSPNPSGFSPGIGGEREKAAIAAHPLYERLLEAHVACLRVATPVDQLPRIDAQIAARPPPLAAAAGAAAAGAAAAGGPSGGEELDLFMTHYVLLLCSFKEQLQQHVRVHAMEAVMGCWELEQSLQSLTGASPGEGTGGTMSDDEDNQVDSEANMFDGNDGSDGMGFGPLILTEGERSLVERVRKELKNELKQGYKEKLVDIREEIMRKRRAGKLPGDTASVLKAWWQAHSKWPYPTEDDKARLVQETGLQLKQINNWFINQRKRNWHSNPTSSAEKTKKKR

SEQ ID NO: 4206 - protein, 616 aa, Panicum virgatum
MVFASGAGAGGPQVLTARFVRQVVLGRWFMVFACLLILSASGATYIFSIYSKVLKSSLGYDQRTLNTLSFFKDLGANVGVLSGLINEVTPPWVVLAMGAAMNLAGYLMIYLVIDGRTARPPVWLMCIYICVGANSQSFANTGALVTCVKNFPESRGIVLGLLKGFVGLSGAIFTQLYLAIYGDDAKSLVLLIAWLPAAISILFVHTVRIMPYPRPSRRRGAAGSSAATSNDAFFCFLYISIALATYLLVMIVVQKQVNFSHAAYGVSAAALLLVLFLPLAVVVKQEYKIQKELEESLREPPTVTVEKPAASLQMAAAAKSQQSTTTEARPPPPPSSSCLGSCLRHMFSPPAQGEDFTILQALVSVDMLVLFLATICGVGGTLTAIDNMGQIGQSLGYPAKSINTFVSLISIWNYAGRVTSGFASEIFLARYKFPRPLMLTLVLLLSCVGHLLIAFGVPQSLYAASVVIGFCFGAQWPLLFAIISEVFGLKYYSTLYNFGSVASPIGAYVLNVRVAGALYDAEAAKQHGGSLDAGGDKTCIGVQCFRKAFLIITAATVAAVLVSLVLVWRTRNFYKGDIYAKFRDNADAADEEEEDPKRPKEVEAEAESTSVNGRKG

SEQ ID NO: 4207 - protein, 612 aa, Zea mays
MVFASGSAAGGPQVLTARFVRQVVQGRWFMVFACLLILSASGATYIFSIYSKVLKSTLGYDQRTLNTLSFFKDLGANVGVISGLINEVTPPWVVLAMGAAMNLAGYLMIYLAIDGRTARPPVWLMCIYICVGANSQSFANTGALVTCVKNFPESRGVVLGLLKGFVGLSGAIFTQLYLAIYGDDAKSLVLLIAWLPAAVTILFVHTVRIMPYPRASRRRGPSAAATSNDAFFCFLYISIALATYLLVMIVVQKQVNFSHAAFAVSAAALLLILFLPLAVVVKQEYKIQKELEESLREDPTVTVEKPATAASLQLVAAAAAAPEPAVAQSMTTGTEAKRSSCLGSCLRHMFSPPAQGEDYTILQALVSVDMLVLFLATICGVGGTLTAIDNMGQIGQSLGYPAKSINTFVSLISIWNYAGRVTAGFASEVFLARYKFPRPLMLTLVLLLSCVGHLLIAFGVPQSLYVASVVIGFCFGAQWPLLFAIISEVFGLKYYSTLYNFGSVASPIGAYVLNVRVAGALYDVEAAKQHGGSLAGGADKTCIGVQCFRKAFLIITAATVAGALVSLVLVWRTRNFYRGDIYAKFRDSADADAAEERAEAEIGSTEVNGRKQ

SEQ ID NO: 4208 - protein, 614 aa, Zea mays
MVFASGSAAGGPQVLTARFVRQVVQGRWFMVFACLLILSASGATYIFSIYSEVLKSTLGYDQRTLNTLCFYKDLGANVDVGVISGLINEVTPPWVVLAMGAAMNLAGYLMIYLAIDGRTGRPPVWLMCIYICVGANSQSFANTGALVTCVKNFPESRGVVLGLLKGFVGLSGAIFTQLYLAIYGDDAKSLVLLIAWLPAAVTILFVHTVRIMPYPRASRRRGPSAAATSNDAFFCFLYISIALATYLLVMIVVQKQVNFSHAAFAVSAAALLLILFLPLAVVVKQEYKIQKELEESLREDPTVTVEKPATAASLQLVAAAAAAPEPAVAQSMTTGTEAKRSSCLGSCLRHMFSPPAQGEDYTILQALVSVDMLVLFLATICGVGGTLTAIDNMGQIGQSLGYPAKSINTFVSLISIWNYAGRVTAGFASEVFLARYKFPRPLMLTLVLLLSCVGHLLIAFGVPQSLYVASVVIGFCFGAQWPLLFAIISEVFGLKYYSTLYNFGSVASPIGAYVLNVRVAGALYDVEAAKQHGGSLAGGADKTCIGVQCFRKAFLIITAATVAGALVSLVLVWRTRNFYRGDIYAKFRDSADADAAEERAEAEIGSTEVNGRKQ

SEQ ID NO: 4209 - protein, 622 aa, Setaria italica
MAFASGDGGGGGPQVLTARFVRQVVLGRWFMVFACLLILSASGATYIFGIYSKVLKSSLGYDQRTLNTLSFFKDLGANVGVLSGLINEVTPPWVVLAMGAAMNLVGYLMIYLAIDGRTARPPVWLMCIYICVGANSQSFANTGALVTCVKNFPESRGIVLGLLKGFVGLSGAIFTQLYLAIYGDDAKSLVLLIAWLPAAVSILFVHTIRIMPYPRPTRRGAAAGASSATSNDAFFCFLYISIALATYLLVMIVVQKQVNFSHAAYGVSAAALLLVLFLPLAVVVKQEYKIQKELQESLREHPTVTVEKPAADLQMVAADEPAANKSQLQSTTEQTEETSPPPSGCLGSCLRHMFSPPAQGEDYTILQALVSVDMLVLFLATICGVGGTLTAIDNMGQIGQSLGYPAKSINTFVSLISIWNYAGRVTSGFASEIFLTRYRFPRPLMLTLVLLLSCVGHLLIAFGVPQSLYAASVVIGFCFGAQWPLLFAIISEVFGLKYYSTLYNFGSVASPIGAYVLNVRVAGGLYDAEAARQHGGSLAGGDKTCIGVQCFRKAFLIITAATVAGALVSLVLVWRTRKFYKGDIYAKFRDNAAAAAADAEEEDLKRPKETEGESTEVNGRTG

SEQ ID NO: 4210 - protein, 515 aa, Sorghum bicolor
PVNLALRLRRLLGPLQILRLRLGGVRAFPELGVDVALVEVPCPPHQHQRHERAGDRGGGDDEERLAEALHADAGLVAGAHQGPAVLLGGLDVVERPRDADVEHVGADGAGHGPEVVERGVVLEPEHLGDDGEQQRPLRAEAEADHHGGHVERLRHAEGDQQVADAREQEHQRQHQRPRELVPRQEHLRREPGGDATGVVPDADEGDEGVDALGRVPQRLPDLTHVVDRRQRAAHAADGGQEQHQHVHAHQRLQDGVVLPLRRRAEHVPKARPQAAAGAGRRPRRLGGGLCRSRRHALALRWCCCQLQRGWFLHGDEQHERLGVVAVDGEVELREDSAAKADESLEDAEHDAAVLREVLDAGDERAGVGERLGVGPNADVDAHEPDGWPGGAPVDGEVDHEVAHKVHGGAHGEHHPRRRDLVDEARDDAHVGAQVLEEGERVERALVVPQRRLEHLGVDAEDVRRPGRRQDEQACEHHEPTAQHHLPHEPRRQHLRAAGGAGPGREHHRARAKLKL

SEQ ID NO: 4211 - protein, 628 aa, Oryza sativa
MVTAESGVAGGGRGAAALLREVATARFARQVVLGRWFMVFACLLILSASGATYIFGIYSKVLKSSLGYDQRTLNTLSFFKDLGANVGVISGLINEVTPPWVVLAMGAAMNLAGYLMIYLAIDGRTARPPVWLMCIYICVGANSQSFANTGALVTCVKNFPESRGIVLGLLKGFVGLSGAIFTQLYVAIYGDDAKSLVLLIAWLPAAISILFVHTVRIMPYLPSRRRRADGELEASAATSNDAFFCFLYISIALATYLLTMIVVQNQTNFSHTAYVVSATALLLVLFLPLVVVIKQEYQIKKELDDSLREPPTVTIEKPAAAAMQMSAITTKPKTETPSSSSPAPAPPSCCLGSCLKHMFNPPAQGEDYTILQALVSVDMLVLFLATICGVGGTLTAIDNMGQIGQSLGYPAKSIKTFISLISIWNYAGRVTSGFASEMFLARYRFPRPLMLTAVLLLACVGHLLIAFGVAQSLYAASVIIGFCFGAQWPLLFAIISEVFGLKYYSTLYNFGSVASPVGAYVLNVRVAGYLYDVEAARQHGGSLAGGDKTCLGVQCFRKAFLIITAATVAGALISLVLVWRTRNFYKGDIYAKFRENTATDEATTNGNSADTAAEKRSTLVNDEDSKKG

SEQ ID NO: 4212 - protein, 99 aa, Saccharum officinarum
MAEPPSKIESMRKWVVDHKLRAVGCLWLGGISSSIAYNWSRPNMKTSVKIIHARLHAQALTLAALIGSACVEYYDNKYGSSGPKVDKYTSQYLAHSHKD

SEQ ID NO: 4213 - protein, 99 aa, Zea mays
MAEAPSKIESMRKWVVEHKLRAVGCLWLGGISSSIAYNWSRPNMKTSVKIIHARLHAQALTLAALVGSACVEYYDQKYGSSGPKVDKYTSQYLAHSHKD

SEQ ID NO: 4214 - protein, 99 aa, Panicum virgatum
MAEAPSKIESMRKWVVEHKLRAVGCLWLTGISSSIAYNWSRPNMKTSVKIIHARLHAQALTLAALVGSACVEYYDNKYGSSGPKVDKYTSQYLAHSHKD

SEQ ID NO: 4215 - protein, 99 aa, Setaria italica
MAEGPSKMESMRKWVVEHKLRAVGCLWLTGISSSIAYNWSRPNMKPSVKIIHARLHAQALTLAALVGSACVEYYDNKYGSSGPKVDKYTSQYLAHSHKD

SEQ ID NO: 4216 - protein, 99 aa, Pennisetum glaucum
MAEGPSKMESMRKWVIDHKLRAVGCLWLTGISSSIAYNWSRPNMKPSVKIIHARLHAQALTLAALVGSACVEYYDNKYGSSGPKVDKYTSQYLAHSHKD

SEQ ID NO: 4217 - protein, 99 aa, Echinochloa colona
MAEAPSKIESMRKWVIDHKLRAVGCLWLTGISSSIAYNWSRPNMKPSVKIIHARLHAQALTLAALVGSACVEYYDQKYGSSGPKVDKYTSQYLAHSHKD

SEQ ID NO: 4218 - protein, 99 aa, Cynodon dactylon
MAETPSKIESMRKWVVDHKLRAVGCLWLTGISGSIAYNWSRPNMKTSVKIIHARLNAQALTLAALVGSACVEYYDQKYGSSGPKVDKYTSQYLAHSHKE

SEQ ID NO: 4219 - protein, 99 aa, Echinochloa colona
MAEAPSKIESMRKWVIDHKLRAVGCLWLTGISSSIAYNWSRPNMKPSVKIIHARLHAQALTVAALVGSACVEFYDQKYGSSGPKVDKYTSQYLAHSHKD

SEQ ID NO: 4220 - protein, 99 aa, Oryza sativa
MAEAPGKIESMRKWVIDHKLRAVGCLWLTGISSSIAYNWSRPNMKTSVKIIHARLHAQALTLAALVGSAMVEYYDAKYGTSGPKVDKYTSQYLAHSHKD

SEQ ID NO: 4221 - protein, 99 aa, Secale cereale
MAEAPSKIESMRKWVVDHKLRAVGCLWLSGISGSIAYNWSRPNMKTSVKLIHARLHAQALTLAALGGCALVEYYEQNYGSSGPKVDKYTRHYMSHSHKD

SEQ ID NO: 4222 - protein, 483 aa, Triticum aestivum
LITLAMATVKLVPGVSGYIAAEKSKVVEQLQSGSASAKKNLRTELPAVGDPDGVIGELQALKDKDVRWQGKCSGTVYIAGSESEGHFSLINKAYSMFSHTNPLHQDVFKSVAQLEAEVVAMTAALLGSKEKASGGQICGNMTSGGTESILLAVKTSRDYMQSKKGITKPEMIIAESAHSAYDKAAQYFNIKVRRVPVNKEFLADVKGFKRCINGNTIMMVGSAPGFPHGLIDPIEELGELASQYGICLHVDLCLGGFVLPFAHKLGYPIPPFDFSVKGVTSISTDVHKYGLAPKGTSTVLYRNHEIRKHQFVAVTEWTGGLYISPTMAGSRPGGLVAGAWAAMMSLGLNGYLESTGKIMEVSKKIQKGIDDISGLFVIGKPDMTVVAFGSDAVDIFEVNDIMSSKGWHLNALQRPNSLHICVTLQHTAIYEEFLKDLEDSVNTVKANPGPISGGMAPIYGAAGKMPDRGTVKELLVEFMDSSC

SEQ ID NO: 4223 - protein, 539 aa, Secale cereale
MEAAAELAQRLRAAANDRLAGQEPLLLVAAPLLALLAARAVHAAAADVADRGLRTVLITLAMAAVKLVPGVSGYIAAEKSKVVEQLQSGSASSKKNLRTELPAVGDPDGVIGELQALKDKDVRWQGKCSGTVYIAGSESEGHFSLINRAYSMFSHTNPLHQDVFKSVAQLEAEVVAMTAALLGSKDKASGGQICGNMTSGGTESILLAVKTTRDYMQSKKGITKPEMIIAESAHSAYDKAAQYFNIKVRRVPVNKEFLADVKGFKRCINGNTIMMVGSAPGFPHGLIDPIEELGELASQYGICLHVDLCLGGFVLPFARKLGYPIPPFDFSVKGVTSISTDVHKYGLAPKGTSTVLYRNHEIRKHQFVAVTEWTGGLYVSPTMAGSRPGGLIAGAWAAMMSLGLNGYLESTGQIMEVSKKIQKGIDGISGLFVIGKPDMTVVAFGSDAVDIFEVNDIMSSKGWHLNALQRPNSLHICVTLQHTAIYEEFLKDLEDSVNTVKANPGPISGGMAPIYGAAGKMPDRGTVKELLVEFMDSSC

SEQ ID NO: 4224 - protein, 539 aa, Secale cereale
MEAAAELAQRLRAAANDRLAGQEPLLLVAAPLLALLAARAAHAAAADVADRGLRTVLITLAMAAVKLVPGVSGYIAAEKSKVVEQLQSGSASSKKNLRTELPTVGDPDGVIGELQTLKDKDVRWQGKCSGTVYIAGSESEGHFSLINKAYSMFSHTNPLHQDVFKSVAQLEAEVVAMTAALLGSKDKASGGQICGNMTSGGTESILLAVKTTRDYMQSKKGITKPEIIIAESAHSAYDKAAQYFNIKVRRVPVNKEFLADVKGFRRCINGNTIMMVGSAPGFPHGLIDPIEELGELASQYGICLHVDLCLGGFVLPFARKLGYPIPPFDFSVKGVTSISTDVHKYGLAPKGTSTVLYRNHEIRKHQFVAVTEWTGGLYVSPTMAGSRPGGLIAGAWAAMMSLGLNGYLESTGQIMEVSKKIEKGIDGISGLFVIGKPDMTVVAFGSDVVDIFEVNDIMSSKGWHLNALQRPNSLHICVTLQHTAIYEEFLKDLEDSVNTVKANPGPISGGMAPIYGAAGKMPDRGTVKELLVEFMDSSC

SEQ ID NO: 4225 - protein, 539 aa, Secale cereale
MEAAAELAQRLRAAANDRLAGQEPLLLVAAPLLALLAARAVHAAAADVADRGLRTVLITLAMAAVKLVPGVSGYIAAEKSKVVEQLQSGSASSKKNLRTELPAVGDPDGVIGELQALKDKDVRWQGKCSGTVYIAGSESEGHFSLINKAYSMFSHTNPLHQDVFKSVAQLEAEVVAMTAALLGSKDKASGGQICGNMTSGGTESILLAVKTTRDYMQSKKGITKPEIIIAESAHSAYDKAAQYFNIKVRRVPVNKEFLADVKGFRRCINGNTIMMVGSAPGFPHGLIDPIEELGELASQYGICLHVDLCLGGFVLPFARKLGYPIPPFDFSVKGVTSISTDVHKYGLAPKGTSTVLYRNHEIRKHQFVAVTEWTGGLYVSPTMAGSRPGGLIAGAWAAMMSLGLNGYLESTGQIMEVSKKIQKGIDGISGLFVIGKPDMTVVAFGSDVVDIFEVNDIMSSKGWHLNALQRPNSLHICVTLQHTAIYEEFLKDLEDSMNTVKANPGPISGGMAPIYGAAGKMPDRGTVKELLVEFMDSSC

SEQ ID NO: 4226 - protein, 539 aa, Lolium multiflorum
MEAATQLALRLRAAANDRLAGHEPLLLAAAPILTLLAARALHAAAGHVADRGLRTVLITLVMAALKMVPGVSAYIAAQKSKVVEQLQSGSGSAKKNLRTELPDVGVPDKVIDDLQVLKDKDVKWQGKCSGTVYIAGSESDGHFALINRAYSMFSHTNPLHQDVFKSVAQLEAEVVAMTAALLGSKEKASGGQICGNMTSGGTESILLAVKTSRDYMQSKKGITKPEMIIAESAHSAYDKAAQYFNIKVRRVPVNKEFLADVKGFRRCINGNTIMMVGSAPGFPHGLIDPIEELGELASQYGICLHVDLCLGGFVLPFARKLGYPIPPFDFSVKGVTSISTDVHKYGLAPKGTSTVLYRNHEIRKHQFVAVTEWTGGLYVSPTMAGSRPGGLIAGAWASMMSLGLNGYLESTGQIMEVSKKIQKGIDDIPGLFVIGKPDMTVVAFGSDVVDIFEVNDIMSSKGWHLNALQRPNSLHICVTLQHTTIYVEFLQDLKNSVDTVKANPGPISGGMAPIYGAAGKMPDRGTVKELLVEFMDSSC

SEQ ID NO: 4227 - protein, 489 aa, Avena sativa
RGLRAVLVALVMAAIKLVPGVSAYIAAEKSKVVEQLQSGSGSARKNLRTQLPDVGVPDGVIGELQALKDKDVRWQGKCSGTVYISGSESDGHFALINKAYSMFSHTNPLHQDVFKSVAHLEAEVVAMTAALLGSKEKASGGQICGNMTSGGTESILLAVKTSRDYMQSKKGITKPEMIIAESAHSAYDKAAQYFNIKVRRVPVNKEFLADVKGFRRCINGNTIMMVGSAPGFPHGLIDPIEELGELASQYGICLHVDLCLGGFVLPFARKLGYPIPPFDFSVKGVTSISTDVHKYGLAPKGTSTVLYRNHEIRKHQFVAVTEWTGGLYVSPTMAGSRPGGLIAGAWAAMMSLGLNGYLESTSQIMEVSKKIQKGIDDIPGLFVIGKPDMTVVAFGSDAVDIFEVNDIMSSKGWHLNALQRPNSLHICVTLQHVAIYEEFLGDLGDSVNTVKANPGPISRGMAPIYGAAGKMPDRGTVRELLVEFMDSSC

SEQ ID NO: 4228 - protein, 539 aa, Lolium multiflorum
MEAATQLALRLRAAANDRLAGHEPLLLAAAPILTLLAARALHAAAGHVADRGLRTVLITLVMAALKMVPGVSAYIAAQKSKVVEQLQSGSGSAKKNLRTELPDVGVPDKVIDDLQVLKDKDVKWQGKCSGTVYIAGSESDGHFALINRAYSMFSHTNPLHQDVFKSVAQLEAEVVAMTAALLGSKEKASGGQICGNMTSGGTESILLAVKTSRDYMQSKKGITKPEMIIAESAHSAYDKAAQYFNIKVRRVPVNKEFLADVKGFRRCINGNTIMMVGSAPGFPHGLIDPIEELGELASQYGICLHVDLCLGGFVLPFARKLGYPIPPFDFSVKGVTSISTDVHKYGLAPKGTSTVLYRNHEIRKHQFVAVTEWTGGLYVSPTMAGSRPGGLIAGAWASMMSLGLNGYLESTGQIMEVSKKIQKGIDDIPGLFVIGKPDMTVVAFGSDVVDIFEVNDIMSSKGWHLNALQRPNSLHICVTLQHTTIYVEFLQDLKNSVDTVKANPGPIKGGMAPIYGAAGKMPDRGTVKELLVEFMDSSC

SEQ ID NO: 4229 - protein, 487 aa, Avena sativa
LRAVLVALVMAAIKLVPGVSAYIAAEKSKVVEQLQSGSGSARKNLRTQLPDVGVPDGVIGDLQALKDKDVRWQGKCSGTVYISGSESDGHFALINKAYSMFSHTNPLHQDVFKSVAHLEAEVVAMTAALLGSKEKASGGQICGNMTSGGTESILLAVKTSRDYMQSKKGITKPEMIIAESAHSAYDKAAQYFNIKVRRVPVNKEFLADVKGFRRRINGNTIMMVGSAPGFPHGLIDPIEELGELASQYGICLHVDLCLGGFVLPFARKLGYPIPPFDFSVKGVTSISTDVHKYGLAPKGTSTVLYRNHEIRKHQFVAVTEWTGGLYVSPTMAGSRPGGLIAGAWAAMMSLGLNGYLESTSQIMEVSKKIQKGIDDIPGLFVIGKPNMTVVAFGSDAVDIFEVNDIMSSKGWHLNALQRPNSLHICVTLQHVAIYEEFLGDLRDSVNTVKANPGPISGGMAPIYGAAGKMPDRGTVRELLVEFMDSSC

SEQ ID NO: 4230 - protein, 542 aa, Brachypodium distachyon
MEAATNLHLALLRFRAAANQHLAHQEPLFLVAAPLLALLVARAVHAATAHVADRGLRAVVISLAMAAVKLVPGVSGYIAAQKSKVVEQLQSGSASTKKNLRTELPAVGIPDGVIKDLQTLKDKDVKWQGKCSGTVYIAGSESEGHFALINKAYSMFSHTNPLHQDVFKSVAQMEAEVVQMTAALLGSKEKASGGQICGNMTSGGTESILLAVKTSRDYMQSKKGIKKPEMIIAESAHSAYDKAAQYFNIKVRRVPVNKDFLADAKGFKRCINGNTIMMVGSAPGFPHGLIDPIEELGELASQYGICLHVDLCLGGFVLPFARKLGYPIPPFDFSVKGVTSISTDVHKYGLAPKGTSIVLYRNHEIRKNQFVAVTEWTGGLYVSPTMAGSRPGGLIAGAWAAMMSVGLNGYLESTGQIMEVSKKIQKGIEDIPGLFVIGKPDMTVVAFGSDVVDIFEVNDIMSSKGWHLNALQRPNSLHICVTLQHVAIYEEFLKDLEDSVNTVKANPGPISGGMAPIYGAAGKMPDRGTVKELLVEFMDTSC

SEQ ID NO: 4231 - protein, 467 aa, Panicum virgatum
GYIAAEKKKVVDKMQSGGTSSKNNRRAELPTIGLGEEVIKDLETLKAKDVDWQGKCSGTVYIAGSESEGHFELINKAYSMFSHTNPLHQDVFKSVAHMEAEVVAMTAALLGSKEKSSGGQICGNMTSGGTESILLAVKTSRDYMRSKKGITKPEMIIAESAHSAYDKAAEYFNIKVRRVPVNKEFLADVKGFKRCINGNTIMMVGSAPGFPHGLIDPIEELGELASRYDICLHVDLCLGGFVLPFACKLGYPIPPFDFSVKGVTSISSDVHKYGLAPKGTSVVLYRNHEIRKHQFVAVTEWTGGLYISPTIAGSRPGGLIAGAWAAMMSLGLNGYLDSTSRIMEVSKKIQRGIDEIPGLFVIGKPDMTVVAFGSDVVDIFEVNDIMSSKGWHLNALQRPNSLHICVTLQHTTVYGEFLKDLQDSVNTVKANPGPISGGMAPIYGAAGKMPDRGTVKELLVEFMDSSC

SEQ ID NO: 4232 - protein, 539 aa, Oryza sativa
MELAMDFALRLRDAANHHLSRYEPLVLLAAPLLALLAARTLHAAAAAVADRGLRTVLLALAMTAIKLLPGVSAYINAEKRKVVDQLQSGGTSTKSTLRTELPTVGLSNQVINDLETLKARDVNWQGKCSGTVYIAGSESEGHFALINKAYSMFSHTNPLHQDVFKSVAQLEAEVVAMTAALLGIKEKSSGGQICGNMTSGGTESILLAVKTSRDYMRTKKGITKPEMIIAESAHSAYDKAAQYFNIKVRRVPVNKEFLADVKGFKRCINGNTIMMVGSAPGFPHGLIDPIEELGELASRYDICLHVDLCLGGFVLPFARKLGYPIPPFDFCVKGVTSISTDVHKYGLAPKGTSIVLYKNHEIRKHQFVAVTEWTGGLYVSPTIAGSRPGGLIAGAWAAMTSLGLNGYMENTGHIMEVSKKIQRGIEDIPGLFVIGKPDMTVVAFGSDSVDIFEVNDIMSSKGWHLNALQRPNSLHICVTLQHTVIYEEFLKDLKDSVDTVKANPGPISGGRAPIYGAAGKMPDRGMVRELLVEFMDASC

SEQ ID NO: 4233 - protein, 408 aa, Leymus cinereus x Leymus triticoides
VYIAGSESEGHFSLINKAYSMFSHTNPLHQDVFKSVAQLEAEVVAMTAALLGSKEKASGGQICGNMTSGGTESILLAVKTSRDYMQSKKGITKPEMIIAESAHSAYDKAAQYFNIKVRRVPVNKEFLADVKGFKQCINGNTIMMVGSAPGFPHGLIDPIEELGELASQYGICLHVDLCLGGFVLPFARKLGYPIPPFDFSVKGVTSISTDVHKYGLAPKGTSTVLYRNHEIRKHQFVAVTEWTGGLYVSPTMAGSRPGGLITGAWAAMMSLGLNGYLESTGQIMEVSKKIQKGIDDISGLFVIGKPDMTVVAFGSDAVDIFEVNDIMSSKGWHLNALQRPNSLHICVTLQHTAIYQEFLKDLEDSVNTVKSNPGPISGGMAPIYGAAGKMPDRGTVKELLVEFMDSSC

SEQ ID NO: 4234 - protein, 535 aa, Setaria italica
MEAAAELALRLRAAANDRLARYEPLALVAAPLLALLVARTLHAAASAVADRGLVAIAIAAVKLLPGVSGYIAAEKKKVVDKMQSGGTSTKNNRRAELPTIGLGEQVIKDLETLKAKDVEWQGKCSGTVYIAGSESEGHFELINKAYSMFSHTNPLHQDVFKSVAHMEAEVVAMTAALLGSKEKSSGGQICGNMTSGGTESILLAVKTSRDYMRSKKGITKPEMIIAESAHSAYDKAAEYFNIKVRRVPVNKEFLADVKGFKRCINGNTIMMVGSAPGFPHGLIDPIEELGELASRYDICLHVDLCLGGFVLPFARKLGYPIPPFDFSVKGVTSISSDVHKYGLAPKGTSVVLYRNHEIRKHQFVAVTEWTGGLYVSPTIAGSRPGGLIAGAWAAMMYVGLNGYLDSTSRIMEVSKKIQRGIEEIPGLFVIGKPDMTVVAFGSDVVDIFEVNDIMSSKGWHLNALQRPNSLHICVTLQHTNIYGEFLKDLQDSVNTVKANPGPISGGMAPIYGAAGKMPDRGTVRELLVEFMDSSC

SEQ ID NO: 4235 - protein, 488 aa, Panicum virgatum
MLFIKEYYLYIKSNRISSKYHDVSLLLLWQVVDKMQSGGTSSKNNRRTELPTIGLGEEVIKDLETLKAKDVDWQGKCSGTVYIAGSESEGHFELINKAYSMFSHTNPLHQDVFKSVAHMEAEVVAMTAALLGSKEKSSGGQICGNMTSGGTESILLAVKTSRDYMRSKKGITKPEMIIAESAHSAYDKAAEYFNIKVRRVPVNKEFLADVKGFKRCINGNTIMMVGSAPGFPHGLIDPIEELGELASRYDICLHVDLCLGGFVLPFARKLGYPIPPFDFSVKGVTSISSDVHKYGLAPKGTSVVLYRNHEIRKHQFVAVTEWTGGLYISPTIAGSRPGGLIAGAWAAMMSMGLNGYLDSTSHIMEVSKKIQRGIEEIPGLYVIGKPDMTVVAFGSDVVDIFEVNDIMSSKGWHLNALQRPNSLHICVTLQHTTVYGEFLKDLQDSVNTVKANPGPISGGMAPIYGAAGKMPDRGTVRELLVEFMDSSC

SEQ ID NO: 4236 - protein, 491 aa, Echinochloa colona
ASAVADRGLVAICIAAAKLLPGVSGYIAAEKKKVVDKMQSGGTSNKNHRRAELPTIGLAEQVIKDLEALKAKDAAWQGKCSGTVYIAGSESEGHFELINKAYSMFSHTNPLHQDVFKSVAQMEAEVVAMTAALLGSKEKSSGGQVCGNMTSGGTESILLAVKATRDYMQSKKGITKPEMIIAESAHSAYDKAAQYFNIKVRRVPVNKEFLADVKGFKRCINRNTIMMIGSAPGFPHGLIDPIEELGELASRYDICLHIDLCLGGFVLPFARKLGYPIPPFDFSVKGVTSISSDVHKYGLAPKGTSIVLYRNHEIRKHQFVAVTEWTGGLYISPTMAGSRPGGLIAGAWAAMMSLGLNGYLDITSRIMEVSKKIQRGIEEIPGLFVIGKPDMTIVAFGSDVVDIFEVNDIMSSKGWHLNALQRPNSLHICVTLQHTSIYGEFLKDLQDSVNTVKANPGPISGGMAPIYGAAGKMPDRGTVRELLVEFMDSSC

SEQ ID NO: 4237 - protein, 480 aa, Echinochloa colona
IAIAAVKLLPGVSGYIAAEKKKVVDKMQSGGTSNKNHRRAELPTIGLAEQVIKDLEALKAKDAAWQGKCSGTVYIAGSESEGHFELINKAYSMFSHTNPLHQDVFKSVAQMEAEVVAMTAALLGSKEKSSGGQICGNMTSGGTESILLAVKATRDYMQSKKGITKPEMIIAESAHSAYDKAAQYFNIKVRRVPVNKEFLADVKGFKRCINRNTIMMIGSAPGFPHGLIDPIEELGELASRYDICLHIDLCLGGFILPFARKLGYPIPPFDFSVKGVTSISSDVHKYGLAPKGTSIVLYRNHEIRKHQFVAVTEWTGGLYISPTMAGSRPGGLIAGAWAAMMSLGLNGYLDITSRIMEVSKKIQRGIEEIPGLFVIGKPDMTIVAFGSDVVDIFEVNDIMSSKGWHLNALQRPNSLHICVTLQHTSIYGEFLKDLQDSVNTVKANPGPISGGMAPIYGAAGKMPDRGTVRELLVEFMDSSC

SEQ ID NO: 4238 - protein, 477 aa, Pennisetum glaucum
AAVKLLPGASGYIAAEKKKVVDKMQSGGTSNKNNRRAELPTIGFGEQVIKDLETLKAKDVEWQGKCSGTVYIAGSESEGHFELINKAYSMFSHTNPLHQDVFKSVAHMEAEVVAMTAALLGSKEKSSGGQICGNMTSGGTESILLAVKTSRDYMRSKKGITKPEMIIAESAHSAYDKAAEYFNIKVRRVPVNKEFLADVKGFKRCINGNTIMMIGSAPGFPHGLIDPIKELGELASHYDICLHVDLCLGGFVLPFARKLGYPIPPFDFSVKGVTSISSDVHKYGLAPKGTSVVLYRNHEIRKHQFVAVTEWTGGLYVSPTIAGSRPGGLIAGAWAAMMSLGLNGYLDSTTHIMEVSKKIQRGIKEIPGLFVIGKPDMTVVAFGSDVVDIFEVNDIMSSKGWHLNALQRPNSLHICVTLQHVNIYGEFLKDLLDSVNTVKANPGPISGGMAPIYGAAGKMPDRGTVRELLVEFMDGSC

SEQ ID NO: 4239 - protein, 421 aa, Triticum aestivum
DKDVRWQGKCSGTVYIAGSESEGHFSLINKAYSMFSHTNPLHQDVFKSVAQLEAEVVAMTAALLGSKEKASGGQICGNMTSGGTESILLAVKTSRDYMQSKKGITKPEMIIAESAHSAYDKAAQYFNIKVRRVPVNKEFLADVKGFKRCINGNTIMMVGSAPGFPHGLIDPIEELGELASQYGICLHVDLCLGGFVLPFARKLGYPIPPFDFSVKGVTSISTDVHKYGLAPKGTSTVLYRNHAIRKHQFVAVTEWTGGLYISPTMAGSRPGGLVAGAWAAMMSLGLNGYLESTGKIMEVSKKIQKGIDDISGLFVIGKPDMTVVAFGSDAVDIFEVNDIMSSKGWHLNALQRPNSLHICVTLQHTAIYEEFLKDLEDSVDTVKANPGPISGGMAPIYGAAGKMPDRGTVKELLVEFMDSSC

SEQ ID NO: 4240 - protein, 479 aa, Zea mays
AIAIAAVKLLPGVSGYIAAEKKKVVDKMQSGGAKNNRRAELPTIGLAEQVIEELETLKAKDVDWQGKCSGTVYIAGSESEGHFQLINKAYSMFSHTNPLHQDVFKSVANMEAEVVAMTAALLGSKEKSSGGQICGNMTSGGTESILLAVKTSRDYMRSKKGITRPEMIIAESAHSAYDKAAQYFNIKVRRVPVNKEFLADVKGFKRCINGNTIMMVGSAPGFPHGLIDPIEELGELASRYDICLHVDLCLGGFVLPFAHKLGYPIPPFDFSVKGVTSISSDVHKYGLAPKGTSIVLYRNHEIRKHQFVAVTEWTGGLYVSPTIAGSRPGGLIAGAWAAMMSLGLNGYLDSTSRIMDVSKKIQRGIGEIPGLFVIGKPDMTVVAFGSDVVDIFEVNDIMSSKGWHLNALQRPNSLHICVTLQHTTVYDQFLKDLQDSVNTVKANPGPISGGKAPIYGAAGKMPDRGTVRELLVEFMDSSC

SEQ ID NO: 4241 - protein, 340 aa, Saccharum officinarum
MEAAAELALSLRAATNDRLARYEPLALVAAPLLALLVARALHSAANAVANRGLVAIAIAAVKLLPGVSGYIAAEKKKVVDKMQSGGAKNDRRAELPTIGLAEQVIEELETLKTKDVDWQGKCSGTVYIAGSESEGHFELINKAYSMFSHTNPLHQDVFKSVANMEAEVVAMTAALLGSKEKSSGGQICGNMTSGGTESILLAVKTTRDYMRSKKGITKPEMIMAESAHSAYDKAAEYFNIKVRRVPVNKEFLADVKGFKRCINGNTIMMIGSAPGFPHGLIDPIEELGELASRYDICLHIDLCLGGFVLPFARKLGYPIPPFDFSVKGVTSISSDVHKYG

SEQ ID NO: 4242 - protein, 533 aa, Sorghum bicolor
MEAAAEMALRLRAAANDRLAGYEPLALVAAPLLALLVARTLHAAANAVADRGLVAIAIAAVKLLPGVSGYIAAEKKKVVDKMQSGGAKNDRRADLPTIGLGEQVIEELETLKAKDVDWQGKCSGTVYIAGSESEGHFELINKAVSMFSHTNPLHQDVFKSVANMEAEVVAMTAALLGSKEKSSGGQICGNMTSGGTESILLAVKTTRDYMRSKKGITKPEIIMAESAHSAYDKAAEYFNIKVRRVPVNKEFLADVKGFKRCINGNTIMMIGSAPGFPHGLIDPIGELGELASRYDICLHIDLCLGGFVLPFARKLGYPIPPFDFSVKGVTSISSDVHKYGLAPKGTSIVLYRNHEIRKHQFVAVTEWTGGLYVSPTMAGSRPGGLIAGAWAAMMSLGLNGYLDNTRCVMEVSKKIQRGIGEIPGLFVIGKPDMTIVAFGSDVVDIFEVNDIMSSKGWHLNALQRPNSLHICVTLQHTTIYDQFLKDLQDSVDTVKANPGPISGGMAPIYGAAGKMPDRGTVRELLVEFMDSSC

SEQ ID NO: 4243 - protein, 426 aa, Festuca arundinacea
LQVLKDKDVKWQGKCSGTVYIAGSESDGHFALINRAYSMFSHTNPLHQDVFKSVAQLEAEVVAMTAALLGSKEKASGGQICGNMTSGGTESILLAVKTSRDYMQSKKGITKPEMIIAESAHSAYDKAAQYFNIKVRRVPVNKEFLADVKGFRRCINGNTIMMVGSAPGFPHGLIDPIEELGELASQYGICLHVDLCLGGFVLPFARKLGYPIPPFDFSVKGVTSISTDVHKYGLAPKGTSTVLYRNHEIRKHQFVAVTEWTGGLYVSPTMAGSRPGGLIAGAWASMMSVGLNGYLESTGQIMEVSKKIQKGIDDIPGLFVIGKPDMTVVAFGSDVVDIFEVNDIMSSKGWHLNALQRPNSLHICVTLQHTTIYVEFLQDLKNSVDTVKANPGPISGGMAPIYGAAGKMPDRGTVKELLVEFMDSSC

SEQ ID NO: 4244 - protein, 413 aa, Avena sativa
QLQSGSGSARKNLRTQLPDVGAPDGVIGDLQALKDKDVRWQGKCSGTVYISGSESDGHFALINKAYSMFSHTNPLHQDVFKSVAHLEAEVVAMTAALLGSKEKASGGQICGNMTSGGTESILLAVKTSRDYMQSKKGITKPEMIIAESAHSAYDKAAQYFNIKVRRVPVNKEFLADVKGFRRCINGNTIMMVGSTPGFPHGLIDPIEELGELASQYGICLHVDLCLGGFVLPFARKLGYPIPPFDFSVKGVTSISTDVHKYGLAPKGTSTVLYRNHEIRKHQFVAVTEWTGGLYVSPTMAGSRPGGLIAGAWAAMMSLGLNGYLESTSQIMEVSKKIQKGIDDIPGLFVIGKPDMTVVAFGSDAVDIFEVNDIMSSKGWHLNALQRPNSLHICVTLQHVAIYEEFRRGSQGFR

SEQ ID NO: 4245 - protein, 539 aa, Elaeis guineensis
MDAMEDLVLRLRASVNSFLSQYEPITLLLSPLLALLLARALHSLLGALQEKGIKAAVLGFLMSSVKLIPGVSGYIESEKRKVVDKLQSGSKSKRDNWRAELPNIGLGRRVIEELEDVKSKDVAWQGKCSGTVYIGGSQSEGHFALTNEAYSMFSHTNPLHQDVFQSVARFEGEVIAMTAALLGSKEKTSGGQICGNMTSGGTESILLAVKTSRDYMRAKKGITKPEMIIPESAHSAYDKAAQYFNIKVRRVPVNKEFVADVKGIRRCINRNTIMIIGSAPGFPHGIVDPIEELGNLASSYGICFHVDLCLGGFVLPFARKLGYQIPPFDFSVKGVTSISIDVHKYGLGPKGTSVVLYRNHELRKHQFVAVTEWSGGLYVSPTIAGSRPGGLIAGAWAAMMSLGLNGYLENTRQIMEASKKIQKGIEDIPELFVVGKPHMTVVAFGSNAVDIFEVNDLMSSKGWHLNALQRPNSLHICVTLQHVPVFEDFLRDLRDSVKTVKENPGAISGGLAPVYGAAGKMPDRGMVEELLVEFMDNSC

SEQ ID NO: 4246 - protein, 507 aa, Ananas comosus
LALLLARALHSALAVLHEKGIQGAVLGFLMSSAKLIPGVSGYIESEKRKVVDKLQSGSKSQRENWRTELPIVGLSEGAIQELKEAKAKDVVWQGKCSGTVYIAGNESDGHFALINEAYSMFSHTNPLHQDVFQSVARFEAEVVAMTAALLGSKEKTSGGQICGNMTSGGTESILLAVKTSRDYMRSKKGITKPEMIIPESAHSAYDKAAQYYNIKLWRVPVNKNFVADVKGIKQRINRNTILIVGSAPGFPHGIIDPIEELGELASSYGICLHVDLCLGGFVLPFARKLGYPLRPFDFSVKGVTSISTDVHKYGLAPKGTSIVLYRNHEIRKHQFVAVTEWSGGLYVSPTMAGSRPGGLIAGAWAAMMSLGLNGYLENTRQIMEVAKKIQKGIEEIPQLFIVGKPHMTVIAFGSNVLDIFEVNDIMSSKGWHLSALQRPNSLHICVTLQHVTVFEDFLNDLKDSVKIVKENPGPIDGGKAPIYGAAGKMPDRGMVRDLLVEFMDGTC

SEQ ID NO: 4247 - protein, 456 aa, Triticum aestivum
EQLQSGSASSKKNLRTELPAVGDPDGVIDELQALKDKDVRWQGKCSGTVYIAGSESEGHFSLINKAYSMFSHTNPLHQDVFKSVAQLEAEVVAMTAALLGSKEKASGGQICGNMTSGGTESILLAVKTSRDYMQSKKGITKPEIIIAESAHSAYDKAAQYFNIKVRRVPVNKEFLADVKGFKRCINGNTIMMVGSAPGFPHGLIDPIEELGELASQYGICLHVDLCLGGFVLPFARKLGYPIPPFDFSVKGVTSISTDVHKYGLAPKGTSTVLYRNHEIRKHQFVAVTEWTGGLYISPTMAGSRPGGLVAGAWAAMMSLGLNGYLESTGKIMEVSRKIQKGIDDISGLFVIGKPDMTVVAFGSDAVDIFEVNDIMSSKGWHLNALQRPNSLHICVTLQHTAIYEEFLKDLEDSVNTVKANPGPISGGMAPIYGAAGKMPDRGTVKELLVEFMDSSC

SEQ ID NO: 4248 - protein, 534 aa, Papaver somniferum
SSSSVLRNRVNSYLSEYEPILLVVTPLLALLIASVLHSFFNYVQDKGFKSALIGFFMNSIKLIPFVKNYIDAEKQKVVDKMQSGGKSKRDGWQTELPKVGLGGHVIDKLREEKEKDVAWQGKCSGTVYIGGNDSERHFSLINEAYSMFAHTNPLHQDVFQSVVRFEAEVVAMTAALLGSKEKASGGQICGNMTSGGTESILLAVKTSRDYMRTKKGITKPEMIIPESAHSAYDKAAQYFNIKLWRVPVNKEFQADVKAIRRFVNKNTILIVGSAPGFPHGIIDPIEELGELASRAGICLHVDLCLGGFVLPFARKLGYPIPPFDFSVEGVTSISVDVHKYGLAPKGTSTVLYRNHEIRKHQFVAVTEWSGGLYISPTIAGSRPGGLSAGAWAAMMSLGLEGYLQNTREIMEVSKQIQKGIKEIPELFIIGRPDMTIVAFGSNDLDIFEVNDIMSSNGWHLNALQRPNSLHICATLQHVSVVEDFLRVLKEAVQTVKANPGPIKGGMAPIYGAAGKMPDRGMVHDLLVDFMDSSC

SEQ ID NO: 4249 - protein, 536 aa, Phalaenopsis aphrodite
MENTLQQLRQSANSFLSQYEPIALLSVPLLALVVARALHSLLSAIQDRGIKAVVIGFIMSSVNLIPSVRSRIESEKKKAVEKLQSSNKSNRDDWITALPSIGLGKEVLEKLEVAKCKDEDWKGKCSGTIYIGGSQSEGHFSLTNEAYSMFSHTNPLHQDVFRSVAKFEAEVVAMTAALLGSKEKESGGQICGNMTSGGTESILLAVKSSRDFMKAKKGITKPEMIIAVSAHSAYDKAAQYFNIKVRRVPVNKEFVADVKAVRRSINRNTILIIGSAPGFPHGVIDPIEELGELASCHGVCLHVDLCLGGFVLPFARKLGYPIPPFDFSVKGVTSISADVHKYGLGPKGTSVVLYRNHEIRKNQFVAVTEWSGGLYVSPTIAGSRPGGLIAGAWAAMMSLGLNGYLENTRQVMEVSKKIQKGIEEIPELFIVGKPDMTVVAFGSDVIDIFEVNDIISSKGWHLNALQRPNSLHICVTLQHVPVYEAFLNDLRESVKIVKQNPGPVSGGLAPMYGAAGKIPHRGLLQELLVEFMDGSC

SEQ ID NO: 4250 - protein, 541 aa, Papaver somniferum
MEYFSSSSVLISFRNRVNSYLSEYEPILLVVTPVVALFIASVLHSFFNYVQDKGFKSALIGFFMNSIKLIPFVKNYIDAEKQKVVDKMQSGGKSKRDGWQTELPKVGLGGHVIDKLKEEKEKDVAWQGKCSGTVYIGGNDSERHFSLINEAYSMFAHTNPLHQDVFQSVVRFEAEVVAMTAALLGSKEKASGGQICGNMTSGGTESILLAVKTSRDYMRTKKGITKPEMIIPESAHSAYDKAAQYFNIKLWRVPVNKEFQADVKAIRRFVNRNTILIVGSAPGFPHGIIDPIEELGELASSMGICLHVDLCLGGFVLPFARKLGYPVPPFDFSVEGVTSISVDVHKYGLAPKGTSTVLYRNHEIRKHQFVAVTEWSGGLYISPTIAGSRPGGLSAGAWAAMMSLGLEGYLQNTREIMEVSKQIQKGIKEIPELFIIGRPDMTIVAFGSNDIDIFEVYDIMSSNGWHLNALQRPNSLHICVTLQHVSVVEDFLRVLKEAVQTVKANPGPIKGGMAPIYGAAGKMPDRGMVHDLLVDFMDSSC

SEQ ID NO: 4251 - protein, 536 aa, Musa acuminata
MEDRMLRLRAAANAALSRYEPLALVVAPLLTLLLARSLHALFLSVREKGIKAAVLGFLIASVKSIPGVSWYIESEKKKVVEKLQSGSKSKRDSWRTELPNIGLGKATIQELEDARNKDIAWQGKCSGTVYIGGSDSENHFALINEAHAMFSHTNPLHQDVFQSVARYEAEVVAMTAALLGSREPASGGQICGNMTSGGTESILLAVKTSRDYMRTKKGITKPEMIIPGSAHSAYDKAAQYFNIKLWRVPVNKDYVADVKRIMRCINGNTILIVGSAPGFPHGVIDPIEELGDLASRYGVCLHVDLCLGGFVLPFARKLGYPIPPFDFSVKGVTSISTDVHKYGLGPKGTSVVLYRNREIRKHQFVAVTEWSGGLYVSPTMAGSRPGGLIAGAWAAMMSLGLNGYLENTRQMMEVSKKIQKGIEEIPGLFIIGQPHMTVVAFGSNDIDIFEVNDMMTSKGWHLNALQKPNSIHICVTLQHLHVVGDFLRDLRESVKMVKENPGPISGGLAPLYGAAGKMPDRGIVQDLLVEFMDSSC

SEQ ID NO: 4252 - protein, 542 aa, Papaver somniferum
MEYFSSSSSVLISLRNRVNSYLSEYEPILLVVTPLTALLIASTLHSFLNHIQNQGFKSAFIGFFMNSIKLIPFVKNYIDAEKQKVVDKMQSGGKSKRDGWQTELPKVGLGGHVIDKLREEKEKDVAWQGKCSGTVYIGGNDSERHFSLINEAYSMFAHTNPLHQDVFQSVVRFEAEVVAMTAALLGSKETASGGQICGNMTSGGTESILLAVKTSRDYMRTKKGIRKPEMIIPESAHSAYDKAAQYFNIKLWRVPVNKEFQADVKAIRRFVNKNTILIVGSAPGFPHGIIDPIEELGELASSMGICLHVDLCLGGFVLPFARKLGYPIPPFDFSVEGVTSISVDVHKYGLAPKGTSTVLYRNHEIRKHQFVAVTEWSGGLYISPTIAGSRPGGLSAGAWAAMMSLGLEGYLQNTREIMEVSKQIQKGIKEIPELFIIGRPDMTIVAFGSNDLDIFEVNDIMSSNGWHLNALQRPNSLHICVTLQHVSVVEDFLRVLKEAVQTVKANPGPVKGGMAPIYGAAGKMPDRGMVHDLLVDFMDSSC

SEQ ID NO: 4253 - protein, 454 aa, Secale cereale
LQSGSASSKKNLRTELPAVGDPDGVIGELQALKDKDVRWQGKCSGTVYIAGSESEGHFSLINKAYSMFSHTNPLHQDVFKSVAQLEAEVVAMTAALLGSKDKASGGQICGNMTSGGTESILLAVKTTRDYMQSKKGITKPEIIIAESAHSAYDKAAQYFNIKVRRVPVNKEFLADVKGFRRCINGNTIMMVGSAPGFPHGLIDPIEELGELASQYGICLHVDLCLGGFVLPFARKLGYPIPPFDFSVKGVTSISTDVHKYGLAPKGTSTVLYRNHEIRKHQFVAVTEWTGGLYVSPTMAGSRPGGLIAGAWAAMMSLGLNGYLESTGQIMEVSKKIQKGIDGISGLFVIGKPDMTVVAFGSDAVDIFEVNDIMSSKGWHLNALQRPNSLHICVTLQHTAIYEEFLKDLEDSVNTVKANPGPISGGMAPIYGAAGKMPDRGTVKELLVEFMDSSC

SEQ ID NO: 4254 - protein, 536 aa, Eucalyptus grandis
MASAVLRLRASANSFLSQYEPLALLLAPLLAVLVARAVRSFVGILHERGLKATFIGFFMSCAKLVPAVKSYIDAEKQKVVDQLQSGGQSKRKSWRTELPRSGMGNGVIDMMKEEKRNDAVWQGKCSGTVYIRGSECEGHFSLINEACSMFAHTNPLHLDVFHSVVRFEAEVVAMTAALLGSKEKVSGGQICGNMTSGGTESILLAVKTSRDYMRAKKGITSPEMIIPESAHSAYDKAAQYFNIKLWRVPVNKEFRADVKAIKRHINRNTILIIGSAPGFPHGIIDPIEELGELASSFNICLHVDLCLGGFVLPFARKLGYPVPPFDFSVEGVTSISVDVHKYGLAPKGTSVVLYRNHDIRKHQFVAVTEWSGGLYVSPTMAGSRPGGLIAGAWAAMMSLGEEGYLENTKEIMEASKKIERGIKEIPEIFIIGRPDMTLVAFGSDVIDIFEVNDIMSSKGWHLNALQRPNSLHICVTLQHVPMVEDFLKDLKESVNTVKENPGPISGGKAPIYGAAGKMPDRGMVQELLVSFMDSAC

SEQ ID NO: 4255 - protein, 536 aa, Musa acuminata
MEDRMLRLRAAANAALSRYEPLALVVAPLLTLLLARSLHALFLSVREKGIKAAVLGLLFACVKSIPGVSWYIESEKKKVVEKLQSGSKSKRDSWRTELPNIGLGKATIQELEDARNKDIAWQGKCSGTVYIGGSDSENHFALINEAHAMFSHTNPLHQDVFQSVARYEAEVVAMTAALLSSREPASGGQICGNMTSGGTESILLAVKTSRDYMRTKKGITKPEMIIPGSAHSAYDKAAQYFNIKLWRVPVNKDYVADVQRIRRCINGNTILIVGSAPGFPHGVIDPIEELGDLASRYGVCLHVDLCLGGFVLPFARKLGYPIPPFDFSVKGVTSISTDVHKYGLGPKGTSVVLYRNREIRKHQFVAVTEWSGGLYVSPTMAGSRPGGLIAGAWAAMMSLGLNGYLENTRQMMEVSKKIQKGIEEIPGLFIIGQPHMTVVAFGSNDIDIFEVNDMMTSKGWHLNALQKPNSIHICVTLQHLHVVGDFLRDLRESVKMVKENPGPISGGLAPLYGAAGKMPDRGIVQDLLVEFMDSSC

SEQ ID NO: 4256 - protein, 536 aa, Amorphophallus konjac
MEGYAARLRAAANAALSQYEPVVLVTSPLLALLVAWAVHALLSHLREKGAKAAAVGAFMAAVKLIPGVNSYIQSEKRKVADKLQSSIKSGRDSWRTELPGLGLGLGVLEELQEDKKKDVTWQGKCSGTVYIGGSELEGHFTLINEACSMFSHTNPLHQDIFRSIARYEAEVVAMTATLLGSKEKNSGGQICGNMTSGGTESILLAVKSSRDYMKMKRGISKPEMIIAESAHSAYDKAGQYLKIKVWRVPVNNDFQADVKAIKRYINKNTILIVGSAPGFPHGIIDPIEELGELASNFGICFHVDLCLGGFVLPFARKLGYPIPLFDFSVRGVTSISADVHKYGLGPKGTSVVLYRNHEIRKHQFVAVTEWSGGLYVSPTVAGSRPGGLIAGAWAAMMSLGLEGYLEKTREIMEVSKKIQKGIKEIPGLFIIGRPDMTVVAFGSNDVDIFEVNDIMSSRGWHLNALQRPNSLHICVTLQHVPVADDFLKDLKESVETVKQNPGPISGGLAPIYGAAGKMPDRGLVEDLLIEFMDGTC

SEQ ID NO: 4257 - protein, 541 aa, Lupinus angustifolius
MANSSITFHFNHFRVSTNSFLSQYEPLLLLITPLFSLFIAHSIRSFFNVFRDKGFKATIITFILNFIKLIPGVKSYIQAEKQKVVDQMQSGGKSKREGWLTELPSTGLGKSVLEKMKEEKRNDPVWQGKCSGTVYIGGSESDGHFFVINEACSMFAHTNPLHLDVFRSVAHFEAEVVAMTAALLGSKEHISGGQICGNMTSGGTESILLAVKTSRDYMKSKKGITRPEMIIPESAHSAYDKAAQYFNIKLWRVPVNKNFQAEAKAIRRRINKNTIMIVGSAPGFPHGIIDPIEELGHLASSYGICLHVDLCLGGFVLPFARELGYPIPPFDFSVKGVTSISVDVHKYGLAPKGTSIVLYRNHEIRKHQFVAVTEWSGGLYVSPTIAGSRPGGLIAGAWAAMISLGKEGYLKNTKEIMEASKKIQKGVEEIPELFVVGRPDMTIVAFGSDVLDIFEVNDIMSSKGWHLNALQRPNSLHICVTLQHVPVVEDFLSELKESVKTVKENPGPIKGGLAPIYGAAGKMPDRGTVQELLVEYMDGTC

SEQ ID NO: 4258 - protein, 501 aa, Tropaeolum majus
QVVQSFIGLINEKGLKASLIGGFMSFIKLFPGVQSYINAEKQKVVDQLQSGSKSTRESWRNDLPGTGFGVEVLEIMKDEKRKDVNWQGKCSGTVYIGGTETEGHFSLINEACSLFAHTNPLHLDVFQSVAKFEAEVVAMTAALLGSKEKASGGEVCGNMTSGGTESILLAVKSSRDYMKYKKGITRPEMIIPESAHSAYDKAAQYFKIKLWRVPVNKEFQADVKAIKRHINRNTILIVGSAPGFPHGIIDPIEELGELASRAGVCLHVDLCLGGFVLPFARKLGYPIPPFDFSVRGVTSISVDVHKYGLAPKGTSVVLYRNHDIRKHQFVAVTEWSGGLYVSPTIAGSRPGGLIAGAWAAMMSLGQEGYLENTKKIMEVSKRIQDGIKEIPELFIIGKPDMTIVAFGSSVVDIFEVNDILSSKGWHLNALQRPNSLHICVTLQHVPIVETFLQDMRESVQTVKENPGPIKGGLAPIYGAAGKMPDRGMVKDLLVNYMDTTC

SEQ ID NO: 4259 - protein, 198 aa, Papaver somniferum
MCTSMDWLLREQVQFYTGIMKYESTNLLLLPSGQVGFIFLQQLPEQAGGLSAGAWAAMMSLGLEGYLQNTREIMEVSKQIQKGIKEIPELFIIGRPDMTIVAFGSNDLDIFEVNDIMSSNGWHLNALQRPNSLHICVTLQHVSVVEGFLRVLKEAVQTVKANPGPIKGGMAPIYGAAGKMPDRGMVHDLLVDFMDSSC

SEQ ID NO: 4260 - protein, 541 aa, Sesamum indicum
MDFDEIFSSLNLFRASANSVLSQYEPLALLLVPILTLLVARILQSVLRVVFEKGLKSAVLEFFMASVKLVPGVQKYIDAEKQKVVDKLQGSGKSKRDGWRSELPKTGLGVEVIDKMKDEKQKDVAWQGKCSGTVYIAGNEQEGHFSLINEACSMFAHTNPLHLDVFQSVVRFEAEVVAMTASLLGSNEKASGGQICGNMTSGGTESILLAVKTSRDYMKVKKGITSPEMIIPVSAHSAYDKAAHYFKIKLWRVPVDQDFRADVKAVKRHINRNTILIVGSAPGFPHGIIDPIEELGELASTYKICLHVDLCLGGFVLPFARKLGYPVPPFDFSVQGVTSISVDVHKYGLAPKGTSVVLYRDHEIRKHQFVAVTEWTGGLYISPTIAGSRPGGLIAGAWAAMMSLGLEGYLENTRKIMEASKRIEKGVRQIPELFIIGRPDMTIVAFGSDIVDIFEVNDVMSSKGWHLNALQRPNSIHICVTLQHVAVTEDFLKDLQDSVQTVKANPGPINGGLAPIYGAAGKMPDRAMVQDLLVDFMDSSC

SEQ ID NO: 4261 - protein, 453 aa, Secale cereale
QSGSASSKKNLRTELPTVGDPDGVIGELQALKDKDVRWQGKCSGTVYIAGSESEGHFSLINKAYSMFSHTNPLHQDVFKSVAQLEAEVVAMTAALLGSKDKASGGQICGNMTSGGTESILLAVKTTRDYMQSKKGITKPEIIIAESAHSAYDKAAQYFNIKVRRVPVNKEFLADVKGFRRCINGNTIMMVGSAPGFPHGLIDPIEELGELASKYGICLHVDLCLGGFVLPFARKLGYPIPPFDFSVKGVMSISTDVHKYGLAPKGTSTVLYRNHEIRKHQFVAVTEWTGGLYVSPTMAGSRPGGLIAGAWAAMMSLGLNGYLESTGQIMEVSKKIEKGIDGISGLFVIGKPDMTVVAFGSDVVDIFEVNDIMSSKGWHLNALQRPNSLHICVTLQHTGIYEEFLKDLEDSVNTVKANPGPISGGMAPIYGAAGKMPDRGTVKELLVEFMDSSC

SEQ ID NO: 4262 - protein, 543 aa, Petroselinum crispum
MEWLSWLCSNYVDEFRGFANEYLSKYEPLVLVIFPVLSLVLALFLHSLLGVISDKGLKPTLLGFFMSFLKLVPGVQKYIDGEKQKVVDKLQSSDKAKRDGWASELPKSGLGFGVIDRLKEQKTNDVAWQGKCSGTVYISGTESEGHFSLINEACAMFAHTNPLHLDVFQSVVRCESEVVAMTAALLGSKEKCSGGQICGNMTSGGTESILMAVKSSRDYMKAKKGITRPEMIIPVSAHSAYDKAAQYFNIKLWRVPVNKEFQADSRAIKRFINKNTILIVGSAPGFPHGIIDPIEELGELASKYGICLHVDLCLGGFVLPFARKLGYPIPPFDFSVKGVTSISADVHKYGLAPKGTSVVLYRNHEIRKCQFVAVTEWTGGLYVSPTMAGSRPGGLIAGAWAALMSLGMEGYLEHTREIMEASKRLQKGLKEISELYIIGRPDMTVVAFGSHNLDIFEVNDIMSSKGWHLNALQRPNSIHICITLQHVAVIDSFLKDLRDSVQTVKENPGPVSGGLAPIYGAAGKMPDRGMVGDLLVDFMDSSC

SEQ ID NO: 4263 - protein, 537 aa, Vitis vinifera
MESSFFSHMRAAANSFLSEYEPLNLLLAPLLALLIARILQCFVGVVNEKGLKATILGFLITSVKLVPGVKRYIDAEKQKVVDKLQSGSKSKRDGWSTELPRTGLGEGVIEKMKEEKRNDVVWQGKCSGTVYIGGSESEGHFSLINEACSMFAHTNPLHMDVFQSVVRFEVEVVAMTAALLGSKEKASGGQICGNMTSGGTESILLAVKTSRDYMKAKRGITRPEMIIPESAHSAYDKAAQYFNIKLLRVPVNKEFQADVKGIRRRINKNTILIVGSAPGFPHGIIDPIEELGELASSFGICFHVDLCLGGFVLPFARKLGYPIPPFDFSVEGVTSISVDVHKYGLAPKGTSVVLYRNHDIRKHQFVAVTEWSGGLYVSPTIAGSRPGALIAGAWAAMISLGQEGYLNNTRETMEVSKKLQRGIKDIPELFVIGRPDMTIVAFGSNVVDIFEVNDILSSKGWHLNALQRPNSIHICLTLQHVTILEDFLKDLKESVQTVKQNPGPINGGLAPIYGAAGKMPDRGMVGELLVNFMDGTC

SEQ ID NO: 4264 - protein, 388 aa, Fagus grandifolia
MFAHTNPLHLDVFQSVVRFEAEVVAMTAALLGSKEKGSGGQICGNMTSGGTESILLAVKSSRDYMKTKKGITKPEMVIAESAHSAYDKAAQYFNIKLWRVPVNKEFQADVKAIRRHINRNTILIVGSAPGFPHGIIDPIEELGELASNFGICLHVDLCLGGFVLPFARKLGYPIPPFDFSVKGVTSVSVDVHKYGLAPKGTSVVLYRNHDIRKHQFVAVTEWSGGLYVSPTIAGSRPGGLIAGAWAAMMSLGEEGYLENSKKIMEVSKRMQKGIEEIPELFIIGRPDMTIVAFGSNVVDIFEVNDVMSSKGWHLNALQRPNSIHICLTLQHVPIVEEFLMDLTESVKTVKENPGPISGGLAPIYGAAGRMPDRVMVQDLLVNYMDGTC

SEQ ID NO: 4265 - protein, 541 aa, Ricinus communis
MEMDSVKELLIQFRVTANSFLSEYEPLALVLAPLLTLLLARILHSLFRVFYENGLKSTLFGFLMASIKLVPGVKSYIDAEKQKVVDKLQSGSKSKREGWRVELPMEGLGTEIIEKMKEEKRNDAVWQGKCSGTVYIGGSESEGHFSIINEACSMFAHTNPLHLDVFQSIARFEAEVVAMTASLLGSKEKASGGEICGNMTSGGTESILLAVKSSRDYMKVKKGITRPEMIIPESAHSAYDKAAQYFNIKLWRVPVNKEFQADAKAIRRHINRNTVLIVGSAPGFPHGIIDPIEELGELAFRYGICFHVDLCLGGFVLPFARKLGYPMPPFDFSVKGVTSISVDVHKYGLAPKGTSVVLYRNHDIRKHQFVAVTEWSGGLYVSPTIAGSRPGGLIAGAWAAMMSLGLEGYLKNTKVIMEVTKKIQKGIEEMPELFVIGRPDMTIVAFGSNVLDIFEVNDILSSKGWHLNALQRPNSLHICVTLQHASVYEDFLQDLRESVQTVKQNPGPINGGLAPIYGAAGKIPDRSMVQELLVNYMDSTC

SEQ ID NO: 4266 - protein, 412 aa, Euphorbia peplus
CSATVYIGGSESEGHFSLINEACSMFAHTNPLHLDVFQSVARFEAEVVAMTASLLGSKEKASGGEVCGNMTSGGTESILLAVKSSRDYMKAKKGITTPEMIIPESAHSAYDKAAQYFNIKLWRVPVNKDFQADVKAIRRHINRNTILIVGSAPGFPHGIIDPIEELGELAFQYGICLHVDLCLGGFVLPFASKLGYPIPPFDFSVKGVTSISVDVHKYGLAPKGTSIVLYRNHDIRKHQFVAVTEWSGGLYVSPTIAGSRPGGLIAGAWAAMMSLGEEGYLENTKAIMEVSKKLQKGMMELPELFIVGKPDMTIVAFGSNVVDIFEVNDIMSSKGWHLNALQRPNSLHICITLQHVSVIDDFVQDLREAVQTVKKNPGPINGGMAPIYGAAGKIPDRGMVSELLVNYMDSTC

SEQ ID NO: 4267 - protein, 505 aa, Triphysaria pusilla
LVFARIVQSVFRVVSEKGLKSVILDFIMTSVKLVPGVQKYIDAEKQKVVDKLQGSGKSKRDGWRTELPREGLGDDVINKMKDDKQKDGAWQGKCSGTVYIAGNEEEGHFSLINEACSMFAHTNPLHLDVFPSVVRFESEVVAMTAALLGSKEKASGGQICGNMTSGGTESILLAVKTSRDYMKVKKGITSPEMIIPISAHSAYDKASQYFKIKLWRVPVGQDFRADVKAIKRHINRNTILIVGSAPGFPHGIIDPIEELGELASSYGVCLHVDLCLGGFVLPFARKLGYPIPPFDFTVKGVTSISVDVHKYGLAPKGTSVVLYRDHDIRKHQFVAVTEWTGGLYVSPSIAGSRPGGLIAGAWAAMMSLGLEGYLENTRKIMETSKRIEKGVREIPELFIVGRPDMTIVAFGSEILDIFEVNDLMSSKGWHLNALQRPNSIHICVTLQHVTVAEEFLKDLSDSVQTVKANPGPINGGLAPIYGAAGKMPDRAMVQDLLVDFMDGSC

SEQ ID NO: 4268 - protein, 541 aa, Manihot esculenta
MDMASLYSLFNEFRASANSFLSEYEPLVLLIVPLFTLILARILRSFLRVLYENGLRATIIGFLMTCIKMVPWVKSYIDAEKQKVVDKMQSGGKSKRESWRSELPREGLGAGVLEKMKEEKRNDIAWRGKCSGTVYIGGTESEGHFSLINEACSMFSHTNPLHFDIFQSVARFEAEVVAMTASLLGSKEKASGGEVCGNMTSGGTESILLAVKSSRDYMKGKKGITRPEMIIPESAHSAYDKAAQYFNIKLWRVPVNEEFQANVKAIRRHINKNTILIVGSAPGFPHGIIDPVEELGELALQYGICLHVDLCLGGFVLPFARQLGYPISPFDFSVKGVTSISVDVHKYGLAPKGTSVILYRNHDIRKHQFVAVTEWSGGLYVSPTIAGSRPGGLIAGAWAAMMSLGQEGFLENTKAIMKASKKIQKGIKEIPELFIIGKPDMTIVAFGSNVLDIFEVNDIMSSKGWHLNALQRPNSLHICVTLQHVSVCEDFLQDLRESVQTVKENPGPISGGLAPIYGAAGRIPDRVMVKELLVNYMDSTC

SEQ ID NO: 4269 - protein, 541 aa, Castanea mollissima
MDSSSLKSFLISFRASANSFLSQYEPLALLLAPLLAFFLARTLHSFLTLLHQRGLKATLFGFFMTLIKLVPGVKNYIDAEKQKVVDKLQSGGKSKREAWRTELPGAGLGVGVIEKMKDLKRNDVAWQGKCSGTVYIGGNESEGHFSVINEACSMFAHTNPLHLDVFQSVVRFEAEVVAMTAALLGSQEKGSGGQICGNMTSGGTESILLAVKSSRDYMKTKKGITKPEMIIPESAHSAYDKAAQYFNIKLWRVPVNKEFQADVKAIRRCINRNTILIVGSAPGFPHGIIDPIEDLGELATSFRICLHVDLCLGGFVLPFACKLGYPIPPFDFTVKGVTSISVDVHKYGLAPKGTSVVLYKNRDIRKHQFVAVTEWSGGLYVSPTIAGSRPGGLIAGAWAAMMSLGEEGYLENTKKIMEVSKRLQKGIEEIPELFIIGRPDMTIVAFGSNVVDIFEVNDSMSSKGWHLNALQRPNSIHICLTLQHVPIVEEFLRDLMESVKTVKENPGPISGGLAPVYGAAGKMPDRGMIQELLVNYMDGTC

SEQ ID NO: 4270 - protein, 543 aa, Gossypium raimondii
MDSYSSWLNSFLVRFRLSANLFLSQFEPLALLLAPLLTLFIARLLHSLLSVIHEKGLKATVLVLFMSSIKLVPGVQSYIDAEKQKVVDKLQSGSKSKREHWRTELPTTGLGVGVIEEMKDVKSNDADWKGKCSGTVYIGGSESEGHFSLINEASSMFAHTNPLHLDVFQSVARFEAEVVAMTADLLGSKEKASGGQVCGNMTSGGTESILLAVKTSRDYMKAKKGITRPEMIIAESAHSAYDKAAQYFNIKLRRVPVNKEFKADVKAIRKQINRKTILIVGSAPGYPHGIIDPIEELGKLADSYGICLHVDLCLGGFVLPFARKLGYPIPPFDFTVRGVTSISADVHKYGLAPKGTSVVLYRNHDIRKHQFVAVTEWSGGLYVSPTIAGSRPGGVIAGAWAAMMSLGQQGYLENTRKIMEVSKMIQKGIKEIPELFIIGNPDMTIVAFGSAVLDIFEVNDIMSGKGWHLNALQRPNSIHICVTLQHVPVVDAFLQDLREAVQTVKENPGPISGGLAPIYGAAGKMPDRGMVQDLLVNYMDGTC

SEQ ID NO: 4271 - protein, 541 aa, Quercus alba
MDSSSLKSFLISFRASANSFLSQYEPLALLLAPLLAFFVACTLHSFLTLLHQRGLKATLVGFFMTLIKLVPGVKNYIDAEKQKVVDKLQSGGKSKRAAWRTELPRAGLGVGVIEKMKDEKRNDVAWQGKCSGTVYIGGNESEGHFSVINEACSMFAHTNPLHLDVFQSVVRFEAEVVAMTAALLGSQEKGSGGQICGNMTSGGTESILLAVKSSRDYMKTKKGITKPEMIIPESAHSAYDKAAQYFNIKLWRVPVNKEFQADVKAIRRRINRNTIFIVGSAPGFPHGIIDPIEDLGELATSFGICLHVDLCLGGFVLPFARKLGYPIPPFDFTIKGVTSISVDVHKYGLAPKGTSVVLYKNHDIRKHQFVAVTEWSGGLYVSPTIAGSRPGGLIAGAWAAMMSLGEEGYLENTKKIMEVSKRLQKGIEEIPELFIIGRPDMTIVAFGSNVVDIFEVNDTMSSKGWHLNALQRPNSIHMCLTLQHVPIVEEFLRDLTESVKTVKENPGPISGGLAPVYGAAGKMPDRGMIQELLVNYMDGTC

SEQ ID NO: 4272 - protein, 539 aa, Olea europaea
FSEFFSGLHRFRASANSYLVQFEPLALMFLPILTLLVARSFQSIFRVFYEKGFKASILGFFFTFVKLVPGVKNYMDREKQKVVTNLQASGKSKREGWRTELPKAGLGGMVIEKMKDEKQNDAAWQGKCSGTVYIGGNEYEGHFSLINEACSMFAHTNPLHLDVFPSVVRFEAEVVAMTAALLGSKEKASGGQICGNMTSGGTESIVLAVKASRDYMKAKKGITRPEMIIPASAHSAYDKAAHYFNIKLWRVPVNKDFRADVKAIKRHINRNTILVVGSAPGFPHGIIDPIEELGELATTLRICFHVDLCLGGFVLPFARKLGYPVPPFDFSVQGVTSISVDVHKYGLAPKGTSVVLYRDHDIRKHQFVAVTEWTGGLYVSPTIAGSRPGGLIAGAWAAMMSLGVEGYLDNTRVIMEASKRIEKGVREISDLFVVGRPDMTIVAFGSDVIDIFEVNDIMSSKGWHLNALQRPNSIHICVTLQHVPVIEDFLKDLKDSVQTVKANPGPISGGLAPIYGAAGKIPDRVMVEDLLVDFMDSSY

SEQ ID NO: 4273 - protein, 539 aa, Aquilegia formosa
MEEISSFLIKIRTTTNSFLSQYEPLLLLITPLLVLFFTFNLQSFFNFVQDKGLKPTLIGFFMTSIKFIPGVNNHIEAEKQKVVDKLQSGSKSKRDGWMTELPKAGLGGGVIEKLRDEKGNDVVWQGKCSGTVYIGGSESEGHFSVINEAYTMFSHTNPLHQDVFQSVVRFEGEVVAMTAALLGSKEKACGGEICGNMTSGGTESILLAVKSSRDYMKTKKGITKPEMIIPESAHSAYDKAAQYFNIKLWRVPVNKEYQADVKAIRRFINKNTILIVGSAPGFPHGIIDPIEELGELALSFGVCLHVDLCLGGFVLPFARKLGYPIPPFDFSVEGVTSISVDVHKYGLAPKGTSVVLYRNHTIRKNQFVAVTEWSGGLYVSPTIAGSRPGGLIAGAWAAMMAVGQEGYLENTRKIMEVSKSLQRGIKDIPELFIIGRPDMTIVAFGSNDLDIFEINDQMSSRGWHLNALQRPNSIHICVTLQHVPVVEDFLRDLRESVQTVKKNPGPISGGLAPIYGAAGRMPDRGMVQDLLVNFMDSSC

SEQ ID NO: 4274 - protein, 519 aa, Gossypium hirsutum
QFEPLALLLAPLLTLFIARLLHSLLSVIHEKGLKATVLALFMSSIKLVPGVQSYIDAEKQKVVDKLQSGSKSKREHWRTELPTTGLGVGVIEEMKDVKSNDADWKGKCSGTVYIGGSESEGHFSLINEASSMFAHTNPLHLDVFQSVARFEAEVVAMTADLLGSKEKASGGQVCGNMTSGGTESILLAVKTSRDYMKAKKGITRPEMIIAESAHSAYDKAAQYFNIKLRRVPVNKEFKADVKAIRKQINRKTILIVGSAPGYPHGIIDPIEELGKLADSYGICLHVDLCLGGFVLPFARKLGYPIPPFDFTVRGVTSISADVHKYGLAPKGTSVVLYRNHDIRKHQFVAVTEWSGGLYVSPTIAGSRPGGVIAGAWAAMMSLGQQGYLENTRKIMEVSKMIQKGIKEIPELFIIGNPDMTIVAFGSAVLDIFEVNDIMSGKGWHLNALQRPNSIHICVTLQHVPVVDAFLQDLREAVQTVKENPGPISGGLAPIYGAAGRMPDRGMVQDLLVNYMDGTC

SEQ ID NO: 4275 - protein, 293 aa, Nicotiana benthamiana
MEFPDPPWLNQFRASTNSFLSQYEPLTLLLSPLFGLLLAQILQSFFLVIHERGLKATIISFVMSSVKLVPGVSKYIDAEKQKIVDKLQASGNRDGWKTELPRSGLGNKALEQMKDEKQKDVTWQGKCSGTVYIGGNEHEGHFSLINEACSMFAHTNPLHLSVFPSVVRFEAEVVAMTAALLGSKEKTSGGQICGNMTSGGTESILLAVKSSRDYMKAKNGITKPEMIIPVSAHSAYDKAAQYFKIKLWRVPVDKEFRADVKAVNRHINKNTIMIVGSAPGFPHGIIDPIEATW

SEQ ID NO: 4276 - protein, 537 aa, Cajanus cajan
MDSSSISQFRATANSFLSQYEPLALLLAPLLSLLLAHSLRSFFLLLRDNALKPTLLGFLISSAKLVPGVKGYIEAEKRKVVDKMQSDGKSKREGWKTELPSTGLGTSVLEKMTEEKINDAAWQGKCSGTVYIGGSESDGHFSLINEACSMFAHTNPLHLDVFKSVARFEAEVVAMTAALLGSKEKSSGGQICGNMTSGGTESILLAVKSSRDYMKSKKGITRPEMIIPESGHSAYDKAAQYFNIKLWRVPVNKSFQADVKAIRRHINKNTILIVGSAPGFPHGIIDPIEELGHLASSFGICFHVDLCLGGFVLPFARELGYNIPPFDFSVKGVSSISVDVHKYGLAPKGTSVVLYRNHEIRKHQFVAVTEWSGGLYVSPTIAGSRPGSLIAGAWAAMISLGKEGYLKNTKAIMEGSGRIQKGIEEITELYIVGRPDMTIVAFGSDVLDIFEVNDIMSSKGWHLNALQRPNSLHICVTLQHVPIVEDFLKDLKESVKIVKENPGPISGGLAPIYGAAGKMPDRGMVQELLVDYMDGTC

SEQ ID NO: 4277 - protein, 541 aa, Malus domestica
MDSASVKTFLLDVRASANSLLSQYEPLVLVSAPLFALLVASTLQSAIHGLQEKGLKATLLGFFMSFIKLVPGVKSYIDAEKQKVVDKLQSGGKSGRESWRTELPSSGLGVGVIEKMKDEKSKDVAWQGKCSGAVYIGGSEVEGHFSVINEACSVFAHTNPLHMDVFKSVVRFESEVVAMTAALLGSKKKSSGGQICGNMTSGGTESILLAVKSSRDYMKTRKGIKKPEMIIPESAHSAYDKAAQYFNIKLWRVPVNKEFQADVKAIRRHINKNTVLIVGSAPGFPHGIVDPIEELGQLASSFDICLHVDLCLGGFVLPFANKLGYPIPPFDFSVKGVTSISADVHKYGLAPKGTSTVLYRNHDIRKHQFVAVTEWSGGLYVSPTIAGSRPGGLIAGAWAAMMSLGEEGYLENTKNIMEASKRLQKGIEEIPELFIIGKPDMTVVAWGSNVVDIFEVNDIMSSKGWHLNALQRPNSIHICVTLQHVPVIDDFLRDLRGSVKTVKENPGPISGGLAPIYGAAGRMPDRGMVQELLVNYMDGTC

SEQ ID NO: 4278 - protein, 458 aa, Cicer arietinum
VVDKMQSDGKSKREGWNTELPNAGLGTSALEKMREEKRNDAVWQGKCSGTVYIGGSESGEHFSLINEACSMFAHTNPLHLDVFRSVVRFEGEVVAMTAALLGSKEKTSGGQICGNMTSGGTESILLAVKSSRDYMKSKKGITRPEMIIPESGHSAYDKAAQYFNIKLWRVPVNKNFQADVKAIRRHINKNTVLIVGSSPGFPHGIIDPIEELGNLASSFGICFHVDLCLGGFVLPFARELGYDIPPYDFSVKGVTSISVDVHKYGLAPKGTSIVLYRNHEIRKHQFVAVTEWSGGLYVSPTIAGSRPGSLIAGAWAAMMSLGKEGYLENTKAIMEGSKRLQKGIEEIAELFIIGKPDMTIVAFGSDVLDIFEVNDIMSSKGWHLNALQRPNSIHICVTLQHVPVVEDFLRDLKESVKTVKENPGPISGGLAPIYGAAGKMPDRGMVQELLVDFMDGSY

SEQ ID NO: 4279 - protein, 540 aa, Prunus mume
MDSSVKSFLLDVRAFANSFLSEYEPLVLVSAPLIALFVASMLQSALQVLHENGLKATLLGFFMSFVKLVPGVKSYIDAEKQKVVDKLQSGGKSVRESWRTELPSTGLGVGVIEQMKDEKRKDVAWQGKCSGAVYIGGSECEGHFSLINEACSMFAHTNPLHMDVFQSVVRFEAEVVAMTAAMLGSKKKSSGGQICGNMTSGGTESILLAVKSSRDYMKTMKGIKKPEMIIPESAHSAYDKAAQYFNIKLWRVPVNKEFQADVKAIRRYINRNTILIVGSAPGFPHGIVDPIEELGQLASSFDICLHVDLCLGGFVLPFANKLGYPIPPFDFSVKGVTSISADVHKYGLAPKGTSVVLYRNHDLRKHQFVAVTEWSGGLYVSPTIAGSRPGGLIAGAWASMISLGEEGYLENTKKIMEVSKRLQKGIEEIPELFVIGRPDMTVVALGSNVVDIFEVNDIMSSKGWHLNALQRPNSIHICVTLQHVPIIDDFLRDLTESVKTVKENPGPISGGLAPIYGAAGRMPDRGTVQELLVNYMDGAF

SEQ ID NO: 4280 - protein, 293 aa, Solanum phureja
MAFPIPPWLNQYRASANSFLSQYEPLILLITPLFSLLIARILQSIFLVIHERGLKATIISFVMSAIKLVPGVKKYIDSEKQKIVDKLQGSSNRDGWRTELPKTGLGDNVLVQMRDEKQKDVTWQGKCSGTVYIGGNENEGHFSLINEACSMFAHTNPLHLSVFPSVVRFEAEVVAMTAAILGSKEKASGGQICGNMTSGGTESILLAVKSSRDYMKAKKGITKPEMIIPVSAHSAYDKAAQYFKIKLWRVPVDKEFRADVKAIKRYINKNTIMIVGSAPGFPHGIIDPIEATW

SEQ ID NO: 4281 - protein, 536 aa, Glycine max
MDSSISHFRASANSFLSQYEPLALLLAPLLSLLFALALRSFFHLLSENGLKATLLGFLINSFKLVPGVKRYIDAEKQKVVDKLQSDSKSKREGWKTELPSTGLGTTVLEKMREEKINDAVWQGKCSGTVYIGGSESDGHFSLINEACSMFAHTNPLHLDVFKSVARFEAEVVAMTAALLGSKEKSSGGQICGNMTSGGTESILLAVKSSRDYMKSKKGITRPEMIIPESGHSAYDKAAQYFNIKLWRAPVNKNFQADAKAIRRHINKNTILIVGSAPGFPHGVIDPIEELGHLASSFGICFHVDLCLGGFVLPFARELGYHIPPFDFSVKGVSSISVDVHKYGLAPKGTSVVLYRNHEIRKHQFVAVTEWSGGLYVSPTIAGSRPGSLIAGAWAAMMSLGKEGYLKNTKAIMEGSRRIQKGIEEIAELFIVGKPDMTIVAFGSAVLDIFEVNDVMSSKGWHLNALQRPNSIHICVTLQHVPIVEDFLNDLKESVKTVKANPGPISGGLAPIYGAAGKMPDRGMVQELLVDYMDGTC

SEQ ID NO: 4282 - protein, 535 aa, Glycine max
MASISHFRTSANSFLSQYEPLSLLLAPLLSLLFAHALRSFFHLLSQNGLKATLLGFLINSLKLVPGVKGYIDAEKQKVVDKLQSDGKSKREGWKTELPSTGLGTSVLEKMREEKINDAVWQGKCSGTVYIGGSESDGHFSLINEACSMFAHTNPLHLDVFKSVARFEAEVVAMTAALLGSKEKSSGRQICGNMTSGGTESILLAVKSSRDYMKSKKGITRPEMIIPESGHSAYDKAAQYFNIKLWRVPVNKNFQADVKAIRRHINKNTILIVGSAPGFPHGVIDPIEELGHLASSFGICFHVDLCLGGFVLPFARELGYHIPPFDFSVKGVSSISVDVHKYGLAPKGTSVVLYRNHEIRKHQFVAVTEWSGGLYVSPTIAGSRPGSLIAGAWAAMISLGKEGYLKNTKEIMEGSRRIQQGIEEIAELFIVGKPDMTIVAFGSDVLDIFEVNDVMSSKGWHLNALQRPNSIHICVTLQHVPIVEDFLNDLKESVKTVKANPGPISGGLAPIYGAAGKMPDRGMVQELLVDYMDGTC

SEQ ID NO: 4283 - protein, 541 aa, Valeriana officinalis
MESSWSCLNHSRVTLNSFLNQYEPLVLLLAPLLSLLLARILHSFFHVIYHKGVKATLLGFFMTSIKLVPGVKKYIDAEKQKVVDKMQSSGKSERNEWRSELPRSGLGVGVIEKMKDEKRKDVVWQGKCSGTVYIGGSESEGHFSLINEACSMFAHTNPLHLDVFKSVVRFEAEVVGMTAALLGSKDEKCFGGEKICGNMTSGGTESILLAVKSSRDYMMAKKGIVVPEMIIPESAHSAYDKACQYFNIKLWRVPVNKDFQADVRSIKRFINKNTILIVGSAPGFPHGIIDPIEELGELAYRTGVCFHVDLCLGGFVLPFARKLGYPLPPFDFCVQGVTSISVDVHKYGLAPKGTSVVLYRNHDIRKHQFVAVTEWSGGLYVSPTIAGSRPGGLIAGAWAAMMSLGMEGYLEHTRNIMEASKRLQKGTEEIRELFIIGKPDMTIVAFGSDSIDIFEVNDLMSSKGWHLNALQRPNSIHICVTLQHVPIVDEFLKDLRDSVETVKANPGPVSGGMAPIYGAAGRMPDRSMVKELLVDFMDTSC

SEQ ID NO: 4284 - protein, 541 aa, Trifolium pratense
MDSSVLTSYFNNFRTTANSFLSQYEPLTLVLVPLFSLFLANVIRSFFSVIHDKGLKATVLGFFMNFIKLIPGVKSYIDAEKQKVVDKLQSDGKSKREGWKTELPSTGLGTSVLEKMSEEKRNDAVWQGKCSGTVYIGGSESSAHFSVINEACSMFAHTNPLHLDVFQSVVRFEAEVVAMTAALLGSKEKTSGGQICGNMTSGGTESILLAVKSSRDYMKSKKGITRPEMIIPESGHSAYDKAAHYFNIKLWRVPVNKKFQADVKAIRSHINKNTILIVGSSPGFPHGIIDPIEELGQLASSFGICFHVDLCLGGFVLPFARELGYHIPPYDFSVKGVTSISADVHKYGLAPKGTSVVLYRNHEIRKHQFVAVTEWSGGLYVSPTIAGSRPGSLIAGAWAAMMSLGKAGYLENTKAIMEGSKRLQKGIEEIPELFIIGKPDMTIVAFGSNVLDIFEVNDIMSSKGWHLNALQRPNSIHICVTLQHVPVIEDFIKDLKESVNTVKENPGPISGGLAPIYGAAGKMPDRGMVQELLVDFMDGTC

SEQ ID NO: 4285 - protein, 542 aa, Panax ginseng
MESSSLFWTSLNRFRASANGLLSEYEPLTLLLAPIFSLLFARILQSFLHLVNDKGLKATLLGFLVTSIKLVPGVKKYIDAEKQKVVDKLQSSGKSKRDGWENELPKAGLGFGVIERMKNDKRNDVVWQGKCSGTVYIGGTESEGHFSLINEACSMFAHTNPLHQDVFQSIVRFEAEVVAMTAALLGSKERSSGGQICGNMTSGGTESILLAVKSSRDYMKARKGITRPEMIIPESAHSAYDKAAQYFNIKLWRIPVNKEFQADVQAIKRFITKNTILIVGSAPGFPHGIIDPIEELGELAFSFGVCFHVDLCLGGFVLPFARKLGYPVPPFDFSVQGVTSISVDVHKYGLAPKGTSVVLYRNHDIRKCQFVAVTEWSGGLYVSPTIAGSRPGGLIAGAWAAMMSLGLEGYMENTREIMEASKKLQKGLKEIPEVFIIGRPDMTIVAFGSHTVDIFEVNDIMSSKGWHLNALQRPNSIHICLTLQHVPVIGDFLKDLRDSVQTVKENPGPINGGLAPIYGAAGKMPDRGMVQELLVDFMDSSC

SEQ ID NO: 4286 - protein, 84 aa, Mimulus guttatus
MDLEAILASMNQLRASANSFLSQYEPLALISIPIFTLLFARIVHSISRLVSDKGLKSTILDFFMASLKLVPGVKKYIDAEKQRL

SEQ ID NO: 4287 - protein, 541 aa, Fragaria vesca
MDFSPVKSFLLGARASANSFLEGYEPLVLFSTPLIGLLVASRLQSVISVLQENGVKATLIGLFMSFIKLVPGVKKYIDAEKQKVVDQLQSGGNSKRENWRTELPGAGLGAGVLDQMKEEKRKDVAWQGKCSGTVYIGGSEFEGHFSLINEACSMFAHTNPLHMDVFQSVVRFEAEVVAMTAAMVGSKTKSSGGQICGNMTSGGTESILLAVKTSRDYMKARKGIKKPEMIIPESAHSAYDKAAQYFNIKLWRVPVDKEFQADVKAIRKFINRNTVLIVGSAPGFPHGIIDPIEELGQLASSFDICLHVDLCLGGFVLPFAQKLGYPIPPFDFSVKGVTSISADVHKYGLAPKGTSIVLYRNHDIRKHQFVAVTEWSGGLYVSPTMAGSRPGGLIAGAWAAMMALGEEGYLENTRAIMEVSKKLQKGLEDIPELFIIGRPDMTVVAFGSNVVDIFEVNDIMSSKGWHLNALQRPNSIHICMTLQHVPILDDFLRDLRESVKTVKENPGPISGGLAPIYGAAGRMPDRGMVQDLLVNYMDGTC

SEQ ID NO: 4288 - protein, 540 aa, Cichorium intybus
MESSILPAVIRLRASANSFLSQFEPLVLVVAPLVSFLVAQIVQSLIQVVHEKGLKATLIVSFMTCVKLVPGVKRYIDAEKQKVVDKLQSSGKSKRDGWRTELPSTGLGSGVLEQMKNEKQKDAAWQGKCSGTVYIGGNESEGHFSLINEACSMFAHTNPLHLDVFKSVVRFEAEVVGMTAALLGSKEKACGGQICGNMTSGGTESILLAVKSSRDYMKAKKNITCPEMIIPESAHSAYDKAAQYFKIKLWRVPVNKEFQADAKAIKKYINKNTVLIVGSAPGFPHGVIDPIEELGELASSYGICLHVDLCLGGFVLPFARKLGYPIPPFDFSVQGVTSISADVHKYGLAPKGTSIVLYRNHEIRKHQFVAVTEWSGGLYVSPTIAGSRPGSLIAGAWAAMLSLGQEGYLEHTREIMEASKRLQKGVKEIPELFIIGRPDMTIVAFGSIVIDIFEVNDILSSKGWHLNPLQRPNSIHICVTLQHVPIVDDFLKDLKDSVQTVKENPGPVSGGLAPIYGAAGKIPDRGMVNELLVDYMDNAC

SEQ ID NO: 4289 - protein, 540 aa, Cichorium intybus
MESSILPAVIRLRASANSYLSQFEPLVLVVAPLVSFLVAQIVQSLIQVVHEKGLKATLIVCFMTCVKLVPGVKRYIDAEKQKVVNKLQSSGKSKRDGWRTELPSTGLGSGVLEQMKNEKQKDAAWQGKCSGTVYIGGNESEGHFSLINEACSMFAHTNPLHLDVFKSVVRFEAEVVGMTAALLGSKEKACGGQICGNMTSGGTESILLAVKSSRDYMKAKKNITCPEMIIPESAHSAYDKAAQYFKIKLWRVPVNKEFQADAKAIKKYINKNTVLIVGSAPGFPHGVIDPIEELGELASSYGICLHVDLCLGGFVLPFARKLGYPIPPFDFSVQGVTSISADVHKYGLAPKGTSIVLYRNHEIRKHQFVAVTEWSGGLYVSPTIAGSRPGSLIAGAWAAMLSLGQEGYLEHTREIMEASKRLQKGVKEIPELFIIGRPDMTIVAFGSIVIDIFEVNDILSSKGWHLNPLQRPNSIHICVTLQHVPIVDDFLKDLKDSVQTVKENPGPVSGGLAPIYGAAGKIPDRGMVNELLVDYMDNAC

SEQ ID NO: 4290 - protein, 542 aa, Panax ginseng
MESLSSFWTSLNRFRASANGLLSEYEPLTLLLAPIFSLLFARILQSFLHLVNDKGLKATLLGFLVTSIKLVPGVKKYIDAEKQKVVDKLQSSGKSKRDGWENELPKAGLGFGVIERMKNDKRNDVVWQGKCSGTVYIGGTESEGHFSLINEACSMFAHTNPLHQDVFQSIVRFEAEVVAMTAALLGSKERSSGGQICGNMTSGGTESILLAVKSSRDYMKARKGITRPEMIIPESAHSAYDKAAQYFNIKLWRIPVNKEFQADVQAIKRFITKNTILIVGSAPGFPHGIIDPIEELGELAFSFGVCFHVDLCLGGFVLPFAQKLGYPVPPFDFSVQGVTSISVDVHKYGLAPKGTSVVLYRNHDIRKCQFVAVTEWSGGLYVSPTIAGSRPGGLIAGAWAAMMSLGLEGYMENTREIMEASKKLQKGLKEIPEVFIIGRPDMTIVAFGSHTVDIFEVNDIMSSKGWHLNALQRPNSIHICLTLQHVPVIGDFLKDLRDSVQTVKENPGPINGGLAPIYGAAGKMPDRGMVQELLVDFMDSSC

SEQ ID NO: 4291 - protein, 540 aa, Lactuca sativa
MESSILPAIIRLRASANSFLSQFEPLLLVVAPLITFLVAQIVQSFIQVVHEKGFKATLIGFIMTWVKLVPGVKSYIDAEKQKVVDKLQSSGKSSRDGWRTELPSSGLGNRVLEQMKNEKEKDAAWQGKCSGTVYIGGNESEGHFSLINEACSMFAHTNPLHLDVFKSVVRFEAEVVAMTAALLGSKEKASGGQICGNMTSGGTESILLAVKSSRDYMKASKSITCPEMIIPESAHSAYDKAAQYFKIKLWRVPVNKEFQADVKAIKKYINKNTILIVGSAPGFPHGIIDPIEELGELALSYRICLHVDLCLGGFVLPFARKLGYPIPPFDFSVQGVTSISADVHKYGLAPKGTSIVLYRNHEIRKHQFVAVTEWSGGLYVSPTIAGSRPGSLIAGAWAAMLSLGQEGYLEHTREIMEASKRLQNGVKQIPELFVIGRPDMTIVAFGSNVIDIFEVNDLLSSKGWHLNPLQRPNSIHICVTLQHVPIVDDFLKDLKDSVQIVKQNPGPISGGLAPIYGAAGKIPDRGMVNELLVDYMDNAC

SEQ ID NO: 4292 - protein, 541 aa, Plantago ovata
MDSDEIFLHLNRYRASVNSFLSQYEPLALIAVPLITLFLARIVNSIFGVISEKGLKSSIIGFFMTSVKLVPGVKKYIDAEKQKVVNQLQGSGKSKKDGWRTELPKGGLGVEVINLMKDEKQKDVTWQGKCSGTVYIAGSEQEGHFSLINEACSMFAHTNPLHLDVFKSVVKFESEVVAMTAALLGSRGNNSGGQICGNMTSGGTESIILAIKTSRDYMKAKKGISKPEMIIPVSAHSAYDKAAQYFNIKLWRVPVSQDFRADVKAIKRHINKNTIVIVGSAPGFPHGIIDPIEELGELASTYGICFHVDLCLGGFVLPFARKLGYPIPPFDFSVQGVTSISVDVHKYGLAPKGTSVVLYRDHEIRKHQFVAVTEWTGGLYISPTIAGSRPGGLIAGAWAAMMSLGLEGYLENTRQVMEASKRLEKGVREIPGLFVIGRPEMTIVAFGSDSFDVFEVNDIMSSKGWHLNALQRPNSVHICLTLQHVPVVGEFLEDLRASVETVKVNPGPVKGGLAPIYGAAGRMPDRATVKDLLVDFMDSSC

SEQ ID NO: 4293 - protein, 540 aa, Prunus persica
MDSSVKSFLLDVRASANSFLSEYEPLVLVSAPLIALFVASMLQSALQVLHENGLKATLLGFFMSFVKLVPGVKSYIDAEKQKVVDKLQSGGKSVRESWRTELPSTGLGVGVIEQMKDEKRKDVAWQGKCSGAVYIGGSECEGHFSLINEACSMFAHTNPLHMDVFQSVVRFEAEVVAMTAAMLGSKKKSSGGQICGNMTSGGTESILLAVKSSRDYMKTTKGIKKPEMIIPESAHSAYDKAAQYFNIKLWRVPVNKEFQADVKAIRRYINRNTVLIVGSAPGFPHGIVDPIKELGQLASSFDICLHVDLCLGGFVLPFANKLGYPIPPFDFSVKGVTSISADVHKYGLAPKGTSVVLYRNHDLRKHQFVAVTEWSGGLYVSPTIAGSRPGSLIAGAWASMISLGEEGYLENTKKIMEVSKRLQKGIEEIPELFVIGRPDMTVVALGSNVVDIFEVNDIMSSKGWHLNALQRPNSIHICVTLQHVPIIDDFLRDLTESVKTVKENPGPISGGLAPIYGAAGRMPDRGTVQELLVNYMDGTC

SEQ ID NO: 4294 - protein, 478 aa, Avena sativa
MSTTEGKPPSPDAATVEEMARVATAWCGIHGLVVGDRADPRSGTVPGVGLVHAPISLLPSRLSESFWEQACDLAPVFNELVDRVSLDGEFLQDSLSKTRQVDDFTSRLLDIHRKMMDTNKDENIRLGLHRSDYMLDSETNSLLQIELNTISVSFPGLCSLVTELHRTLINQYGNLLCLDAKKVPGNEASRQFAQALARACDEFNVDRAVVMMIVQPKERNMYDQYWLVKYLKESHGVTTIRKTLSEVEAEGQVLPDGTLVVDGKKVAVVYFRAGYTPNDYPSEAEWSARLLMEQSSAVKCPSISYHLVGSKKIQQELAKPNVLERFLENKEEISKLRQCFAGLWSLDEEEIVKSAIENPDLFVLKPQREGGGNNIYGLDVRDALIRLKKEGGDALSAYILMQRIFPKASFANLVRGGVCHEALTVSELGIYGAYLRNKDKVIINDKCGYLMRTKVSSSDEGGVAAGFAVLDSLYLTDK

SEQ ID NO: 4295 - protein, 487 aa, Festuca arundinacea
MSTTEGKPSPSPSPDAAVVEEMARVAATWCAMHGLVVGDRADPRSGTVPGVGLVHAPISLLPSRLPESFWEQACELAPIFNELVDRVSLDGDFLQDSLSKTRQVDDFTSRLLDIHRKMMDTNKEESIRLGLHRSDYMLDSETNSLLQIELNTISVSFPGLCSLVTELHRTLINQYGNLLSLDAKRVPGNEASRQFAGALARACDEFNVDSAVVMMIVQSEERNMYDQYWLVKYLKESHGITTIRKTLSEVEAEGQVLPDGTLVVDGRKVAVVYFRAGYTPNDYPSEREWSARLLMEQSSAVKCPSISYHLVGTKKIQQELAKPNVLERFLKNKEEIANLRQCFAGLWSLDDEDVVKSAMENPNLFVLKPQREGGGNNIYGLDVREALIRLKKEGGDALSAYILMQRIFPKESLANLVRGGVFHEALTVSDLGIYGAYLRNKDKVIINDKCGYLMRTKVSSSDEGGVAAGFAVLDSLYLTEKVIHTSV

SEQ ID NO: 4296 - protein, 460 aa, Brachypodium distachyon
MARDATAWCAMHGLVVGDRAEQRSGTVPGVGLVHAPISLLPARLPESFWSQACELAPIFNELVDRVSLDGDFLQDSLSKTRQVDDFTSRLLEIHRKMMDINKEENIRLGLHRSDYMLDSETNSLLQIEMNTISVSFPGLCSLVTKLHRVLINQYGNLLCLDSKRIPENVASQQFAEALSRAWDEFSVDSAVVMMIVQPEERNMYDQYWIVKYLKESHGVTTIRKTLSEVEAEGQVLPDGTLVVDGRTVAVVYFRAGYTPNDYPSEAEWSARLLMEQSSAVKCPSISYHLVGTKKIQQELAKPNVLERFLENKEEIAKLRQCFAGLWSLDDEEIVKSAIETPDLFVLKPQREGGGNNIYGLDVRETLIRLQKEGGDALSAYILMQRIFPKASLANLVRGGVSHEALTISELGIYGAYLRNKDKVVMNDQCGYLMRTKVSSSDEGGVAAGFAVLDSLYLTDK

SEQ ID NO: 4297 - protein, 479 aa, Oryza sativa
MSAAAEGRPAAAAAAGEMVREATAWCALHGLVVGDRADPRSGTVPGVGLVHAPFSLLPTHLPESHWRQACELAPTFNELVDRVSLDGDFLQDSLSKTKQVDDFTSRLLEIHRKMMEINKEENIRLGLHRSDYMLDSETNSLLQIELNTISASFPGLGSLVSELHRTLIDQYGHLFCLDSKRVPGNEASSQFAKALARAWDEFNVDSAVIMMIVQPEERNMYDQYWLAKHLKESHGITTIRKTLSEVEAEGHVLPDGTLVIDGKTVSVVYFRAGYTPNDYPSEAEWAARLLLEQSSAVKCPSISYHLVGTKKIQQELARPNVLERFLENKEEITKIRKCFAGLWSLDDEEIVKSAIQKPELFVLKPQREGGGNNIYGIDVRETLIRLQKEGGDALAAYILMQRIFPKASLSNLVRGGVCHEALTISELGIYGAYLRNNDKVVMNEQSGYLMRTKVSSSDEGGVAAGFAVLDSLYLTDKAM

SEQ ID NO: 4298 - protein, 476 aa, Setaria italica
MSAAVPPPADPAAAGEMAREAAAWCALHGLVVGDRADPRSGTVPGVGLVHAPFSLLPAHLPEPFWKQACELAPIFNELVDRVSLDGNFLQDSLSKTRQVDDFTSRLLEIHRKMMEINKEENIRLGLHRSDYMLDSETSSLLQIELNTISTSFPGLGPLVSELHRTLINQYGRVLSLEPKRVPGNAASSKFAEALARAWTEFDVDSAIVMMIVQPEERNMYDQYWITKYLKESHGITTIRKTLTQVEAEGHVLPDGTLLVDGKKVAVVYYRAGYTPNDYPSEAEWSARLLIEQSSSVKCPSISYQLVGTKRIQQELANPNVLERFLENKEDIAKLRKCFAGLWSLDDEEIIKTAIEKPELFVLKPQREGGGNNIYGLDLRETLTRLQKEGGDALAAYILMQRIFPKASLAYLVRGGICHEGLVISELGIYGSYLRSKDKVITNDQCGYLMRTKVSSSDEGGVAAGFAVLDSLYLTDK

SEQ ID NO: 4299 - protein, 480 aa, Panicum virgatum
MSAAVPVPAPPQVDPAAAREMAREAAAWCALHGLVVGDRADPRSATVPGVGLVHAPFSLLPAHLPESVWRQACELAPIFNKLVDRVSLDGKFLQDSLSKTRQVDDFTSRLLEIHRKMVEINKEENIRLGLHRSDYMLDLETNSLLQIELNTISTSFPGLGSLVSNLHRTLINQYGHLLSLEPKRVPGNAASSKFAEALARAWAEFNVDSAVVMMIVQPEERNMYDQYWLTNHLKESHGITTIRKTLSQVEAEGQVLPEGTLLVDGKKVAVVYYRAGYTPNDYPSEAEWSARLLIEQSCAVKCPSISYHLVGTKKIQQELAKPNVLERFLENKEEIAKLRKCFAGLWSLDDEEIVKTAIEKPELFVLKPQREGGGNNIYGLDLRETLTRLQKEGGDALAAYILMQRIFPKASPAYLVRGGICHEGLVISELGIYGAYLRNKDKVVINDQSGYLMRTKVSSSDEGGVAAGFAVLDSLYLTDK

SEQ ID NO: 4300 - protein, 476 aa, Setaria italica
MSAAVPPPADPAAAGEMAREAAAWCALHGLVVGDRADPRSGTVPGVGLVHAPFSLLPAHLPEPFWKQACELAPIFNELVDRVSLDGNFLQDSLSKTRQVDDFTSRLLEIHRKMMEINKEENIRLGLHRSDYMLDSETSSLLQIELNTISTSFPGLGPLVSELHRTLINQYGRVLSLEPKRVPGNAASSKFAEALARAWTEFDVDSAIVMMIVQPEERNMYDQYWITKYLKESHGITTIRKTLTQVEAEGHVLPDGTLLVDGKKVAVVYYRAGYTPNDYPSEAEWSARLLIEQSSSVKCPSISYQLVGTKRIQQELANPNVLERFLENKEDIAKLRKCFAGLWSLDDEEIIKTAIEKPELFVLKPQREGGGNNIYGLDLRETLTRLQKEGGDALAAYILMQRIFPKASLAYLVRGGICHEGLVISELGIYGSYLRSRDKVITNDQCGYLMRTKVSSSDEGGVAAGFAVLDSLYLTDK

SEQ ID NO: 4301 - protein, 480 aa, Panicum virgatum
MSAAVPVPAPPPVDPATAGEMAREAAAWCALHGLVVGDRADPRSATVPGVGLVHAPFSLLPAHLPESIWRQACELATIFNELVDRVSLDGKFLQDSLSKTRQVDDFTSRLLEIHRKMMEINKEENIRLGLHRSDYMLDLETNSLLQIELNTISTSFPGLGSLVSDLHRSLINQYVHLLSLEPKRVPGNAASSKFAEALARAWAEFNVDSAVVMMIVQPEERNMYDQYWLTNHLKESYGITTIRKTLSQVEAEGQVLPDGTLVVDGKKVAVVYYRAGYTPNDYPSEAEWSARLLIEQSCAVKCPSISYHLVGTKKIQQELAKPNVLERFLENKEEIAKLRKCFAGLWSLDDEEIVKTAIEKPELFVLKPQREGGGNNIYGLDLRETLTRLQKEGGDALAAYILMQRIFPKASLAYLVRGGICHEGLVISELGIYGAYLRNKDKVVINEQSGYLMRTKVSSSDEGGVAAGFAVLDSLYLTDK

SEQ ID NO: 4302 - protein, 460 aa, Cenchrus ciliaris
MAREAAAWCALHGLVVGDRADPRSGTVPGVGLVHAPFSLLPAHLPEPFWKQACELAPIFNELVDRVSLDGKFLQDSLSKTRQVDDFTSRLLEIHRKMMETNKEENIRLGLHRSDYMLDSETNSLLQIELNTISTSFPGLGPLVSELHRTLINQYGHVLSLEPKRVPGNAASSKFAEALARAWTEFDVGSAVVMMIVQPEERNMYDQYWITKYLKESHGITTIRKTLSQVEDEGQVLPDGTLLVDGKKIAVVYYRAGYTPNDYLSEAEWSARLLIEQSSAVKCPSISYHLVGTKKIQQELAKPNVLERFLENKEDIAKLRKCFAGLWSLDDEEIITTAIEKPDMFVLKPQREGGGNNIYGLDLQETLTRLQKEGGDGRAEYILMQRIFPKASLAYLVRGGICHEGLVISELGIYGAYLRSKDKVVTNDQCGYLMRTKVSSSDEGGVAAGFAVLDSLYLTDK

SEQ ID NO: 4303 - protein, 476 aa, Sorghum bicolor
MSAAVPPAMDPAAAGEMAREAAAWCALHGLVVGDRADQRSATVPGVGLVHAPFSLLPAHLPEPFWRQACELAPIFNELVDRVSMDGNFLQDALSKTRQVDDFTSRLLEIHRKMVEINKEENIRLGLHRSDYMLDSETSSLLQIELNTISASFPGLGSLVSDLHRTLIKQHGTLLGLEHKRVPANAANTQFAEALAQTWAEFNIDSAVIMMIVQPEERNMYDQYWLSKHLQDSHGITTIRKTLSQVEAEGQILPDGTLLVGGHKVAVVYYRAGYTPNDYPSEAEWSARLMMEQSSAVKCPSISYHLVGTKKIQQELAKPNVLERFLESKEEIDKVRKCFAGLWSLDDEEIIKTAVEKPELFVLKPQREGGGNNIYGLDLRETLVRLQKEGGDALAAYILMQRIFPKASLAYLVRGGVCHEGLAISELGIYGAYLRNKDKVVINEQSGYLMRTKVSSSDEGGVAAGFAVLDSLYLTGK

SEQ ID NO: 4304 - protein, 475 aa, Zea mays
MSAAMPPAMDPAAAGEMAREAAAWCSLHGLVVGDRADQRSATVPGVGLVHAPFSLLPAHFPESFWRQACELAPVFNELVDRVSMDGNFLQNALSKTRQVDDFTSRLLEIHRKMMEINKEENIRLGLHRSDYMLDSETSSLLQIELNTISASFPGLGSLVSDLHRSLIKQYGTSLSLEHKRVPANAASTQFSEALAQAWSEFNIDSAVIMMIVQPEERNMYDQYWLSKHLQDSHGITTIRKTLSQVEAEGQVLPDGTLLVGGQKVAVVYFRAGYAPNDYPSEAEWSARLMMEQSSAVKCPSISYHLVGTKKIQQELAKPNVLERFLKSEEIDKVRKCFAGLWSLDDEYIIKTAVEKPELFVLKPQREGGGNNIYGLDLRETLVRLQKEGGDALAAYILMQRIFPKASPAYLVRGGVCHEGLAISELGIYGAYLRNKDKVVINEQCGYLMRTKVSSSDEGGVAAGFAVLDSLYLTGK

SEQ ID NO: 4305 - protein, 362 aa, Solanum phureja
MATAVSAAVSLPSSKSTSFSSRTSIISTDKINFNKVPLYYRNVSGGSRLVSIRAQVTTEAPAKVEKISKKQDEGVIVNKFRPKEPYVGRCLLNTKITGDDAPGETWHMVFSTEGEVPYREGQSIGVIADGVDANGKPHKLRLYSIASSALGDFGDSKTVSLCVKRLVYTNDKGEEVKGVCSNFLCDLKPGAEVKITGPVGKEMLMPKDPNATVIMLATGTGIAPFRSFLWKMFFEKHEDYKFNGTAWLFLGVPTSSSLLYKEEFEKMKEKAPENFRLDFAVSREQTNEKGEKMYIQTRMAQYAEELWTLLQKDNTFIYMCGLKGMEQGIDEIMSALAERDGIVWADYKKQLKKAEQWNVEVY

SEQ ID NO: 4306 - protein, 362 aa, Solanum tuberosum
MATAVSAAVSLPSSKSTSFSSRTSIISTDKINFNKVPLYYRNVSGGSRLVSIRAQVTTEAPAKVEKISKKQDEGVIVNKFRPKEPYVGRCLLNTKITGDDAPGETWHMVFSTEGEVPYREGQSIGVIADGVDANGKPHKLRLYSIASSALGDFGDSKTVSLCVKRLVYTNDKGEEVKGVCSNFLCDLKPGAEVNITGPVGKEMLMPKDPNATVIMLATGTGIAPFRSFLWKMFFEKHEDYKFNGTAWLFLGVPTSSSLLYKEEFEKMKEKAPENFRLDFAVSREQTNEKGEKMYIQTRMAQYAEELWTLLQKDNTFIYMCGLKGMEQGIDEIMSALAERDGIVWADYKKQLKKAEQWNVEVY

SEQ ID NO: 4307 - protein, 362 aa, Solanum melongena
MSAAVTAAVSLPSSNSTSFPTRASIISSDKINFNKVPLYYRNVSGGNRLVSIRAQVTTEAPAKVEKISKKQEEGVVVNKFRPKEPYVGRCLLNTKITGDDAPGETWHMVFSTEGEVPYREGQSIGVIADGVDANGKPHKLRLYSIASSAIGDFGDSKTVSLCVKRLVYTNDKGEEVKGVCSNFLCDLKPGAEVKITGPVGKEMLMPKDPNATVIMLATGTGIAPFRSFLWKMFFEKHEDYKFNGLAWLFLGVPTSSSLLYKEEFEKMQEKAPDNFRLDFAVSREQTNEKGEKMYIQTRMAQYAEELWSLLKKDNTFIYMCGLKGMEQGIDDIMTSLAERDGIVWADYKKQLKKSEQWNVEVY

SEQ ID NO: 4308 - protein, 362 aa, Nicotiana tabacum
MAAAVSAAVSLPSSKSTSFATRTSIISPEKINFNKVPLYYRNVSAGSRVVSIRAQVTTEAPAKVEKISKKQDEGVVVNKFRPKEPYIGRCLLNTKITGDDAPGETWHMVFSTEGEVPYREGQSIGVIADGVDANGKPHKLRLYSIASSALGDFGDSKTVSLCVKRLIYTNDKGEEVKGVCSNFLCDLKPGAEVKITGPVGKEMLMPKDPNATVVMLATGTGIAPFRSFLWKMFFEKHEDYKFNGLAWLFLGVPTSSSLLYKEEFEKMKEKAPENFRLDFAVSREQTNEKGEKMYIQTRMAQYAEELWGLLQKDNTFVYMCGLKGMESGIDDIMTSLAARDGIVWADYKKQLKKAEQWNVEVY

SEQ ID NO: 4309 - protein, 362 aa, Nicotiana benthamiana
MAAAVSAAVSLPSSKSTSFPTRTSIISPEKINFNKVPLYYRNVSAGSRVASIRAQVTTEAPAKVEKISKKQDEGVVVNKFRPKEPYIGRCLLNTKITGDDAPGETWHMVFSTEGEVPYREGQSIGVIADGVDANGKPHKLRLYSIASSALGDFGDSKTVSLCVKRLIYTNDKGEEVKGVCSNFLCDLKPGAEVKITGPVGKEMLMPKDPNATIVMLATGTGIAPFRSFLWKMFFEKHEDYKFNGLAWLFLGVPTSSSLLYKEEFEKMKEKAPENFRLDFAVSREQTNEKGEKMYIQTRMAQYAEELWGLLQKDNTFVYMCGLKGMESGIDDIMTSLAARDGIVWADYKKQLKKAEQWNVEVY

SEQ ID NO: 4310 - protein, 362 aa, Nicotiana benthamiana
MAAAVSAAVSLPSSKSTSFPTRTSIISPEKISFNKVHLHYRNVSAGSRVVSIRAQVTTEAPAKVEKISKKQDEGVVVNKFRPKEPYIGRCLLNTKITGDDAPGETWHMVFSTEGEVPYREGQSIGVIADGVDANEKPHKLRLYSIASSALGDFGDSKTVSLCVKRLIYTNDKGEEVKGVCSNFLCDLKPGAEVKITGPVGKEMLMPKDPNATIVMLATGTGIAPFRSFLWKMFFEKHEDYKFNGLAWLFLGVPTSSSLLYKEEFEKMKEKAPENFRLDFAVSREQTNEKGEKMYIQTRMAQYAEELWGLLQKDNTFVYMCGLKGMESGIDDIMTSLAARDGIVWADYKKQLKKAEQWNVEVY

SEQ ID NO: 4311 - protein, 362 aa, Ipomoea nil
MAAAVSAAVSLPSSKSTSLASRTSIISPEKICFNKVPLYYRNVSSGGKLVPIRAQVTTEAPAKVEKISKKQDEGIVTNKFKPKEPYIGRCLLNTKITGDDAPGETWHMVFSTEGEVPYREGQSIGVIADGVDANGKPHKLRLYSIASSALGDFGDSKTVSLCVKRLVYTNDKGEIVKGVCSNFLCDLKPGAEVKITGPVGKEMLMPKDPNATVIMLATGTGIAPFRSFLWKMFFEKHEDYKFNGLAWLFLGVPTGSSLLYKEEFEKMKEKAPENFRLDFAVSREQTNEKGEKMYIQTRMAQYAEELWELLKKDNTFVYMCGLKGMEKGIDDIMTSLAARDGIDWAEYKRTLKKAEQWNVEVY

SEQ ID NO: 4312 - protein, 362 aa, Carpinus betulus
MATAVTATVSFPSSKSASLSSRTSIISPERVSFKKVPLQYRDVSVGGRAVSIRAQVTTEAPAKVEKVSKKMEEGVVVNKYRPKEPYVGRCLLNTKITGDDAPGETWHMVFSTEGEVPYREGQSIGVIADGIDKNGKPHKLRLYSIASSAIGDFGDSKTVSLCVKRLVYTNDKGEIVKGVCSNFLCDLKPGAEVKITGPVGKEMLMPKDPTATVVMLATGTGIAPFRSFLWKMFFEKHEDYKFNGLAWLFLGVPTSSSLLYKEEFEKMKEKAPENFRLDFAVSREQTNEKGEKMYIQTRMAQYAEELWQLLKKDNTFVYMCGLKGMEKGIDDIMVSLAARDGIDWLDYKKKLKKAEQWNVEVY

SEQ ID NO: 4313 - protein, 362 aa, Glycine max
MATAVTAAVSFPATKSTSLSSRTSITAPDRIVFKKVSLQYRDVSTSGRVVSIRAQVTTEAPAKVEKESKKQEEGVIVNKFKPKNPYIGRCLLNTKITGDDAPGETWHMVFSTEGEVPYREGQSIGVIPDGVDKNGKPHKLRLYSIASSALGDFGDSKTVSLCVKRLVYTNENGELVKGVCSNFLCDLKPGAEVKITGPVGKEMLMPKDPNATVIMLATGTGIAPFRSFLWKMFFEKHDDYKFNGLAWLFLGVPTSSSLLYKEEFEKMKEKAPDNFRLDFAVSREQTNEKGEKMYIQTRMAQYAEELWELLKKDNTFVYMCGLKGMEKGIDDIMVSLAAKDGIDWIEYKRQLKKAEQWNVEVY

SEQ ID NO: 4314 - protein, 362 aa, Vitis vinifera
MATAVTAAVSLPSSKTTSLSARTSIISPERISLKKVPLFYRDISAGGRVVSIRAQVTTEAPAKVEKISKKNEEGVIVNKFKPKNPYIGRCLLNTKITGDDAPGETWHMVFSTEGEVPYREGQSIGVIADGVDKNGKPHKLRLYSIASSALGDFGDSKTVSLCVKRLVYTNENGELVKGVCSNFLCDLKPGAEVKITGPVGKEMLMPKDPNATIIMLATGTGIAPFRSFLWKMFFEKHEDYKFNGLAWLFLGVPTSSSLLYKEEFEKMKEKKPENFRLDFAVSREQSNAKGEKMYIQTRMAEYAEELWELLKKDNTYVYMCGLKGMEKGIDDIMVSLAARDGIDWIEYKRQLKRAEQWNVEVY

SEQ ID NO: 4315 - protein, 363 aa, Lippia dulcis
MAAAVSAAVSLPTSKSTSLQARTSLISPERINFSKVPLYHRNVYSAGAKIGPIRAQVTTEAPAKAEKISKKQEEGVVVNKFRPKEPYIGRCLLNTKITGDDAPGETWHMVFSTEGEVPYREGQSIGVIADGIDKNGKPHKLRLYSIASSAIGDFGDSKTVSLCVKRLVYTNDQGEIVKGVCSNFLCDLKPGAEVKITGPVGKEMLMPKDPNATIVMLATGTGIAPFRSFLWKMFFEKHDDYQFNGLAWLFLGVPTSSSLLYKEEFEKMKEKRPENFRLDFAVSREQTNAKGEKMYIQTRMAEYAEELWQLLKKDNTFVYMCGLKGMEKGIDDIMVSLAARDGIDWIDYKKQLKKAEQWNVEVY

SEQ ID NO: 4316 - protein, 101 aa, Valeriana officinalis
MATAVSAAVSLPSSKSTSISARSNSLISQNDRINFVKVPLYYKNVCGGGKMLSIRAQVTTEAPVKVEKISKKDEEGVVVNKFKPKNPYTGMCLLQHQDYRR

SEQ ID NO: 4317 - protein, 362 aa, Humulus lupulus
MAAAVTAAVSFPSSKSTSLPTRTSIITPDRITLKKAPFYRDASAVGARVVSVRAQVTTEAPAKVEKVSKKDEEGVVVNKFKPKNPYTGRCLLNTKITGDDAPGETWHMVFSTEGEVPYREGQSIGVIADGEDKNGKPHKLRLYSIASSALGDFGDSKTVSLCVKRLVYTNDKGELVKGVCSNFLCDLKPGAEVKITGPVGKEMLMPKDPNATIVMLATGTGIAPFRSFLWKMFFEKHEDYEFNGLAWLFLGVPTSSSLLYKEEFEKMKEKAPENFRLDFAVSREQTNEKGEKMYIQTRMAQYAEELWQLLQKDNTYVYMCGLKGMEKGIDDIMVSLAARDGIDWIDYKKKLKKAEQWNVEVY

SEQ ID NO: 4318 - protein, 362 aa, Vigna unguiculata
MAAAVSAAVSFPSTKSTSLQSRTSIVAPERVIFNKVPFQYRDVSSNGRVVSIRAQVTTEAPAKVEKESKKQDEGVIVNKFKPKAPYIGRCLLNTKITGDDAPGETWHMVFSTEGEVPYREGQSIGVIPDGIDKNGKPHKLRLYSIASSAIGDFGDSKTVSLCVKRLVYTNDSGEIVKGVCSNFLCDLKPGSEVTITGPVGKEMLMPKDPNATVVMLATGTGIAPFRSFLWKMFFEKHEDYKFNGLAWLFLGVPTSSSLLYKEEFEKMQEKYPENFRLDFAVSREQTNEQGEKMYIQTRMAQYAEELWELLKKDNTFVYMCGLKGMEKGIDDIMVSLAARDGIDWIDYKKQLKKAEQWNVEVY

SEQ ID NO: 4319 - protein, 360 aa, Olea europaea
MAAAVSAGVSLPSSKSISLPTRTAIFSPERINFNKVPLYYRNVSGGGKVIRAQVTTEAPAKAEKISKKQEEGVVVNKYRPKEPYIGRCLLNTKITGDDAPGETWHMVFTTEGEIPYREGQSIGIIADGLDKNGKPHKLRLYSIASSALGDFGDSKTVSLCVKRLVYTNDQGEIVKGVCSNFLCDLKPGSEAKITGPVGKEMLMPKDPNATVIMLATGTGIAPFRGFLWKMFFEKHDDYKFNGLAWLFLGVPTSSSLLYKEEFEKMKEKYPDNFRLDFAVSREQTNEKGEKMYIQTRMAQYAEELWELLKKDNTFVYMCGLKGMEKGIDDIMVSLAAKDGIDWIEYKKQLKKAEQWNVEVY

SEQ ID NO: 4320 - protein, 362 aa, Cajanus cajan
MAAAVSAAVSFPSTKSTSLPSRTPIIAPERLVFKKVPLQYRDVSTSGRVVSIRAQVTTEAPTKVEKISKKQEEGVIVNKFKPKNPYIGRCLLNTKITGDDAPGETWHMVFSTEGEVPYREGQSIGVIPEGIDKNGKPHKLRLYSIASSALGDFGDSKTVSLCVKRLVYTNENGELVKGVCSNFLCDLKPGAEVTITGPVGKEMLMPKDPNATVIMLGTGTGIAPFRSFLWKMFFEKHEDYKFNGLAWLFLGVPTSSSLLYKEEFEKMKEKFPENFRLDFAVSREQTNEKGEKMYIQTRMAQYAEELWELLKKDNTFVYMCGLKGMEKGIDDIMVSLAAKDGIDWIEYKRQLKKAEQWNVEVY

SEQ ID NO: 4321 - protein, 364 aa, Amsonia hubrichtii
MAAAVSAAVSLPSSKSTASLPTTRTSIISTERVNFNKVPLYYRNVSVGGKVVSIRAQVTTEAPQKVEKISKKNEEGVTVNKFRPKNPYTGRCLLNTKITGDDAPGETWHMVFSTEGEIPYREGQSIGVIADGIDKNGKPHKLRLYSIASSAIGDFGDSKTVSLCVKRLVYTNEQGELVKGVCSNFLCDLKPGSEVKITGPVGKEMLMPKDPNATIIMLATGTGIAPFRGFLWKMFFEKHEDYKFNGLAWLFLGVPTSSSLLYKEEFEKMKEKYPENFRLDFAVSREQTNEKGEKMYIQTRMAQYADELWELLKKDNTFVYMCGLKGMEKGIDDIMLPLAAKEGIDWLEYKRQLKKAEQWNVEVY

SEQ ID NO: 4322 - protein, 363 aa, Juglans hindsii x Juglans regia
MATAVTSTVSFPSSKSASLPSRTSIISPERISFKKVPLHYRDVSVGGRVVSVRAQVTIEAPAKKVEKESKKMEEGVVVNKYKPKDPYVGRCLLNTKITADDAPGETWHMVFSTDGEVPYREGQSIGVIADGIDKNGKPHKLRLYSIASSALGDFGDSKTVSLCVKRLVYTNDKGEVVKGVCSNFLCDLKPGYEVKITGPVGKEMLMPKDPTATIIMLATGTGIAPFRSFLWKMFFEKHDDYKFNGLAWLFLGVPTSSSLLYKEEFEKMKEKAPENFRLDFAVSREQTNEKGEKMYIQTRMAQYAEELWELLKKDNTYVYMCGLKGMEKGIDEIMLSLAARDGIDWLDYKKKLKKAEQWNVEVY

SEQ ID NO: 4323 - protein, 362 aa, Aristolochia fimbriata
MAAAVTAAVSVPTTKSSPLPARTCFISSERISFQKTCLYTRNVATVGKVGPIRAQVTTEAPAKVEKISKKDDEGVVVNKYRPKEPYVGRCLLNTKITGDDAPGETWHMVFSTEGEVPYREGQSIGVIADGVDKNGKPHKLRLYSIASSALGDFGDSKTVSLCVKRLVYTNDQGEIVKGVCSNFLCDLKPGAEVKITGPVGKEMLMPKDPNATVVMLATGTGIAPFRSFLWKMFFEKHDDYKFNGLAWLFLGVPTSSSLLYKEEFEKMKEKAPENFRLDFAVSREQTNEKGEKMYIQTRMAQYAEELWELLKKDNTYVYMCGLRGMEKGIDDIMTSLAERDGLVWADYKKQLKKAEQWNVEVY

SEQ ID NO: 4324 - protein, 362 aa, Phaseolus vulgaris
MATAVTAAVSFPASKSTSLPSRTSVTSPDRILFKKLSLQYRDVSVSGRVVSVRAQVTTEAPAKVEKESKKQDEGLIVNKFKPKDPYIGRCLLNTKITGDDAPGETWHMVFSTEGEVPYREGQSIGIIADGVDKNGKPHKLRLYSIASSALGDFGDSKTVSLCVKRLVYTNENGELVKGVCSNFLCDLKPGAEVKITGPIGKEMLMPKDPNATVVMLATGTGIAPFRSFLWKMFFEKHDDYRFNGLAWLFLGVPTSSSLLYKEEFEKMKEKAPENFRLDFAVSREQTNEKGEKMYIQTRMAQYAEELWELLKKDNTFVYMCGLKGMEKGIDDIMVSLAAKDGIDWIDYKRQLKKAEQWNVEVY

SEQ ID NO: 4325 - protein, 361 aa, Citrus sinensis
MAAVSAAVSLPTSKSTSLPTRTSIISPDRITFRKVPFYYKDVSTGGRVVSVRAQVTTEAPAKVEKESKKMEEGVIVNKFKPKTPYIGRCLLNTKITGDDAPGETWHMVFSTEGEVPYKEGQSIGVIADGVDKNAKPHKLRLYSIASSALGDFGDSKTVSLCVKRLVYTNENGEIVKGVCSNFLCDLKPGAEVKITGPVGKEMLMPRDPNATVIMLATGTGIAPFRGFLWKMFFEKHEDYKFNGLAWLFLGVPTSSSLLYKEEFEKMKEKAPENFRLDFAVSREQKNEKGEKMYIQTRMAEYANELWELLKKDNTYVYMCGLRGMEKGIDDIMVSLAANDGIDWLDYKKQLKKSEQWNVEVY

SEQ ID NO: 4326 - protein, 362 aa, Cajanus cajan
MAAVVTAAVSFPSSKSTSLPSRTSIAAPDRIVFKKVSLQYRDVSISGRIVSIRAQVTTEAPAKVEKESKKQEEGVIVNKFKPKNPYTARCLLNTKITGDDAPGETWHMVFSTEGEVPYREGQSIGVIPDGVDKDGKPHKLRLYSIASSALGDFGDSKTVSLCVKRLVYTNENGELVKGVCSNFLCDLKPGAEVKITGPVGKEMLMPKDPNATMIMLATGTGIAPFRSFLWKMFFEKHDDYKFNGLAWLFLGVPTSSSLLYKEEFEKMKEKAPENFRLDFAVSREQTNEKGEKMYIQTRMAQYAEELWELLKKDNTYVYMCGLKGMEKGIDDIMVSLAAKDGIDWIEYKRRLKKAEQWNVEVY

SEQ ID NO: 4327 - protein, 360 aa, Solanum phureja
AALSASLSLPSSNSTCLSIKTIFISPENITFNKVPLCNRNVSAGGKVFPIRAQLTTEVPAKVAKVSKKQDEGVVVNKFRPKDPYIGRCLLNTKITGDDAPGETWHMVFSTEGEIPYTEGQSIGVIPDGVDSNGKPHKLRLYSIASSALGDFGDSKTVSLCVKRLVYTNDKGEIVKGVCSNFLCDLKPGAEVKITGPVGKEMLMPKDPNATVIMLATGTGIAPFRGFLWKMFFEKHEDYKFNGLAWLFLGVPTSSSLIYKEEFEKMKEKAPENFRLDFAVSREQTNEKGEKMYIQTRMAEYAEELWTLLKKDNTFVYMCGLKGMEQGIDDIMTSLAERDGINWADYKKQLKKAEQWNVEVY

SEQ ID NO: 4328 - protein, 321 aa, Castanea mollissima
MATAVTATVSFPSSKSSSLSSRTSIILPERIPFKKVPLQYRDVSVGGRVVSIRAQVTTEAPAKVAKESKKMEEGVVVNKYKPKNPYTGRCLLNTKITGDDAPGETWHMVFSTEGEIPYREGQSVGVIPDGIDKNGKPHKLRLYSIASSAIGDFGDSKTVSLCVKRLVYTNDAGEIVKGVCSNFLCDLKPGAEVKMTGPVGKEMLMPKDPNATIIMLATGTGIAPFRSFLWKMFFEKHDDYKFNGLAWLFLGVPTSSSLLYKEEFEKMKEKAPENFRLDFAVSREQKMRKVRRCTSKPEWLSMQKSYGNCLRRITPLSICVG

SEQ ID NO: 4329 - protein, 361 aa, Gossypium hirsutum
MAAVTAAVSFPSTKSTSLPARTSIASPDRITFKKVPVYYRDVCSGGRVVSVRAQVTTEAPAKVVKESKKNDEGVVVNKFRPINPYIGRCLLNTKITGDDAPGETWHMVFSTEGEVPYREGQSIGVIPDGVDKNGKPHKLRLYSIASSALGDFGDSKTVSLCVKRLVYTNEKGELVKGVCSNFLCDLKPGAEVKITGPVGKEMLMPKDPNATIIMLATGTGIAPFRSFLWKMFFEKHDDYKFNGLAWLFLGVPTSSSLLYKEEFEKMKEKNPENFRLDFAVSREQTNEKGEKMYIQTRMAEYAKELWELLKKDNTFVYMCGLRGMEKGIDDIMVSLAAADGIDWAEYKKQLKKAEQWNVEVY

SEQ ID NO: 4330 - protein, 361 aa, Gossypium raimondii
MAAVTAAVSFPSTKSTSLPARTSIVSPDRITFKKVPVYYRDVCSGGRVVSVRAQVTTEAPAKVVKESKKNDEGVVVNKFRPINPYIGRCLLNTKITGDDAPGETWHMVFSTEGEVPYREGQSIGVIPDGVDKNGKPHKLRLYSIASSALGDFGDSKTVSLCVKRLVYTNEKGELVKGVCSNFLCDLKPGAEVKITGPVGKEMLMPKDPNATIIMLATGTGIAPFRSFLWKMFFEKHDDYKFNGLAWLFLGVPTSSSLLYKEEFEKMKEKNPENFRLDFAVSREQTNEKGEKMYIQTRMAEYAKELWELLKKDNTFVYMCGLRGMEKGIDDIMVSLAAADGIDWAEYKKQLKKAEQWNVEVY

SEQ ID NO: 4331 - protein, 363 aa, Arachis hypogaea
MATAVTAAVSFPSTKSTSIPTTTTSIASPHRLLFKKVTLQYRDVCISGRVVPIRAQVTTEAPAKVEKISKKQEEGVVVNKFKPKEPYIGRCLLNTKITGDDAPGETWHMVFSTEGEVPYREGQSIGVIPDGIDKNGKPHKLRLYSIASSALGDFGDSKTVSLCVKRLVYTNENGELVKGVCSNFLCDLKPGAEVKITGPVGKEMLMPKDPNATIIMLATGTGIAPFRSFLWKMFFEKHDDYKFNGLAWLFLGVPTSSSLLYKEEFEKMKEKNPEKFRLDFAVSREQTNEKGEKMYIQTRMAQYAEELWELLKKDNTFVYMCGLKGMEKGIDDIMVSLAARDGIDWTEYKRQLKKAEQWNVEVY

SEQ ID NO: 4332 - protein, 362 aa, Solanum lycopersicum
MAAALSASLSLQSSNSTSLSIKTIFISPENITFNKVLLCNRNVSVSRKVFHIRGQLTTEVPANVAKVSKKQDEGVVVNKFRPKDPYIGRCLLNTKITGDDAPGETWHMVFSTEGEIPYREGQSIGVIPDGVDSNGKPHKLRLYSIASSALGDFGDSKTVSLCVKRLVYTNDKGEIVKGVCSNFLCDLKPGAEVKITGPVGKEMLMPKDPNATVIMLATGTGIAPFRGFLWKMFFEKHEDYKFNGLAWLFLGVPTSSSLLYKEEFEKMKEKAPQNFRLDFAVSREQINEKGEKMYIQTRMAEYAEELWTLLKKDNTFVYMCGLKGMEQGIDDIMTSLAERDGINWADYKKQLKKAEQWNVEVY

SEQ ID NO: 4333 - protein, 360 aa, Olea europaea
HGCCSKCCSLSSILQVYFSSNQNRHFFPGNNQLQQGAIVLQKCVGWWEVIRAQVTTEAPAKVGKISKKQEEGVVVNKYRPKEPYIGRCLLNTKITGDDAPGETWHMVFTTEGEIPYREGQSIGVIPDGIDKNGKPHKLRLYSIASSAIGDFGDSKTVSLCVKRLVYTNDQGEIVKGVCSNFLCDLKPGAEVQITGPVGKEMLMPIDPNATIVMLGTGTGIAPFRSFLWKMFFEKHEDYKFNGLAWLFLGVPTSSSLLYKEEFEKMKEKFPDNFRLDFAVSREQTNEKGEKMYIQTRMAQYAEELWELLKKDNTYVYMCGLKGMEKGIDDIMCSLAAKEGIDWIDYKKQLKKGEKWNVEVY

SEQ ID NO: 4334 - protein, 366 aa, Tripterygium wilfordii
MAAAVTAAVSFPSSKSTSLPTRISVISPERITFKKFNTVHYRYRDGSAGGRVGSIVRAQVTTEAPAKVEKESKKMEEGVIVNKFKPKNPYIGRCLLNTKITGDDAPGETWHMVFSTEGEVPYREGQSIGVIPDGIDKNGKPHKLRLYSIASSAIGDFGDSKTVSLCVKRLVYTNDKGEVVKGVCSNFLCDLKPGADVTITGPVGKEMLMPKDPNATVVMLATGTGIAPFRSFLWKMFFEKHEDYKFNGLAWLFLGVPTSSSLLYKEEFEKMKEKAPDNFRLDFAVSREQTNEKGEKMYIQTRMAQYAEELWELLKKDNTFVYMCGLKGMEQGIDEIMESLAERDGVTWVDYKRQLKKAGQWNVEVY

SEQ ID NO: 4335 - protein, 365 aa, Antirrhinum majus
MAAAVSAAVSVPSSKSASLTARNSIVSTDRVSLFNKVPSYYRNVSSGGVRILPIRAQVTTEAPAAKPEKVHKKQEDGVVVNKYRPKEPYVGRCLLNTKITGDDAPGETWHMVFSTEGEIPYREGQSIGIIADGEDKNGKPHKLRLYSIASSALGDFGDAKTVSLCVKRLVYTNDQGEIVKGVCSNFLCDLKPGSEVKITGPVGKEMLMPKDPNATIIMLGTGTGIAPFRSFLWKMFFEKHDDYKFNGLAWLFLGVPTSSSLLYKEEFEKMKEKAPENFRLDFAVSREQTNAKGEKMYIQTRMAEYAEELWELLKKDNTYVYMCGLKGMEKGIDDIMLSLAAKDGIDWLDYKKQLKRAEQWNVEVY

SEQ ID NO: 4336 - protein, 360 aa, Mimulus guttatus
MAAAVSAAVSLPSTKFTSLQSKTSILSPERINFNKVPLYYSRNVTKVGPIRAQVTTEAPAKAEKISKKQEEGVIVNKYRPKEPYVGRCLLNTKITGDDAPGETWHMVFSTEGEVPYREGQSIGIIPDGIDKNGKPHKLRLYSIASSALGDFGDSKTVSLCVKRLIYTNDQGETVKGVCSNFLCDLKPGTEVKITGPVGKEMLMPKDPNATIIMLGTGTGIAPFRSFLWKMFFEKHDDYKFNGLGWLFLGVPTSSSLLYKEEFEKMKEKFPDNFRLDFAVSREQNNAKGEKMYIQTRMAEYAEELWELLKKDNTYVYMCGLKGMEKGIDEIMLSLAAKDGIDWLDYKKQLKRAEQWNVEVY

SEQ ID NO: 4337 - protein, 364 aa, Tripterygium wilfordii
MAAAVTAAVSFPSSKSTSLPTRTSITSPERITFKKFNAVYYRDGSSGGRMGSIVRAQVTTEAPAKVEKESKKMEEGLIVNKFKPKNPYIGRCLLNTKITGDDAPGETWHMVFSTEGEVPYREGQSIGVIPDGIDKNGKPHKLRLYSIASSAIGDFGDSKTVSLCVKRLVYTNDQGELVKGVCSNFLCDLKPGSEVKITGPIGKEMLMPKDPNATVVMLATGTGIAPFRSFLWKMFFEKHEDYKFNGLAWLFLGVPTSSSLLYKEEFEKMKEKAPDNFRLDFAVSREQTNEKGEKMYIQTRMAQYAEELWELLKKDNTFVYMCGLKGMEQGIDEIMASLAERDGINWVEYKRQLKKTEQWNVEVY

SEQ ID NO: 4338 - protein, 362 aa, Panax ginseng
MAAAVSAAVSLPSSKSTALSTRTFIISPERVNFTKVPLSFRNVSGGGKVVSIRAQVTTEAPAKVEKVSKKVDEGVITNKFRPKDPYVGKCLLNTKITGDDAPGETWHMVFSTEGEVPYKEGQSIGIIADGEDKNGKPHKLRLYSIASSALGDFGDSKTVSLCVKRLVYTNDQGEIVKGVCSNFLCDLKPGYDVKITGPVGKEMLMPKDPNATVVMLATGTGIAPFRSFLWKMFFEEHKDYKFNGLAWLFLGVPTSSSLLYKEEFEKMKEKKPDNFRLDFAVSREQTNEKGEKMYIQTRMAQYAEELWELLKKDNTFVYMCGLKGMEKGIDDIMVSLAAKDGIEWVEYKRSLKKAGQWNVEVY

SEQ ID NO: 4339 - protein, 362 aa, Manihot esculenta
MAAAVTAAVSFPSSKSTSLSSRTSIVAPDRIAFNKVSVYYKDVSSGGRVVSIRAQVTTEAPAKVKKESKKMEEGVVVNKFKPKNPYIGRCLLNTKITGDDAPGETWHMVFSTEGEVPYREGQSIGVIPDGIDKNGKPHKLRLYSIASSALGDFGDSKTVSLCVKRLVYVNENGETVKGVCSNFLCDLKPGSEVKITGPVGKEMLMPKDPNATIVMLATGTGIAPFRSFLWKMFFEKHEDYKFTGLAWLFLGVPTSSSLLYKEEFEKMKEKAPDNFRLDFAVSREQTNEKGEKMYIQTRMAQYAEELWELLKKDNTYVYMCGLKGMEKGIDDIMVSLAAKDGIDWLEYKRSLKKAEQWNVEVY

SEQ ID NO: 4340 - protein, 361 aa, Gossypium hirsutum
MAAVTAAVSFPSTKSTSLPARTSLVFPDRITFKKVPVYYRDVCSGGRVVSVRAQVTTEAPAKVVKESKKNDEGVVVNKFRPINPYIGRCLLNTKITGDDAPGETWHMVFSTEGEVPYREGQSIGVIPDGVDKNGKPHKLRLYSIASSALGDFGDSKTVSLCVKRLVYTNEKGELVKGVCSNFLCDLKPGAEVKITGPVGKEMLMPKDPNATIIMLATGTGIAPFRSFLWKMFFEKHDDYKFNGLAWLFLGVPTSSSLLYKEEFEKMKEKNPENFRLDFAVSREQTNEKGEKMYIQTRMAEYAKELWELLKKDNTFVYMCGLRGMEKGIDDIMVSLAAADGIDWAEYKKQLKKAEQWNVEVY

SEQ ID NO: 4341 - protein, 362 aa, Panax ginseng
MAAALSAAVSLPSSKSTALSTRTFIISPERVNFTKVPLSFRNVSGGGKVVSIRAQVTTEAPAKVEKVSKKVDEGVITNKFRPKDPYVGKCLLNTKITGDDAPGETWHMVFSTEGEVPYKEGQSIGIIADGEDKNGKPHKLRLYSIASSALGDFGDSKTVSLCVKRLVYTNDQGEIVKGVCSNFLCDLKPGYDVKITGPVGKEMLMPKDPNATVVMLATGTGIAPFRSFLWKMFFEEHKDYKFNGLAWLFLGVPTSSSLLYKEEFEKMKEKKPDNFRLDFAVSREQTNEKGEKMYIQTRMAQYAEELWELLKKDNTFVYMCGLKGMEKGIDDIMVSLAAKDGIEWVEYKRSLKKAGQWNVEVY

SEQ ID NO: 4342 - protein, 365 aa, Eucalyptus grandis
MAAAVTASVSLPSSSKSTSLPASRTSIISTERINFKKVPVHYRDVCGGGRMVSAIRAQVTTEAPAKVVKESKKMDEGVVVNKFKPKNPYIGRCLLNTKITGDDAPGETWHMVFSTEGEVPYREGQSIGVIPEGIDKNGKPHKLRLYSIASSALGDFGDSKTVSLCVKRLVYTNENGELVKGVCSNFLCDLKPGAEVTITGPVGKEMLLPKDPNATVIMLATGTGIAPFRSFLWKMFFEKHEDYKFNGLAWLFLGVPTSSSLLYKEEFEKMKEKKPDNFRLDFAVSREQTNEKGEKMYIQTRMAQYAEELWELLKKDNTYVYMCGLKGMEKGIDDIMVSLAAKDGIDWLEYKRQLKKSEQWNVEVY

SEQ ID NO: 4343 - protein, 362 aa, Daucus carota
MATALTAALSLHSSKTPSISTTPSILSTDRLNFTKVPLTFRNVSSGGKMVSIRAQVTTEAPAKVEKVSKKVEEGVVTNKFRPKEPYVGKCLLNTKITGDDAPGETWHMVFSTEGEVPYKEGQSIGIIADGEDKNGKPHKLRLYSIASSALGDFGDSKTVSLCVKRLVYTNDQGEVVKGVCSNFLCDLKPGADVKITGPVGKEMLMPKDPNATVVMLATGTGIAPFRSFLWKMFFEKHEDYQFNGLAWLFLGVPTSSSLLYKEEFEKMKEKKPDNFRLDFAVSREQTNAKGEKMYIQTRMAEYAEELWELLKKDNTFIYMCGLKGMEKGIDDIMVSLAAKDGIDWIEYKRSLKKAGQWNVEVY

SEQ ID NO: 4344 - protein, 362 aa, Daucus carota
MATAVSAAVSLPSSSSTSLSTRTSFISTDRLSFAKVPLTFRNVSSGGKLVSIRAQVTTEAPAKVEKVSKKVDEGIVTNKYRPKEPYVGKCLLNTKITGDDAPGETWHMVFSTEGEIPYKEGQSIGIIADGEDKNGKPHKLRLYSIASSAIGDFGDSKTVSLCVKRLVYTNDQGEEVKGVCSNYLCDLKPGADVSITGPVGKEMLMPKDPNATVIMLGTGTGIAPFRSFLWKMFFEKHEDYQFNGLAWLFLGVPTSSSLLYKEEFEKMKEKKPDNFRLDFAVSREQTNAKGEKMYIQTRMAEYAEELWELLKKDNTFIYMCGLKGMEKGIDDIMVSLAAKDGIDWIEYKRSLKKAGQWNVEVY

SEQ ID NO: 4345 - protein, 362 aa, Phaseolus vulgaris
MAAAVSAAVSFPSTKSTSLPCRTSIIAPERVIFKKVPFQYRDVSSSGRVVSIRAQVTTEAPAKVEKESKKQDEGVIVNKFKPKTPYIGRCLLNTKITGDDAPGETWHMVFSTEGEVPYREGQSIGVIPEGVDKNGKPHKLRLYSIASSAIGDFGDSKTVSLCVKRLVYTNDSGEIVKGVCSNFLCDLKPGSEVTITGPVGKEMLMPKDPNATVVMLATGTGIAPFRSFLWKMFFEKHEDYTFNGLAWLFLGVPTSSSLLYKEEFEKMQEKYPENFRLDFAVSREQTNEQGEKMYIQTRMAQYAEELWELLKKENTFVYMCGLKGMEKGIDDIMGSLAARDGIDWIEHKKKLKKAEQWNVEVY

SEQ ID NO: 4346 - protein, 363 aa, Fagus grandifolia
MATAVTATVSFPSSKSASLSSRTSIISPERISFKKVPLQYRDVSVGGRAVSIRAQVTTEAPAKVEKKESKKMEEGVVVNKYKPKNPYIGRCLLNTKITGDDAPGETWHMVFSTDGEIPYREGQSVGVIPDGIDKNGKPHKLRLYSIASSAIGDFGDSKTVSLCVKRLVYTNDKGEIVKGVCSNFLCDLKAGAEVTLTGPVGKEMLMPKDPNATVIMLATGTGIAPFRSYLWKMFFEKHDDYKFNGLAWLFLGVPTSSSLLYKEEFEKMKEKYPSNFRLDFAVSREQKNEKGEKMYIQTRMAQYAEELWELLKKDNTYVYMCGLKGMEKGIDDIMLSLAAKDGIDWLDYKKQLKKAEQWNVEVY

SEQ ID NO: 4347 - protein, 362 aa, Bupleurum chinense
MATAVSAAVSLPSSKSNSISSRTSIISPDRLNFIKVPLTLRNVSSGGKMVFIRAQVATDAPAKVEKVSKKVEEGVITNKFKPKEPYVGKCLLNTKITGDDAPGETWHMVFSTEGEVPYKEGQSIGIIADGEDKSGKPHKLRLYSIASSAIGDFGDSKTVSLCVKRLVYTNDQGEEVKGVCSNYLCDLKPGSDVKITGPVGKEMLMPKDPNATVIMLGTGTGIAPFRSFLWKMFFEKHEDYEFNGLAWLFLGVPTSSSLLYKEEFEKMKEKKPENFRLDFAVSREQTNAKGEKMYIQTRMAEYAEELWELLKKDNTFIYMCGLKGMEKGIDDIMVSLAAKEGIDWNEYKRSLKKSGQWNVEVY

SEQ ID NO: 4348 - protein, 363 aa, Coffea canephora
MATAVTAAVSLPSSKTSASLSSKTSIISPERINFVKVPLYYKNVSIGRKLVSIKAQVTTEAPAKVQKVSKKQEKGVGTNKYKPKDPYMGKCLLNTKITGDDAPGKTWHMVFTTEGELPYREGQSIGVIANGVNKNGKPHKLRLYSIGSSALGDFGDSKTVSLCVKRLVYTNDQGEIVKGVCSNFLCDLKPGAEVKITGPVGKEMLMPKDPNATVVMLATGTGIAPFRGFLWKMFFEKHDDYKFNGLAWLFLGVPTSSSLLYKEEFEKMKEKHPDNFRLDFAVSREQTNERGEKMYIQTRMAQYAEELWELLKKDNTFVYMCGLKGMEKGIDDIMASLAAKDGIDWAEYKKQLKKGEQWNVEVY

SEQ ID NO: 4349 - protein, 327 aa, Tropaeolum majus
MATAVSAAVSLPSSNSTSLIPTRTSITSAERVSFKKATLHGCGGRRVVSIRAQVTTEAPAKVEKISKKQEEGITVNKFKPKNPYTGRCLLNTKITADDAPGETWHMVFSTEGEVPYREGQSIGVIADGVDKNGKPHKLRLYSIASSALGDFGDSKTVSLCVKRLVYTNDQGEVVKGVCSNFLCDLKPGAEVKITGPVGKEMLMPKDPNATVIMLATGTGIAPFRSFLWKMFFEKYDDYKFNGLAWLFLGVPTSSSLLYKEEFETMQSKHPDNFRLDFAVSREQTNEKGEKMYIQTRMAQYARELWELLKKRQHLCLHVWVKRDGERN

SEQ ID NO: 4350 - protein, 367 aa, Vinca minor
MATAAVSAAVSLPSIKSSSSISTTRTSIISTERVNFNKVPLYYRSVSSGGKVVASIRAQVTTEAPAKVEKVSKKNEEGVIVNKYKPKEPYIGRCLLNTKITGDDAPGETWHMVFTTEGEVPYREGQSIGIIPDGIDPKNGKPHKLRLYSIASSAIGDFGDSKTVSLCVKRLVYTNDNGELVKGVCSNFLCDLKPGADVKITGPIGKEMLMPKDPNATVIMLGTGTGIAPFRSFLWKMFFEKHDDYQFNGLAWLFLGVPTSSSLLYKEEFEKMKEKYPENFRLDFAVSREQTNEQGEKMYIQTRMAQYAEELWQLLKKDNTYVYMCGLKGMEKGIDDIMVSLAARDGIDWLEYRRQLKKAEQWNVEVY

SEQ ID NO: 4351 - protein, 364 aa, Prunus persica
MAAAVTAAVSFPSSKSSSLPSRTSIISPDRITLKKVPLYYRDASASGRVVSIRAQVTTEAAPPAKVVKESKKQDEGVVVNKYKPKNPYTARVLLNTKITGDDAPGETWHMVFSTEGEIPYREGQSIGVIPDGIDKNGKPHKLRLYSIASSALGDFGDSKTVSLCVKRLVYTNDQGEIVKGVCSNFLCDLKPGSEVTVTGPVGKEMLMPKDPNATIVMLATGTGIAPFRSFLWKMFFEKHEDYKFNGLAWLFLGVPTSSSLLYKEEFEKMKEKVPENFRLDFAVSREQTNEKGEKMYIQTRMAQYAEELWELLKKDNTYIYMCGLKGMEKGIDDIMVSLAAKDGIDWIDYKKKLKKAEQWNVEVY

SEQ ID NO: 4352 - protein, 364 aa, Triphysaria pusilla
MAAAVSAAVSLPSSKSTSLSARTAFISPERTNFKKGPLYYRNVVSSGRANVLSIKAQVTTDAPVKAEKVHKKQEEGVVVNKFRPKEPYIGRVLLNTKITGDDAPGETWHMVFSTEGEVPYREGQSIGVIPDGIDKNGKPHKLRLYSIASSAIGDFGDSKTVSLCVKRLVYTNDQGETVKGVCSNFLCDLKPAAEVKITGPVGKEMLMPKDPNATIIMLGTGTGIAPFRSFLWKMFFEKHEDYKFNGLAWLFLGVPTSSSLLYKEEFEKMKEKNPENFRLDFAVSREQTNDKGEKMYIQTRMAEYAEELWEMLKKENTFVYMCGLKGMEKGIDDIMLSLAAKDGIDWLDYKKQLKRAEQWNVEVY

SEQ ID NO: 4353 - protein, 362 aa, Daucus carota
MATALTAALSLHSSKTPSISTTPSILSTDRLNFTKVPLTFRNVSSGGKMVAIRAQVTTEAPAKVEKVSKKVEEGVVTNKFRPKEPYVGKCLLNTKITGDDAPGETWHMVFSTEGEVPYKEGQSIGIIADGEDKNGKPHKLRLYSIASSALGDFGDSKTVSLCVKRLVYTNDQGEVVKGVCSNFLCDLKPGADVKITGPVGKEMLMPKDPNATVVMLATGTGIAPFRSFLWKMFFEKHEDYQFNGLAWLFLGVPTSSSLLYKEEFEKMKEKKPDNFRLDFAVSREQTNAKGEKMYIQTRMAEYAEELWELLKKDNTFIYMCGLKGMEKGIDDIMVSLAAKDGIDWIEYKRSLKKAGQWNVEVY

SEQ ID NO: 4354 - protein, 362 aa, Daucus carota
MATALTAALSLHSSKTPSISTTPSILSTDRLNFTKVPLTFRNVSSGGKMVAIRAQVTTEAPAKVEKVSKKVEEGVVTNKFRPKEPYVGKCLLNTKITGDDAPGETWHMVFSTEGEVPYKEGQSIGIIADGEDKNGKPHKLRLYSIASSALGDFGDSKTVSLCVKRLVYTNDQGEVVKGVCSNFLCDLKPGADVKITGPVGKEMLMPKDPNATVVMLATGTGIAPFRSFLWKMFFEKHEDYEFNGLAWLFLGVPTSSSLLYKEEFELMKEKKPENFRLDFAVSREQTNAKGEKMYIQTRMAEYAEELWELLKKDNTFIYMCGLKGMEKGIDDIMVSLAAKDGIDWIEYKRSLKKAGQWNVEVY

SEQ ID NO: 4355 - protein, 362 aa, Daucus carota
MATAVSAAVSLPSSSSTSLSTRTSFISTDRLSFAKVPLTFRNVSSGGKLVSIRAQVTTEAPAKVEKVSKKVDEGIVTNKYRPKEPYVGKCLLNTKITGDDAPGETWHMVFSTEGEIPYKEGQSIGIIADGEDKNGKPHKLRLYSIASSAIGDFGDSKTVSLCVKRLVYTNDQGEEVKGVCSNYLCDLKPGADVSITGPVGKEMLMPKDPNATVIMLGTGTGIAPFRSFLWKMFFEKHEDYEFNGLAWLFLGVPTSSSLLYKEEFELMKEKKPENFRLDFAVSREQTNAKGEKMYIQTRMAEYAEELWELLKKDNTFIYMCGLKGMEKGIDDIMVSLAAKEGIEWIEYKRSLKKAGQWNVEVY

SEQ ID NO: 4356 - protein, 362 aa, Manihot esculenta
MAAAVTAAVSFPSSKSTSLSSRTSIVAPERITFKQVPFYYKDVSAGGRVVSISAQVTTEAPAKVKKESKKMEEDVVVNKFKPKNPYIGRCLLNTKITGDDAPGETWHMVFSTEGEVPYREGQSIGVIPDGIDKNGKPHKLRLYSIASSALGDFGDSKTVSLCVKRLVYVNEKGETVKGVCSNFLCDLKPGSEVKITGPVGKEMLMPKDPNATIIMLATGTGIAPFRSFLWKMFFEKHDDYKFNGLAWLFLGVPTSSSLLYKEEFEKMKEKVPNNFRLDFAVSREQTNEKGEKMYIQTRMAQYAEELWELLKKDNTYVYMCGLKGMEKGIDDIMLSLAARDGIDWLEYKRSLKKAEQWNVEVY

SEQ ID NO: 4357 - protein, 364 aa, Scabiosa columbaria
MATAVTAAVSLPSSKSTSLSTRTSSSSLSLFSPERIKVPLYYKNVSGGGKMVSIRAQVTTEAPAKVEKISKKNEEGVVVNKFKPKNPYTGMCLLNTKITGDDAPGETWHMVFSTEGEVPYREGQSIGIIPDGIDKNGKPHKLRLYSIASSAIGDFGDSKTVSLCVKRLVYTNDQGEVVKGVCSNFLCDLKPGSQVKITGPIGKEMLMPKDPNATIIMLATGTGIAPFRSFLWKMFFEKHEDYKFNGLAWLFLGVPTSSSLLYKEEFEKMKEKNPDNFRLDFAVSREQTNEKGEKMYIQTRMAEYAEELWQLLKKDNTFVYMCGLKGMEKGIDDIMVSLAAREGIDWIEYKRQLKKAEQWNVEVY

SEQ ID NO: 4358 - protein, 316 aa, Primula obconica
MAGAVSVAVSLPTSKSSALQTRTSFVSTSERITFNKVAFPYRNVSAGGKLGLVIRAQVTTTETPKKVEKISKKMEEGVIVNKFRPKEPYVGRCLLNTKITGDDAPGETWHMVFSTEGEVPYKEGQSIGVIPEGIDKNGKPHKLRLYSIASSALGDFGDSKTVSLCVKRLVYTNDQGETVKGVCSNFLCDLKPGTEVKITGPVGKEMLMPKDPNATIVMLGTGTGIAPFRSFLWKMFFEKHDDYKFNGLAWLFLGVPTSSSLLYREEFEKMKEKAPENFRLDFAVSREQTNDKGEKMYIQTRMAQYAEELWELLQKR

SEQ ID NO: 4359 - protein, 364 aa, Vaccinium corymbosum
MAAAVSAAVSLPSSKSTSRSARTNVFSPDGINFKVSLPYRNVSAGGKVFTVRAQVTTEAVEAPAKVEKVSKKMDEGVVVNKYRPKDPYIGRCLLNTKITGDDAPGETWHMVFTTEGEVPYREGQSIGVIPDGIDKNGKPHKLRLYSIASSALGDFGDSKTVSLCVKRLVYTNDQGEIVKGVCSNFLCDLKPGSDVKITGPVGKEMLMPKDPTATVIMLATGTGIAPFRSFLWKMFFEKYDDYKFNGLAWLFLGVPTSSSLLYKEEFEKMKEKAPDNFRLDFAVSREQTNEKGEKMYIQTRMAQYAEELWELLKKDNTYVYMCGLKGMEKGIDDIMVSLAAKDGIDWMAYKKQLKKAEQWNVEVY

SEQ ID NO: 4360 - protein, 365 aa, Prunus mume
MAAAVTAAVSFPSSKSSSLPSRTSIISPDRITLKKVPLYYRDASASGRVVSIRAQVTTTEAAPPAKVVKESKKQDEGVVVNKYKPKNPYTARVLLNTKITGDDAPGETWHMVFSTEGEIPYREGQSIGVIPDGIDKNGKPHKLRLYSIASSALGDFGDSKTVSLCVKRLVYTNDQGEIVKGVCSNFLCDLKPGSEVTVTGPVGKEMLMPKDPNATIVMLATGTGIAPFRSFLWKMFFEKHEDYKFNGLAWLFLGVPTSSSLLYKEEFEKMEEKAPENFRLDFAVSREQTNEKGEKMYIQTRMAQYAEELWELLKKDNTYIYMCGLKGMEKGIDDIMVSLAAKDGIDWTDYKKKLKKAEQWNVEVY

SEQ ID NO: 4361 - protein, 362 aa, Daucus carota
MATALTAALSLHSSKTPSISTTPSILSTDRLNFTKVPLTFRNVSSGGKMVAIRAQVTTEAPAKVEKVSKKVEEGVVTNKFRPKEPYVGKCLLNTKITGDDAPGETWHMVFSTEGEVPYKEGQSIGIIADGEDKNGKPHKLRLYSIASSALGDFGDSKTVSLCVKRLVYTNDQGEVVKGVCSNFLCDLKPGADVKITGPVGKEMLMPKDPNATVVMLATGTGIAPFRSFLWKMFFEKHEDYQFNGLAWLFLGVPTSSSLLYKEEFEKMKEKKPDNFRLDFAVSREQTNAKGEKMYIQTRMAEYAEELWELLKKDNTFIYMCGLKGMEKGIDDIMVSLAAKEGIEWIEYKRSLKKAGQWNVEVY

SEQ ID NO: 4362 - protein, 362 aa, Daucus carota
MATAVSAAVSLPSSSSTSLSTRTSFISTDRLSFAKVPLTFRNVSSGGKLVSIRAQVTTEAPAKVEKVSKKVDKDIVTNKYRPKEPYVGKCLLNTKITGDDAPGETWHMVFSTEGEIPYKEGQSIGIIADGEDKNGKPHKLRLYSIASSAIGDFGDSKTVSLCVKRLVYTNDQGEEVKGVCSNYLCDLKPGADVSITGPVGKEMLMPKDPNATVIMLGTGTGIAPFRSFLWKMFFEKHEDYEFNGLAWLFLGVPTSSSLLYKEEFELMKEKKPENFRLDFAVSREQTNAKGEKMYIQTRMAEYAEELWELLKKDNTFIYMCGLKGMEKGIDDIMVSLAAKDGIDWIEYKRSLKKAGQWNVEVY

SEQ ID NO: 4363 - protein, 363 aa, Aquilegia formosa
MATALAAAVSLPSSSKSSSLSSRTSIIFTERTSFNKNYLYSKNLSIGGNVVSIRAQVTTEAPAKVAKHSKKQEEGVVVNKFKPKNPYIGRVLLNTKITGDDAPGETWHMVFSTEGEVPYREGQSIGIIPDGVDKNDKPHKLRLYSIASSALGDFGDSKTVSLCVKRLIYTNDKGETIKGVCSNFLCDLKPGAEVKITGPIGKEMLLPKDPNATIVMLATGTGIAPFRSFLWKMFFEKHEDYKFNGLGWLFLGVPTSSSLLYKEEFEKMKEKAPENFRLDFAVSREQTNEKGEKMYIQTRMAQYAEELWELLKKDNTYVYMCGLKGMEKGIDDIMVSLAAKDGIDWIEYKRQLKKGEQWNVEVY

SEQ ID NO: 4364 - protein, 362 aa, Eschscholzia californica
MATTVTASVSLPSSSKSSSLSSRTSIIFSDRINLTKSNVYSGAISTGRVVSIRAQVTTEAPAKVVKISKKNDEGVIVNRYKPKEPYTGRCLLNTKITGDDAPGETWHMVFSTEGEIPYREGQSVGVIADGIDKNGKPHKLRLYSIASSALGDFGDSKTVSLCVKRLVYTNDAGEVVKGVCSNFLCDLKPGAEVKLTGPVGKEMLMPKDPNATIIMLGTGTGIAPFRSFLWKMFFEKHEDYKFNGLAWLFLGVPTSSSLLYKEEFEKMKEKAPENFRLDFAVSREQTNEAGEKMYIQTRMAQYAEELWQMLKKDNTYVYMCGLKGMEKGIDDIMGSLAARDGLDWLEYKRQLKKAEQWNVEVY

SEQ ID NO: 4365 - protein, 362 aa, Glycine max
MAAAVSAAVSFPSTKSTSLPSRTSLIAPERVVFKKASLQNRDVSSSGRVVSIRAQVTTEAPAKVEKESKKQDEGVVVNKFKPKTPYIGRCLLNTKITGDDAPGETWHMVFSTEGEIPYREGQSIGVIPDGIDKNGKPHKLRLYSIASSAIGDFGDSKTVSLCVKRLVYTNENGEIVKGVCSNFLCDLKPGAEVTITGPVGKEMLMPKDPNATIIMLGTGTGIAPFRSFLWKMFFEKHEDYKFNGLAWLFLGVPTSSSLLYKEEFEKMQEKSPENFRLDFAVSREQTNEKGEKMYIQTRMAQYAEELWELLKKDNTFVYMCGLKGMEKGIDDIMVSLAAKDGIDWTEYKRQLKKAEQWNVEVY

SEQ ID NO: 4366 - protein, 359 aa, Citrullus lanatus
MAAAVTAAVSFPSKSSSLPSRTPLISPDRIFLKKVPVFFHGGRAAVSPIRAQVTTEAPAKVEKESKKQEEGIVVNKFKPKSPYVGRCLLNTKITGDDAPGETWHMVFSTEGEVPYREGQSIGVIADGEDKNGKPHKLRLYSIASSALGDFGDSKTVSLCVKRLVYTNEQGEIVKGVCSNFLCDLKPGAEVKITGPVGKEMLMPKDPNATVIMLATGTGIAPFRSFLWKMFFEKHEDYKFNGLAWLFLGVPTSSSLLYKEEFEKMKEKYPDNFRLDFAVSREQTNEQGEKMYIQTRMAQYAEELWELLKKDNTFVYMCGLKGMEKGIDDIMVSLAARDGIDWLEYKRELKKSEQWNVEVY

SEQ ID NO: 4367 - protein, 365 aa, Cyclamen graecum
  Sequence also found in Organisms: Ananas comosus
MAAAVSAAVSLSSSKSSSLQTRTPIVPTPERISFNKVSLPYRNVSRVGKLGSVIRAQVTTTETPKKVEKISKKNEEGVIVNKYRPKEPYIGRCLLNTKITGDDAPGETWHMVFSTDGEVPYREGQSIGVIPEGVDKNGKPHKLRLYSIASSALGDFGDSKTVSLCVKRLVYTNDKGELVKGVCSNFLCDLKPGTEVKITGPVGKEMLMPKDPNATIVMLGTGTGIAPFRSFLWKMFFEEHEDYKFNGLAWLFLGVPTSSSLLYKEEFEKMKEKFPDTFRLDFAVSREQTNEKGEKMYIQTRMAQYAEELWEMLKKDNTFVYMCGLKGMEKGIDDIMVSLAAKDGIDWMEHKKLLKKAEQWNVEVY

SEQ ID NO: 4368 - protein, 366 aa, Chelidonium majus
MATAVTAAVSLPSSKSASLSSRTSIIFADRISFTKSNVYSGGVSIAGKSVSIRAQVTTETTEAPPAKVEKHSKKNEEGVIVNKYKPKNPYTGRCLLNTKITADDAPGETWHMVFSTEGEIPYREGQSVGVIPDGIDKNGKPHKLRLYSIASSALGDFGDSKTVSLCVKRLVYTNDQGEVVKGVCSNFLCDLKPGSEVKLTGPVGKEMLMPKDPNATVIMLGTGTGIAPFRSFLWKMFFEKHEDYKFNGLAWLFLGVPTSGSLLYKEEFEKMKEKAPDNFRLDFAVSREQTNEQGEKMYIQTRMAQYAEELWQLLKKDNTFVYMCGLKGMEKGIDDIMASLAERDGLNWVEYKRQLKKAEQWNVEVY

SEQ ID NO: 4369 - protein, 366 aa, Plantago ovata
MATAVSAAVTLSSATSNTLSARTSISSTDRLLFNKVPLHYRSVSYTGVKVLPIRAQITTTEEVPTAKVEKVHKKQEEGVVVNKFRPKEPYIGRCLLNTKITGDDAPGETWHMVFSTEGEVPYREGQSIGVIADGEDKNGKPHKLRLYSIASSALGDFGDSKTVSLCVKRLVYTNDAGEVVKGVCSNFLCDLKPGSEVKITGPVGKEMLMPKDPNATVIMLATGTGIAPFRSFLWKMFFEKHEDYKFNGLAWLFLGVPTSSSLLYKEEFEKMKEKSPDNFRVDFAVSREQANAQGEKMYIQTRMAEYAEELWQLLKKDNTFVYMCGLKGMEKGIDDIMVSLAARDGIDWIEYKRQLKKAEQWNVEVY

SEQ ID NO: 4370 - protein, 360 aa, Cucumis melo
MAAAVTAAAVSFPSKSSSLPSRTPLISPDRIFLKKVPVFYHGGRVAVSPIRAQVTTEAPAKVEKESKKQEEGIVVNKFKPKTPYIGRCLLNTKITGDDAPGETWHMVFSTEGEVPYKEGQSIGVIADGEDKNGKPHKLRLYSIASSALGDFGDSKTVSLCVKRLVYTNEQGEIVKGVCSNFLCDLKPGAEVKITGPVGKEMLMPKDPNATVIMLATGTGIAPFRSFLWKMFFEKHEDYKFNGLAWLFLGVPTSSSLLYKEEFEKMKEKYPENFRLDFAVSREQTNEKGEKMYIQTRMAEYAEELWELLKKDNTFVYMCGLKGMEKGIDDIMDSLAARDGIDWQEYKRQLKRSEQWNVEVY

SEQ ID NO: 4371 - protein, 362 aa, Petroselinum crispum
MATAVSAAVSLPSSNSTSLSTRTSFISTDRLNFTKVPLTYRNVSSGGKLVAIRAQVTTEAPAKVEKVSKKVDKGVVTNTFRPKEPYVGKCLLNTKITGDDAPGETWHMVFSTEGKIPYLEGQSIGIIADGEDKNGKPHKLRLYSIASSAIGDFGDSQTVSLCVKRLVYTNDQGEIVKGVCSNYLCDLKPGADVNITGPVGKEMLMPKDPNATIIMLGTGTGIAPFRSFLWKMFFEKHEDYEFNGLAWLFLGVPTSSSLLYKEEFEKMKEKKPENFRLDFAVSREQTNAKGEKMYIQTRMAEYAEELWELLKKDNTFIYMCGLKGMEKGIDDIMVTLAAKDGIDWTEYKRSLKKAGQWNVEVY

SEQ ID NO: 4372 - protein, 362 aa, Glycine max
MAAAVSAAVSFPSTKSTSLPSRTSIITPERVVFKKASLQYRDVCSSGRVVSIRAQVTTEAPAKVEKESKKQDEGVVVNKFKPKTPYVGRCLLNTKITGDDAPGETWHMVFSTEGEIPYREGQSIGVIPDGVDKNGKPHKLRLYSIASSAIGDFGDSKTVSLCVKRLVYTNENGEIVKGVCSNFLCDLKPGAEVTITGPVGKEMLMPKDPNATIIMLGTGTGIAPFRSFLWKMFFEKHEEYKFNGLAWLFLGVPTSSSLLYKEEFEKMQEKYPDNFRLDFAVSREQTNENGEKMYIQTRMAQYAEELWELLKKDNTFVYMCGLKGMEKGIDDIMVSLAAKDGIDWTEYKRQLKKSEQWNVEVY

SEQ ID NO: 4373 - protein, 365 aa, Ricinus communis
MAAAVTAAVSFPSTKSTSLPSRTSIIAPERTTLKKVPVYYRDVVSAGKRVVSIRAQVTTEAEAPVKVKKESKKNEEGIVVNKFKPKNPYTGRCLLNTKITGDDAPGETWHMVFSTEGEVPYREGQSIGVIPDGIDKNGKPHKLRLYSIASSALGDFGDSKTVSLCVKRLVYTNDKGELVKGVCSNFLCDLKPGAEVQITGPVGKEMLMPKDPNATIVMLGTGTGIAPFRSFLWKMFFEKHEDYKFNGLAWLFLGVPTSSSLLYKEEFEKMKEIAPDNFRLDFAVSREQTNEKGEKMYIQTRMAQYAEELWELLKKDNTFVYMCGLKGMEKGIDDIMASLAAKEGIDWLEYKRQLKKAEQWNVEVY

SEQ ID NO: 4374 - protein, 75 aa, Cucurbita pepo
MAAAVTAAVLSPPPPKSSSLPSRTALISPDRIALKKVRRVHHGGRVVVAPIRAQVTTEAPAKVEKSRRSKKKESW

SEQ ID NO: 4375 - protein, 364 aa, Cicer arietinum
MAAAVTAAVSFPYSNSTSLPIRTSVVAPERLVFKKVSLQYRDNNVSISGRVGSIRAQVTTEAPAKVEKISKKQDEGIVVNKFKPKEPYIGRCLLNTKITGDDAPGETWHMVFSTEGEVPYREGQSIGVVPDGIDKNGKPHKLRLYSIASSAIGDFGDSKTVSLCVKRLVYTNDSGEVVKGVCSNFLCDLKPGSEVKITGPVGKEMLMPKDPNATIIMLGTGTGIAPFRSFLWKMFFEKHEDYQFNGLAWLFLGVPTSSSLLYKEEFEKMKEKAPENFRLDFAVSREQVNEKGEKMYIQTRMAQYAEELWELLKKDNTFVYMCGLKGMEKGIDDIMVSLAAKDGIDWIEYKRQLKKAEQWNVEVY

SEQ ID NO: 4376 - protein, 361 aa, Gossypium raimondii
MAAVTAAVSFPSTNSTSFTTRTSIISPERITFKKVSFYYPDVSSGGRVVSVRAQVTTEAPAKVVKESKKNDEGVVVNKFKPKEPYIGRCLLNTKITGDDAPGETWHMVFSTEGEVPYREGQSIGVIPDGVDKNGKPHKLRLYSIASSALGDFGDSKTVSLCVKRLVYTNEKGELVKGVCSNFLCDMKPGAEVKITGPIGKEMLMPKDPDATIIMLATGTGIAPFRSFLWKMFFERHEDYKFNGLAWLFLGVPTSSSLLYKEEFEKMKETYPDNFRLDFAVSREQTNEKGEKMYIQTRMAEYAKELWELLKKDNTFVYMCGLKGMEKGIDDIMVSLAAADGIDWIEYKRQLKKSEQWNVEVY

SEQ ID NO: 4377 - protein, 363 aa, Scabiosa columbaria
MATAVSAAVSLPSSKSTSLATRSTSLFFPERVNFVKVPLYNKNVCGGAKVVSIRAQVTTEAPAKVVKESKKNEEGIVVNKFKPKNPYTGMCLLNTKITGDDAPGETWHMVFSTEGEVPYREGQSIGVIPEGIDKNGKPHKLRLYSIASSAIGDFGDSKTVSLCVKRLVYTNDQGEVVKGVCSNFLCDLKPGSNVTITGPIGKEMLMPKDPNATIIMLATGTGIAPFRSFLWKMFFEKHDDYKFNGLAWLFLGVPTSSSLLYKEEFEKMKEKNPDNFRLDFAVSREQTNEKGEKMYIQTRMAEYAEELWQLLKKDNTFVYMCGLKGMEKGIDDIMVSLAARDGIDWIEYKRQLKKAEQWNVEVY

SEQ ID NO: 4378 - protein, 364 aa, Cicer arietinum
MAAAVTAAVSFPYSNSTSLPIRTSVVAPERLVFKKISLQYRDNNVSISGRVGSIRAQVTTEAPAKVEKISKKQDEGIVVNKFKPKEPYIGRCLLNTKITGDDAPGETWHMVFSTEGEVPYREGQSIGVVPDGIDKNGKPHKLRLYSIASSAIGDFGDSKTVSLCVKRLVYTNDSGEVVKGVCSNFLCDLKPGSEVKITGPVGKEMLMPKDPNATIIMLGTGTGIAPFRSFLWKMFFEKHEDYQFNGLAWLFLGVPTSSSLLYKEEFEKMKEKAPENFRLDFAVSREQVNEKGEKMYIQTRMAQYAEELWELLKKDNTFVYMCGLKGMEKGIDDIMVSLAAKDGIDWIEYKRQLKKAEQWNVEVY

SEQ ID NO: 4379 - protein, 362 aa, Lactuca sativa
MASAVSAIVSLPSSKSAAISTRTSLITQERVSFTKVPYYKNVSSNVKSLSIRAQVTTEAPAKVEKISKKQEEGVVTNKYRPKEPYVGRCLLNTKITGDDAPGETWHMVFTTEGEIPYKEGQSIGVIPDGIDPKNGKPHKLRLYSIASSALGDFGDSKTVSLCVKRLVYTNDAGEEVKGVCSNFLCDLKPGAEVQITGPVGKEMLMPKDPNATVIMLATGTGIAPFRSFMWKMFFEKHEDYKFNGLAWLFLGVPTSSSLLYKEEFEKMKEMKPDNLRVDFAVSREQTNEKGEKMYIQTRMAQYDRELWELLKKDNTFVYMCGLKGMEKGIDDIMGTLAAEDGIDWVTYKKQLKKEGQWNVEVY

SEQ ID NO: 4380 - protein, 365 aa, Arnica chamissonis
MAAAVSAVVSLPSSKSTVISSRSSLTPQERVSFTKVPYYKNVSTSGNKLLSIRAQLVTDTEAPAKVEKISKKQEEGVVTNKYRPKEPYVGRCLLNTKITGDDAPGETWHMVFTTEGEIPYREGQSIGVIPDGIDPKNGKPHKLRLYSIASSAIGDFGDSKTVSLCVKRLVYTNDAGEEVKGVCSNFLCDLKPGSEVQITGPVGKEMLMPKDPNATVIMLATGTGIAPFRSFLWKMFFEKHEDYKFNGLAWLFLGVPTSSSLLYKEEFEKMKEMKPDNLRVDFAVSREQTNEKGEKMYIQTRMAQYDRELWELLKKDNTFVYMCGLKGMEKGIDDIMVTLAAEDGIDWIQYKKQLKKQGQWNVEVY

SEQ ID NO: 4381 - protein, 363 aa, Linum usitatissimum
MAAAVTSAAVSFPSSKSSFPLSSRTSIIPTPERIAFKKASYVQAGARGVVSVRAQVTTEAPVVKVKKESKKDEEGVIVNKYKPKEPYTGRCLLNTKITSDDAPGETWHMVFSTEGEVPYREGQSIGVIPEGIDKNGKPHKLRLYSIASSALGDFGDSKTVSLCVKRLIYTNDAGEIVKGVCSNFLCDLKPGSEVKITGPVGKEMLMPKDPNATIIMLGTGTGIAPFRSFLWKMFFEKHEDYKFNGLAWLFLGVPTSSSLLYKEEFEKMKEKAPENFRLDFAVSREQTNEMGEKMYIQTRMAQYAEELWELLKKDNTYVYMCGLKGMEKGIDEIMVGLAAKEGIDWLDYKKQLKKAEQWNVEVY

SEQ ID NO: 4382 - protein, 362 aa, Cyclamen graecum
MATAISAAVSFQSSSSTSLSTKSSIISPKRITFKVPLPNRNVSTGCRVLSIRAQITTDAPAKKVEKHSKKMEEGVIVNKYRPKDPYIGTCLLNTKITADDAPGETWHMVFSTEGEVPYREGQSIGVIPDGVDKNGKPHKLRLYSIASSALGDLGDSKTVSLCVKRLVYTNDQGEVVKGVCSNFLCDLKPGADVKITGPVGKEMLMPVDPTATVIMLATGTGIAPFRSFLWKMFFEKHEDYKFNGLAWLFLGVPTSSSLLYKDEFTKMKEKAPENFKVDYAVSREETNEKGEKMYIQTKMAQYAEQLWELLKKDNTYVYMCGLKGMEKGIDDIMVSLAAKDGIDWLDYRKQLKKAEQWNVEVY

SEQ ID NO: 4383 - protein, 362 aa, Cirsium arvense
MAAAVSAVVSLSSSKSTAISTRTSLVSQERVSFAKVPYYKNVSSSGKLFSIRAQVTTEAPAKVEKVSKKQEEGVVTNKYRPKEPYVGRCLLNTKITGDDAPGETWHMVFSTEGEIPYREGQSIGVIPDGIDPKNGKPHKLRLYSIASSAIGDFGDSKTVSLCVKRLVYTNDQGVEVKGVCSNFLCDLKPGSEVQITGPVGKEMLMPKDPNATVIMLATGTGIAPFRSFMWKMFFEKHEDYQFNGLAWLFLGVPTSSSLLYKEEFEKMKEMKPENLRVDFAVSREQTNDKGEKMYIQTRMAQYDKELWELLKKDNTFVYMCGLKGMEKGIDDIMVSLAAEDGIDWLQYKKQLKKEGQWNVEVY

SEQ ID NO: 4384 - protein, 363 aa, Lotus japonicus
MAAAVTAAVSFPSTKSTSLTSRTSIVAPERVVFKKVPLQYTSGRVVSIRAQVTTDTDTQAPPAKVEKVHKKQEEGVVVNKFKPKNPYIGRVLLNSKITGDDAPGETWHMVFSTEGEVPYREGQSIGVIPEGIDKNGKPHKLRLYSIASSALGDFGDSKTVSLCVKRLVYTNDSGEIVKGVCSNFLCDLKPGSEVTITGPVGKEMLMPKDPNATVIMLATGTGIAPFRSFLWKMFFEKHDDYKFNGLAWLFLGVPTSSSLLYKEEFEKMKEKSPENFRLDFAVSREQTNDKGEKMYIQTRMAQYAEELWQLLKKDNTFVYMCGLKGMEKGIDDIMVSLAARDGIDWIEYKRQLKKAEQWNVEVY

SEQ ID NO: 4385 - protein, 367 aa, Utricularia gibba
MAAAVSAAVSLPSSKSTSLTTRNSSAVSERITYNKGSLSYRNGSCGGSKFLSIRAQVTADTEVQAPPKAVKHSKKQEEGVVVNKFKPKDPYTGRCLLNTKITGDDAPGETWHMVFSTEGEVPYREGQSIGVIPDGIDKNGKPHKLRLYSIASSALGDFGDSKTVSLCVKRLVYTNDQGEIVKGVCSNFLCDLKPGAEVKITGPVGKEMLMPKDPNATVIMLATGTGIAPFRSFLWKMFFEKHDDYQFNGLAWLFLGVPTSSSLLYKEEFEKMKEKSPENFRVDFAVSREQTNANGEKMYIQTRMAEYAQELWELLKKDNTYVYMCGLKGMEKGIDDIMVSLAAKDGIDWIDYKKQLKRGEQWNVEVY

SEQ ID NO: 4386 - protein, 365 aa, Arnica chamissonis
MAAAAVSVVVSLPSSKSTVISTTTSLVSHPRVSFTKVPYYKNVSTNGRLVSIRAQVATDTEAPAKVEKVSKKQEEGVVTNKYRPKEPYVGRCLLNTKITGDDAPGETWHMVFSTEGEIPYREGQSIGVIPDGIDPKNGKPHKLRLYSIASSAIGDFGDSKTVSLCVKRLVYTNDKGEEVKGVCSNFLCDLKPGAEVQITGPVGKEMLMPKDPNATVIMLATGTGIAPFRSFMWKMFFEKHEDYKFNGLAWLFLGVPTSSSLLYKEEFEKMKEMKPDNLRVDFAVSREQTNEKGEKMYIQTRMAQYDRELWELLKKDNTFVYMCGLKGMEKGIDDIMVTLAAEDGIDWVQYKKQLKKEGQWNVEVY

SEQ ID NO: 4387 - protein, 364 aa, Heritiera littoralis
MAAVTAAVSFPSTKSTSLPARTSIIISPERITFRKVPVYFRDVSNGGRMVSVRAQVTTEAEAPAKVVKESKKNEEGVVVNKFKPKNPHIGRCLLNTKITGDDAPGETWHMVFSTEGELPYREGQSIGVIPDGIDKNGKPHKLRLYSIASSALGDFGDSKTVSLCVKRLVYTNENGELVKGVCSNFLCDLKPAAEVKITGPVGKEMLMPKDPNATIIMLATGTGIAPFRSFLWKMFFEKHDDYKFNGLAWLFLGVPTSSSLLYKEEFEKMKEKYPDKFRLDFAVSREQTNEKGEKMYIQTRMAQYAKELWELLKKDNTFVYMCGLKGMEKGIDDIMVSLAAEDGVDWTEYKRQLKKAEQWNVEVY

SEQ ID NO: 4388 - protein, 329 aa, Cicer arietinum
AAAVTAAVSFPYSNSTSLPIRTSVVAPERLVFKKISLQYRDNNVSISGRVGSIRAQVTTEAPAKVEKISKKQDEGIVVNKFKPKEPYIGRCLLNTKITGDDAPGETWHMVFSTEGEVPYREGQSIGVVPDGIDKNGKPHKLRLYSIASSAIGDFGDSKTVSLCVKRLVYTNDSGEVVKGVCSNFLCDLKPGSEVKITGPVGKEMLMPKDPNATIIMLGTGTGIAPFRSFLWKMFFEKHEDYQFNGLAWLFLGVPTSSSLLYKEEFEKMKEKAPENFRLDFAVSREQVNEKGEKMYIQTRMAQYAEELWELLKKDNTFVYMCGLKGMEKD

SEQ ID NO: 4389 - protein, 362 aa, Ananas comosus
MATAISAAVSFQSSSSTSLSTKSSIISPKRITFKVPLPNRNVSTGCRVLSIRAQITTDAPAKKVEKHSKKMEEGVIVNKYRPKDPYIGTCLLNTKITADDAPGETWHMVFSTEGEIPYREGQSIGVIPDGVDKNGKPHKLRLYSIASSALGDLGDSKTVSLCVKRLVYTNDQGEVVKGVCSNFLCDLKPGADVKITGPVGKEMLMPVDPTATVIMLATGTGIAPFRSFLWKMFFEKHEDYKFNGLAWLFLGVPTSSSLLYKDEFTKMKEKAPENFKVDYAVSREETNEKGEKMYIQTKMAQYAEQLWELLKKDNTYVYMCGLKGMEKGIDDIMVSLAAKDGIDWLDYRKQLKKAEQWNVEVY

SEQ ID NO: 4390 - protein, 362 aa, Theobroma cacao
MAAVNAAVSFPSTKSTSLPARISIISPERLTFKKVPVYYRDVSSGGRVVSVRAQVTTEAPAKKVVKESKKNEEGVVVNKFKPKNPYTGRCLLNTKITGDDAPGETWHMVFSTEGEVPYREGQSIGVIPDGIDKNGKPHKLRLYSIASSALGDFGDSKTVSLCVKRLVYTNENGELVKGVCSNFLCDMKPGSEVKITGPVGKEMLMPKDPNATIIMLATGTGIAPFRSFLWKMFFEKHDDYKFNGLAWLFLGVPTGSSLLYKEEFEKMKEKYPDNFRLDFAVSREQTNEKGEKMYIQTRMDQYSKELWELLKKDNTYVYMCGLKGMEKGIDDIMVSLAAEDGIDWTEYKRQLKKSEQWNVEVY

SEQ ID NO: 4391 - protein, 363 aa, Populus trichocarpa
MAAAVTAAVSFPSSTKSTSLSSRTTLIAPERITLKKAPVYYRDASASGRVISIRAQVTTEAPVKVEKVSKKDVEGVVVNKFKPKNPYTGRCLLNTKITGDDAPGETWHMVFSTEGEVPYREGQSIGVIPDGIDKNGKPHKLRLYSIASSAIGDFGDSKTVSLCVKRLVYTNEQGEIVKGVCSNFLCDLKPGAEVQITGPVGKEMLMPKDPNATIIMLGTGTGIAPFRSFLWKMFFEKHDDYKFNGLAWLFLGVPTSSSLLYKEEFEKMKEKAPDNFRLDFAVSREQTNDKGEKMYIQTRMAEYAEELWELLKKDNTYVYMCGLKGMEKGIDEIMVSLAAKDGIDWLEYKRSLKKAEQWNVEVY

SEQ ID NO: 4392 - protein, 360 aa, Pisum sativum
MAAAVTAAVSLPYSNSTSLPIRTSIVAPERLVFKKVSLNNVSISGRVGTIRAQVTTEAPAKVVKHSKKQDENIVVNKFKPKEPYVGRCLLNTKITGDDAPGETWHMVFSTEGEVPYREGQSIGIVPDGIDKNGKPHKLRLYSIASSAIGDFGDSKTVSLCVKRLVYTNDAGEVVKGVCSNFLCDLKPGSEVKITGPVGKEMLMPKDPNATVIMLGTGTGIAPFRSFLWKMFFEKHEDYQFNGLAWLFLGVPTSSSLLYKEEFEKMKEKAPENFRLDFAVSREQVNDKGEKMYIQTRMAQYAEELWELLKKDNTFVYMCGLKGMEKGIDDIMVSLAAKDGIDWIEYKRTLKKAEQWNVEVY

SEQ ID NO: 4393 - protein, 270 aa, Amaranthus tuberculatus
MAAAVTAAVSFPTTKSSNPSSRTSSIISNDKISYKKVPLYHRNVCGVGKVGAIRAQVTSDVAAPPAKVEKHSKKMEEGVVLNKYKPKEPYVGRCLLNTKITGDDAPGETWHMVFSHEGEVPYREGQSIGVIADGVDKNGKPHKLRLYSIASSALGDFGDSKTVSLCVKRLVYTNEAGEIVKGVCSNYLCDLKPGAEVKITGPVGKEMLMPKDPNATIIMLATGTGIAPFRSFLWKMFFEKHDDYKFNGLAWLFWVYRQAVLCSTKRNLKR

SEQ ID NO: 4394 - protein, 365 aa, Tropaeolum majus
MATAVSAAVSLPSATSTSLISNRTSIISPERVSFSFNKGFLQYRDVCAGGRVVPIRAQVTTEAPAKVEKVHKKMEDGITVNKFKPKNPYTGRCLLNTRITGDDAPGETWHMVFSTEGEVPYREGQSIGVIADGADKNGKPHKLRLYSIASSAIGDFGDSKTVSLCVKRLVYTNDQGEVVKGVCSNFLCDLKPGSEVKITGPVGKQMLMPKDPNATIIMLGTGTGIAPFRSFLWKMFFESHEDYKFNGLAWLFLGVPTSSSLLYKEEFEEMQKKHPDNFRLDFAVSREQTNEKGEKMYIQTRMAQYARELWELLKKDNTFVYMCGLKGMEKGIDDIMVSLAAEDGIDWLEYKKQLKKAEQWNVEVY

SEQ ID NO: 4395 - protein, 361 aa, Medicago truncatula
MAAAVTAAVSFPYSNSTSLPIRTSVISPDRLVFKKVSLNNVSISGRLTVRAEVATEAPAPVKVEKISKKQEEGIVVNKFKPKTPYIGRCLLNTKITGDDAPGETWHMVFSTEGEVPYREGQSIGIVPDGIDKNGKPHKLRLYSIASSALGDFGDSKTVSLCVKRLVYTNDAGEVVKGVCSNFLCDLRPGSEVQITGPVGKEMLMPKDPNATVIMLGTGTGIAPFRSFLWKMFFEKHEDYKFNGLAWLFLGVPTSSSLLYKEEFEKMKEKAPENFRLDFAVSREQVNDKGEKMYIQTRMAQYAEELWELLKKDNTFVYMCGLKGMEKGIDDIMVSLAAKDGIDWIEYKRSLKKAEQWNVEVY

SEQ ID NO: 4396 - protein, 363 aa, Populus trichocarpa
MAAAVTAAVSFPSSTKSTSLPSRTILIAPERITLRKVPVHFRDVSASGRVISIRAQVTTEAPAKVEKVSKKNEEGVVVNKFKPKNPYTGRCLLNTKITGDDAPGETWHMVFSTEGEVPYREGQSIGVIPDGIDKNGKPHKLRLYSIASSAIGDFGDSKTVSLCVKRLVYTNDQGEIVKGVCSNFLCDLKPGAEVNITGPVGKEMLMPKDPNATVIMLGTGTGIAPFRSFLWKMFFEKHDDYKFNGLAWLFLGVPTSSSLLYKEEFEKMKEKAPDNFRLDFAVSREQTNAKGEKMYIQTRMAEYAEELWELLKKDNTYVYMCGLKGMEKGIDDIMVSLAAKEEIDWLEYKRSLKKAGQWNVEVY

SEQ ID NO: 4397 - protein, 362 aa, Tragopogon dubius
MASAVSAVVSLPSSKSAAISTRTSLISQERVSFTKVPSYKNVSSSVKSFTIRAQVTTEAPAKVEKISKKQEEGVVTNKYRPKEPYVGRCLLNTKITGDDAPGETWHMVFTTEGEIPYREGQSIGVIPDGIDPKNGKPHKLRLYSIASSALGDFGDSKTVSLCVKRLVYTNDEGVEVKGVCSNFLCDLKPGAEVQITGPVGKEMLMPKDPNATVIMLATGTGIAPFRSFMWKMFFEKHDDYKFNGLAWLFLGVPTSSSLLYKEEFEKMKEMKPDNLRVDFAVSREQTNDKGEKMYIQTRMAQYDRELWELLKKDNTFVYMCGLKGMEKGIDDIMGTLAAEDGIDWVTYKKQLKKEGQWNVEVY

SEQ ID NO: 4398 - protein, 364 aa, Echinacea purpurea
MAAAVSVVVSLPSSKSTVISTRTSLISQDRVSFTKVPYYKNVSTNGKSLSIRAQVTTEAEAPPKVEKVSKKQEEGVVTNKYRPKEPYIGRCLLNTKITGDDAPGETWHMVFSTEGEIPYREGQSIGVIPDGIDPKNGKPHKLRLYSIASSALGDFGDSKSVSLCVKRLVYTNDKGEEVKGVCSNFLCDLKPGAEVQITGPVGKEMLMPKDPNATIIMLATGTGIAPFRSFMWKMFFEKHEDYKFNGLAWLFLGVPTSSSLLYKEEFEKMKAAKPDNLRVDYAVSREQTNEKGEKMYIQTRMAQYDRELWELLKKDNTFVYMCGLKGMEKGIDDIMVTLAAEDGIDWTTYKKQLKKEGQWNVEVY

SEQ ID NO: 4399 - protein, 364 aa, Flaveria ramosissima
MASAVSAVVSLPSSKSTTISTRTSLISQERVSFTKVPCYKNVSTSGRLLSIRAQVTTEAEAPAKVEKVSKKQEEGVVTNKYRPKEPYIGRCLLNTKITGDDAPGETWHMVFSTEGEIPYKEGQSIGVIPDGIDPKNGKPHKLRLYSIASSAIGDFGDSKTVSLCVKRLVYTNDQGEEVKGVCSNFLCDLKPGAEVQITGPVGKEMLMPKDPNATIIMLATGTGIAPFRSFMWKMFFEKHEDYKFNGLAWLFLGVPTSSSLLYKEEFEKMKEMKPDNLRVDFAVSREQTNDKGEKMYIQTRMAQYDRELWELLKKDNTFVYMCGLKGMEKGIDDIMTTLAAEEGIDWVQYKKQLKKEGQWNVEVY

SEQ ID NO: 4400 - protein, 364 aa, Flaveria ramosissima
MAAAVSAVVSLPSSKSTTISTRTSLISQERVSFTKVPCYKNVSTSGRLLSIRAQVTTEAEAPAKVEKVSKKQEEGVVTNKYRPKEPYIGRCLLNTKITGDDAPGETWHMVFSTEGEIPYKEGQSIGVIPDGIDPKNGKPHKLRLYSIASSAIGDFGDSKTVSLCVKRLVYTNDQGEEVKGVCSNFLCDLKPGAEVQITGPVGKEMLMPKDPNATIIMLATGTGIAPFRSFMWKMFFEKHEDYKFNGLAWLFLGVPTSSSLLYKEEFEKMKEMKPDNLRVDFAVSREQTNDKGEKMYIQTRMAQYDRELWELLKKDNTFVYMCGLKGMEKGIDDIMTTLAAEEGIDWVQYKKQLKKEGQWNVEVY

SEQ ID NO: 4401 - protein, 214 aa, Primula obconica
MRLVKLGTWVFSTEGEVPYREGQSIGVIADGIDKNGKPHKLRLYSIASSALGDLGDSKTVSLCVKRLVYTNDQGEIVKGVCSNFLCDLKPGADVKITGPVGKEMLMPKDPNATIIMLATGTGIAPFRSFLWKMFFEKHEDYEFKGLAWLFLGVPTSSSLLYKDEFTKMKEKAPENFKVDYAVSREESNEKGEKMYIQTRMAQYAEQLWELTKKG

SEQ ID NO: 4402 - protein, 365 aa, Cichorium intybus
MASAVSAVVSLPSSKSAVVSTRTSLISQERVSFAKVPYFKNASSSVKSLSIRAQVTTEAEAPPAKVEKISKKQEDGVVTNKYRPKEPYVGRCLLNTKITGDDAPGETWHMVFTTEGEIPYREGQSIGVIPDGIDPKNGKPHKLRLYSIASSALGDFGDSKTVSLCVKRLVYTNDAGEEVKGVCSNFLCDLKPGAEVQITGPVGKEMLMPKDPNATIIMLATGTGIAPFRSFMWKMFFEKHEDYKFNGLAWLFLGVPTSSSLLYKEEFEKMKEMKPDNLRVDFAVSREQTNEKGEKMYIQTRMAQYDRELWELLKKDNTFVYMCGLKGMEKGIDDIMGTLAAEDGIDWVTYKKQLKKEGQWNVEVY

SEQ ID NO: 4403 - protein, 366 aa, Elaeis guineensis
MASAAVTAAVSFPSSKSSSLALPTSRTSISTTERLSLHKTCLHPRSVSTAGKLVSIRAQVTTETPAKVQKISKKNDEGVVVNKYKPKEPYIGRCLLNTKITGDDAPGETWHMVFSTEGDVPYREGQSIGVIPDGIDKNGKPHKLRLYSIASSALGDFGDSKTVSLCVKRLVYTNEQGEIVKGVCSNFLCDMKPGAEVKITGPVGKEMLMPKDPNATIIMLATGTGIAPFRSFLWKMFFEKHDDYKFNGLAWLFLGVPTSSSLLYKEEFEKMKEKAPNNFRVDFAVSREQTNEKGEKMYIQTRMAQYAEELWDLLKKDDTYVYMCGLKGMEKGIDDIMVSLAAKDGIDWVDYRKNLKKSEQWNVEVY

SEQ ID NO: 4404 - protein, 366 aa, Helianthus annuus
MAAAVSLAVSLPSSKSTLISTRPSLLSQDRVSFTKVPYYKNVTTNGKPLSIRAQITTEAEAEAPAKVEKVSKKQEEGVVTNKYKPKEPYIGRCLLNTKITGDDAPGETWHMVFSTEGEIPYREGQSIGVIPDGIDPKNGKPHKLRLYSIASSALGDFGDSKTVSLCVKRLVYTNDKGEEVKGVCSNFLCDLKPGAEVQITGPVGKEMLMPKDPNATVIMLATGTGIAPFRSFMWKMFFEKHEDYQFNGLAWLFLGVPTSSSLLYKEEFEKMKEMKPDNLRVDFAVSREQTNDKGEKMYIQTRMAQYDRELWELLKKDNTFVYMCGLKGMEKGIDDIMTTLAAEDGIEWATYKKQLKKEGQWNVEVY

SEQ ID NO: 4405 - protein, 369 aa, Beta vulgaris
MAAAVTAAVSFPSTKSTSLSSRTSSIISPEKISFKKVPLYYRNVSATGKVGPIRAQVTSDVEAPAAAPAKVEKHSKKMEENLVVNKYKPKNPYVGRCLLNTKITGDDAPGETWHMVFSHEGEIPYREGQSVGVIADGLDKNGKPHKLRLYSIASSALGDFGDSKTVSLCVKRLVYTNDAGEEVKGVCSNFLCDLKPGSEVKLTGPVGKEMLMPKDPNATIVMLGTGTGIAPFRSFLWKMFFEKHEDYQFNGLAWLFLGVPTSSSLLYKEEFEKMKEKFPDNFRLDFAVSREQTNEKGEKMYIQTRMAQYANELWEMLKKDNTFVYMCGLKGMESGIDDIMVSLAAAEGIDWFEYKRQLKKAEQWNVEVY

SEQ ID NO: 4406 - protein, 364 aa, Flaveria ramosissima
MASAVSAVVSVPSSKSTTISTRASLISQERVSFTKVPCYKNVSTSGRLSLIRAQVTTEAEAPAKVEKVSKKQEEGVVTNKYRPKEPYIGRCLLNTKITGDDAPGETWHMVFSTEGEIPYKEGQSIGVIPDGIDPKNGKPHKLRLYSIASSAIGDFGDSKTVSLCVKRLVYTNDQGEEVKGVCSNFLCDLKPGAEVQITGPVGKEMLMPKDPNATVIMLATGTGIAPFRSFMWKMFFEKHEDYKFNGLAWLFLGVPTSSSLLYKEEFEKMKEMKPDNLRVDFAVSREQTNDKGEKMYIQTRMAQYDRELWELLKKDNTFVYMCGLKGMEKGIDDIMTTLAAEEGIDWVQYKKQLKKEGQWNVEVY

SEQ ID NO: 4407 - protein, 366 aa, Ambrosia trifida
MAASVSAVVSLPSSKSTIVSTRTSLISQERVSFTKVPHYKNVSTSGRLLSIRAQITTEAETEAPAKVEKISKKQEEGVVTNKYRPKEPFVGRCLLNTKITGDDAPGETWHMVFSTEGEIPYREGQSIGVIPDGIDPKNGKPHKLRLYSIASSAIGDFGDSKTVSLCVKRLVYTNDQGEEVKGVCSNFLCDLKPGSEVQITGPVGKEMLMPKDPNATIIMLATGTGIAPFRSFLWKMFFEKHEDYEFNGLAWLFLGVPTGSSLLYKEEFEKMKEMKPDNFRLDFAVSREQTNDKGEKMYIQTRMAQYDRELWELLKKDNTFVYMCGLKGMEKGIDDIMVTLAAEDGIDWVTYKKQLKREGQWNVEVY

SEQ ID NO: 4408 - protein, 367 aa, Ambrosia trifida
MAAAVSVAVTSLPSSKSTVISTRTSLVSQDRLSFTKVPYYKNLSTNSKPLSIRAQVTTEAEAEAPAKVEKVSKKQEEGVVTNKYRPKEPYIGRCLLNTKITGDDAPGETWHMVFSTEGEIPYKEGQSIGVIPDGIDPKNGKPHKLRLYSIASSALGDFGDSKTVSLCVKRLVYTNDKGEEVKGVCSNFLCDLKPGAEVQITGPVGKEMLMPKDPNATIIMLATGTGIAPFRSFMWKMFFEKHEDYQFNGLAWLFLGVPTSSSLLYKEEFEKMKEMKPDNLRVDFAVSREQTNEKGEKMYIQTRMAQYDRELWELLKKDNTFVYMCGLKGMEKGIDDIMGTLAAEDGIDWVTYKKQLKREGQWNVEVY

SEQ ID NO: 4409 - protein, 361 aa, Flaveria ramosissima
MASAVSAVVSLPSSKSTKISTRTSLISQQRVSFTKVPYYKNVSSRGRLLSVRAQVTTEAEAPEKVSKKQEEGVVTNKYRPKEPYIGRCLLNTKITGDDAPGETWHMVFSTEGEIPYKEGQSIGVIPDGIDPKNGKPHKLRLYSIASSAIGDFGDSKTVSLCVKRLVYTNDQGEEVKGVCSNFLCDLKPGAEVQITGPVGKEMLMPKDPNATIIMLATGTGIAPFRSFMWKMFFEKHEDYKFNGLAWLFLGVPTSSSLLYKEEFEKMKEMKPDNLRVDFAVSREQTNDKGEKMYIQTRMAQYDRELWELLKKDNTFVYMCGLKGMEKGIDDIMTTLAAEEGIDWVQYKKQLKKEGQWNVEVY

SEQ ID NO: 4410 - protein, 363 aa, Arachis hypogaea
MAAAVTASVSFPSTKSASLSSRTSIVAPERVVFKKASLQWRDVSVSIRAQVTTTETETTQTPTKVEKEHKKQEEGVVVNKFKPKNPYIGRCLLNTKITGDDAPGETWHMVFSTEGEVPYREGQSIGVIPEGVDKNGKPHKLRLYSIASSALGDFGDSKTVSLCVKRLVYTNENGEIVKGVCSNFLCDLKPGAEVTITGPVGKEMLMPKDPNATIVMLATGTGIAPFRSFLWKMFFEKHDDYKFNGLAWLFLGVPTSSSLLYKEEFEKMKEKAPENFRLDFAVSREQTNEKGEKMYIQTRMAEYAEELWELLKKDNTFVYMCGLKGMEKGIDDIMVSLAARDGIDWIEYKRQLKKAEQWNVEVY

SEQ ID NO: 4411 - protein, 345 aa, Platanus occidentalis
SLSSRASITSSERISFNKSCLYSRNVSIGGKVVPIRAQVTTEAPAKVVKISKKDDEGVIVNKYKPKNPYIGRCLLNTKITGDDAPGETWHMVFSTEGEIPYREGQSIGVIADGVDKNGKPHKLRLYSIASSALGDFGDSKTVSLCVKRLVYTNDKGEIVKGVCSNFLCDLKPGTEVQLTGPVGKEMLMPKDPNATVVMLATGTGIAPFRSFLWKMFFEKHEDYKFNGLAWLFLGVPTSSSLLYKEEFEKMKEKSPDNFRVDFAVSREQTNEKGEKMYIQTRMAQYAEELWELLKKDNTFVYMCGLKGMEKGIDDIMVSLAAKDGIDWIEYKRQLKKAEQWNVEVY

SEQ ID NO: 4412 - protein, 367 aa, Helianthus annuus
MAASVSAVVSLPSSKSTIVSTRTSSLISPERLTFTKVPHYKNVSTSGRLLSIRAQITTEAETEAPAKVEKISKKQEEGVVTNKYKPKEPYVGRCLLNTKITGDDAPGETWHMVFSTEGEIPYKEGQSIGVVPDGIDPKNGKPHKLRLYSIASSAIGDFGDSKTVSLCVKRLVYTNDQGVEVKGVCSNFLCDLKPGAEVQITGPVGKEMLMPKDPNATVIMLGTGTGIAPFRSFLWKMFFEKHEDYEFNGLAWLFLGVPTSSSLLYKEEFEKMKELKPDNFRLDFAVSREQTNDKGEKMYIQTRMAQYDRELWELLKKDNTFVYMCGLKGMEKGIDDIMATLAAEDGIEWATYKKQLKKEGQWNVEVY

SEQ ID NO: 4413 - protein, 364 aa, Chrysanthemum coronarium
MASSVSAVVSLSSSKTTAISTRSSFISQDRVSFAKGPSYKNVSSGKLLSIRAQVATDTDTPPAKVEKISKKQEEGVVVNKFRPKEPYIGRCLLNTKITGDDAPGETWHMVFSTEGEVPYKEGQSIGVIPDGIDPKNGKPHKLRLYSIASSALGDFGDSKTVSLCVKRLVYTNDQGVEVKGVCSNFLCDLKPGADVQITGPVGKEMLMPKDPNATVIMLATGTGIAPFRSFMWKMFFEKHEDYQFNGLAWLFLGVPTSSSLLYKEEFEKMKEIKPDNLRVDFAVSREQTNEKGEKMYIQTRMAQYDRELWELLKKDNTFVYMCGLKGMEKGIDDIMVSLAAEDGIDWVTYKKQLKKEGQWNVEVY

SEQ ID NO: 4414 - protein, 365 aa, Cichorium intybus
MASAVSAVVSLPSSKSAVVSTRTSLITQERVSFTKVPYYKNASSSVKSLSIRAQVTTEAEAPPAKVEKISKKQEDGVVTNKYRPKEPYVGRCLLNTKITGDDAPGETWHMVFTTEGEIPYREGQSIGVIPDGIDPKNGKPHKLRLYSIASSAIGDFGDSKTVSLCVKRLVYTNDAGEEVKGVCSNFLCDLKPGAEVQITGPVGKEMLMPKDPNATIIMLATGTGIAPFRSFMWKMFFEKHEDYKFNGLAWLFLGVPTSSSLLYKEEFEKMKEMKPDNLRVDFAVSREQTNEKGEKMYIQTRMAQYDRELWELLKKDNTFVYMCGLKGMEKGIDDIMGTLAAEDGIDWVTYKKQLKKEGQWNVEVY

SEQ ID NO: 4415 - protein, 364 aa, Flaveria ramosissima
MAAAVSAVVSLPSSKSTTISTRTSLISQERVSFTKVPCYKNVSTSGRLLSVRAQVTTEAEAPAKVEKVSKKQEEGVVTNKYRPKEPYTGRCLLNTKITGDDAPGETWHMVFSTEGEIPYKEGQSIGVIPDGIDPKSGKPHKLRLYSIASSAIGDFGDSKTVSLCVKRLVYTNDQGEEVKGVCSNFLCDLKPGAEVQITGPVGKEMLMPKDPNATIIMLATGTGIAPFRSFMWKMFFEKHEDYKFNGLAWLFLGVPTSSSLLYKEEFEKMKEMKPDNLRVDFAVSREQTNDKGEKMYIQTRMAQYDRELWELLKKDNTFVYMCGLKGMEKGIDDIMTTLAAEEGIDWVQYKKQLKKEGQWNVEVY

SEQ ID NO: 4416 - protein, 364 aa, Flaveria ramosissima
MASAVSAVVSLPSSKSTTISTRTSLISQERVSFTKVPYYKNVSTSGRLLSIRAQVTTEAEAPAKVEKVSKKQEEGVVTNKYRPKEPYIGRCLLNTKITGDDAPGETWHMVFSTEGEIPYKEGQSIGVIPDGIDPKTGKPHKLRLYSIASSAIGDFGDSKTVSLCVKRLVYTNDQGEEVKGVCSNFLCDLKPGAEVQITGPVGKEMLMPKDPNATIIMLATGTGIAPFRSFMWKMFFEKHEDYKFNGLAWLFLGVPTSSSLLYKEEFEKMKDMKPDNLRVDFAVSREQTNDKGEKMYIQTRMAQYDRELWELLKKENTFVYMCGLKGMEKGIDDIMTTLAAEEGIDWVQYKKQLKKEGQWNVEVY

SEQ ID NO: 4417 - protein, 264 aa, Manihot esculenta
MAATVNAAVSLPTTKSSSLPSRIANINPEKVSFSKGFLYSRNVYVVGRKVTIRAQVTTQAPAKVEKVSKKNEEGIVVNKFKPKNPYTGTCLLNTKITGDDAPGETWHMVFSTEGEVPYREGQSIGVIPDGIDKNGKPHKLRLYSIASSALGDFGNSKTVSLCVKRLVYTNEQGEIVKGVCSNFLCDLKPGAEVKITGPVGKEMLMPKDPNATIIMLGTGTGIAPFRSFLWKMFFEKHEDYKFNGLAWLFLGVPTSSSLLYKEAI

SEQ ID NO: 4418 - protein, 366 aa, Centaurea maculosa
MAASLSAVVSLSSSKSTAISTRSPSLVSQERVSFAKVPYYKNVSSSGKLFSIRAQVTTDVEAPPAKVEKISKKQEEGVVTNKYRPKEPYVGRCLLNTKITGDDAPGETWHMVFSTEGEIPYREGQSIGVIPDGIDPKNGKPHKLRLYSIASSAIGDFGDSKTVSLCVKRLVYTNDQGVEVKGVCSNFLCDLKPGAEVAMTGPVGKEMLMPKDPNATVIMLATGTGIAPFRSFMWKMFFEKHEDYQFNGLAWLFLGVPTSSSLLYKEEFEKMKEMKPDNLRVDFAVSREQTNDKGEKMYIQTRMAQYDKELWELLKKDNTFVYMCGLKGMEKGIDDIMVSLAAEDGIDWLQYKKQLKKEGQWNVEVY

SEQ ID NO: 4419 - protein, 367 aa, Cirsium arvense
MAASVSAVVSLSSSKSTAAISTRSSSLVSQERVSFAKVPYYKNVSSSGKLFSIRAQVTTDVEAPPAKVEKISKKQEEGVVTNKYRPKEPYVGRCLLNTKITGDDAPGETWHMVFSTEGEIPYREGQSIGVIPDGIDPKNGKPHKLRLYSIASSAIGDFGDSKTVSLCVKRLVYTNDQGVEVKGVCSNFLCDLKPGAEVAMTGPVGKEMLMPKDPNATVIMLATGTGIAPFRSFMWKMFFEKHEDYQFNGLAWLFLGVPTSSSLLYKEEFEKMKEMKPDNLRVDFAVSREQTNDKGEKMYIQTRMAQYDKELWELLKKDNTFVYMCGLKGMEKGIDDIMVSLAAEDGIDWLQYKKQLKKEGQWNVEVY

SEQ ID NO: 4420 - protein, 366 aa, Flaveria ramosissima
MAAAVSVVVSLPSSKSSAISSRTSLIPQDRVSFTKVPYYKSVSTNGKLLSIRAQITTEAETEAPAKVEKVSKKQEEGVVVNKYRPKEPYIGRCLLNTKITGDDAPGETWHMVFSTEGEIPYKEGQSIGVIPDGIDPKSGKPHKLRLYSIASSALGDFGDSKTVSLCVKRLVYTNDKGEEVKGVCSNFLCDLKPGAEVQITGPVGKEMLMPKDPNATIIMLATGTGIAPFRSFMWKMFFEKHEDYQFNGLAWLFLGVPTSSSLLYKEEFEKMKEMKPDNLRVDFAVSREQTNEKGEKMYIQTRMAQYDRELWELLKKDNTFVYMCGLKGMEKGIDDIMTTLAAEEGIDWIQYKKQLKKEGQWNVEVY

SEQ ID NO: 4421 - protein, 367 aa, Helianthus annuus
MAASVSAVVSLPSSKSTIVSTRTSSLISPERLTFTKVPHYKNVSTSGRLLSIRAQITTEAETEAPAKVEKISKKQEEGVVTNKYKPKEPYVGRCLLNTKITGDDAPGETWHMVFSTEGEIPYKEGQSIGVVPDGIDPKNGKPHKLRLYSIASSAIGDFGDSKTVSLCVKRLVYTNDQGVEVKGVCSNFLCDLKPGAEVQITGPVGKEMLMPKDPNATVIMLGTGTGIAPFRSFLWKMFFEKHDDYEFNGLAWLFLGVPTSSSLLYKEEFEKMKELKPDNFRLDFAVSREQTNDKGEKMYIQTRMAQYDRELWELLKKDNTFVYMCGLKGMEKGIDDIMATLAAEDGIEWATYKKQLKKEGQWNVEVY

SEQ ID NO: 4422 - protein, 366 aa, Cocos nucifera
MASAAVTAAVSLPSSKSSSLALPTSRTSISTTERLSLHKTCLHPRSVSTAGKLVSVRAQVTTETPAKVQKVSKKNDEGVVVNKYKPKDPYIGRCLLNTKITGDDAPGETWHMVFSTEGEVPYREGQSIGVIPDGVDKNGKPHKLRLYSIASSAIGDFGDSKTVSLCVKRLVYTNEQGEIVKGVCSNFLCDIKPGAEVKITGPVGKEMLMPKDPNATIIMLATGTGIAPFRSFLWKMFFEKHDDYKFNGLAWLFLGVPTSSSLLYKEEFEKMKEKAPNNFRVDFAVSREQTNEKGEKMYIQTRMAQYAEELWDLLKKDNTYVYMCGLKGMEKGIDDIMVSLAAKDGIDWLDYRRNLKRSEQWNVEVY

SEQ ID NO: 4423 - protein, 365 aa, Cleome spinosa
MASAISTAVSFPSSNSTSLSAKASFLSPDRIFLRKGTLCYRDACVGGRVVSVRAQVTTEVTEAPVKVEKESKKQEEGIVVNKFKPKNPYTGRCLLNVRLTGDDAPGETWHIVFSTEGEVPYREGQSIGVIPDGIDKNGKPHKLRLYSIASSAIGDFGDSKTVSLCVKRLVYTNENGELVKGVCSNFLCDLKPGAEAKITGPVGKEMLMPKDPNATVIMLATGTGIAPFRSFLWKKFFEEHEDYKFNGLAWLFLGVPTSSSLLYKEEFERMKEKNPENFRLDFAVSREQTNEKGEKMYIQTRMAQYADELWELLKKDNTFVYMCGLKGMEKGIDDIMVSLAARDGIDWLDYKKQLKKNEQWNVEVY

SEQ ID NO: 4424 - protein, 276 aa, Flaveria ramosissima
MASAVSAVVSVPSSKSTTISTRASLISQERVSFTKVPCYKNVSTSGRLSLIRAQVTTEAEAPAKVEKVSKKQEEGVVTNKYRPKEPYIGRCLLNTKITGDDAPGETWHMVFSTEGEIPYKEGQSIGVIPDGIDPKNGKPHKLRLYSIASSAIGDFGDSKTVSLCVKRLVYTNDQGEEVKGVCSNFLCDLKPGAEVQITGPVGKEMLMPKDPNATIIMLATGTGIAPFRSFMWKMFFEKHEDYKFNGLAWLFLGVPTSSSLLYKEEFEKMKEMSQIT

SEQ ID NO: 4425 - protein, 338 aa, Salvia sclarea
MAAAVSAAVSLPTNKSTSLSARTSIVSPERINFNKASLHYRNVSSKVAPIRAEVSTEAAPAPAKKEKHSKKQEEGVVVNKFRPKEPYIGKCLLNTKITGDDAPGETWHMLFSTEGEVPYREGQSIGIIPDGIDKNGKPHKLRLYSIASSALGDLGDSKTVSLCVKRLVYTNDQGEVVKGVCSNFLCDLTPGAEVKITGPVGKEMLLPKDPNATIIMLATGTGIAPFRSFLWKMFFEKHDDYKFNGLAWLFLGVPTSSSLLYKDEFSKMKSKNPDNFRVDYAVSREETNAKGEDVHPDTDGRVRGGAVGAAQEGQHLHLHVWAQGHGEGHRRHHGLVSC

SEQ ID NO: 4426 - protein, 362 aa, Trifolium pratense
MAAAVTAAVSFPYSNTTSLPIRTSIVAPDRLVFKKVSLNNVSISGRVGTIRAQVTTEAEAPAKVVKISKKQDEDIVVNKFKPKDPYTGMCLLNTKITGDDAPGETWHMVFTTEGEVPYREGQSIGIIPDGIDKNGKPHKLRLYSIASSALGDFGDSKTVSLCVKRLVYTNDAGEVVKGVCSNFLCDLKPGNEVKITGPVGKEMLMPKDPNATVIMLGTGTGIAPFRSFLWKMFFEKHDDYKFNGLAWLFLGVPTSSSLLYKEEFELMKEKAPENFRLDFAVSREQVNDKGEKMYIQTRMAQYAEELWELLKKDNTFVYMCGLKGMEKGIDDIMVSLAAKDGIDWIEYKRQLKKSEQWNVEVY

SEQ ID NO: 4427 - protein, 366 aa, Flaveria ramosissima
MGRCSKRCCLPSIFQIFCNFIKTSLFSQDRVSFTKVPYYKSVSTNGKLLSIRAQITTEAEAEAPAKVEKVSKKQEEGVVVNKYRPKEPYIGRCLLNTKITGDDAPGETWHMVFSTEGEIPYKEGQSIGVIPDGIDPKNGKPHKLRLYSIASSAIGDFGDSKTVSLCVKRLVYTNDKGEEVKGVCSNFLCDLKPGAEVQITGPVGKEMLMPKDPNATIIMLATGTGIAPFRSFMWKMFFEKHEDYQFNGLAWLFLGVPTSSSLLYKEEFEKMKEMKPDNLRVDFAVSREQTNEKGEKMYIQTRMAQYDRELWELLKKDNTFVYMCGLKGMEKGIDDIMTTLAAEEGIDWVQYKKQLKKEGQWNVEVY

SEQ ID NO: 4428 - protein, 366 aa, Centaurea maculosa
MAASVSAVVSLSSSKSTAISTRTSSLVSQERVSFAKVPYYKNVSSSGKLFSVRAQVTADVEAPPAKVEKISKKQEEGVVTNKYRPKEPYVGRCLLNTKITGDDAPGETWHMVFSTEGEIPYREGQSIGVIPDGIDPKNGKPHKLRLYSIASSAIGDFGDSKTVSLCVKRLVYTNDQGVEVKGVCSNFLCDLKPGAEVQMTGPVGKEMLMPKDPNATVIMLATGTGIAPFRSFMWKMFFEKHEDYQFNGLAWLFLGVPTSSSLLYKEEFEKMKEMKPDNLRVDFAVSREQTNDKGEKMYIQTRMAQYDKELWELLKKDNTFVYMCGLKGMEKGIDDIMVSLAAEDGIDWIQYKKQLKKEGQWNVEVY

SEQ ID NO: 4429 - protein, 366 aa, Flaveria ramosissima
MAAAVSVVVSLPSSKSSAISSRTSLFSQDRVSITKVPYYKSVSTNGKLLSIRAQITTEAEAEAPAKVEKVSKKQEEGVVVNKYRPKEPYIGRCLLNTKITGDDAPGETWHMVFSTEGEIPYKEGQSIGVIPDGIDPKNGKPHKLRLYSIASSAIGDFGDSKTVSLCVKRLVYTNDKGEEVKGVCSNFLCDLKPGAEVQITGPVGKEMLMPKDPNATIIMLATGTGIAPFRSFMWKMFFEKHEDYQFNGLAWLFLGVPTSSSLLYKEEFEKMKEMKPDNLRVDFAVSREQTNEKGEKMYIQTRMAQYDRELWELLKKDNTFVYMCGLKGMEKGIDDIMTTLAAEEGIDWVQYKKQLKKEGQWNVEVY

SEQ ID NO: 4430 - protein, 366 aa, Flaveria ramosissima
MAAAVSVVVSLPSSKSSAISSRTSLFSQDRVSLTKVPYYKSVSTNGKLLSIRAQITTEAETEAPAKVEKVSKKQEEGVVVNKYRPKEPYIGRCLLNTKITGDDAPGETWHMVFSTEGEIPYKEGQSIGVIPDGIDPKNGKPHKLRLYSIASSAIGDFGDSKTVSLCVKRLVYTNDKGEEVKGVCSNFLCDLKPGAEVQITGPVGKEMLMPKDPNATIIMLATGTGIAPFRSFMWKMFFEKHEDYQFNGLAWLFLGVPTSSSLLYKEEFEKMKEMKPDNLRVDFAVSREQTNEKGEKMYIQTRMAQYDRELWELLKKDNTFVYMCGLKGMEKGIDDIMTTLAAEEGIDWVQYKKQLKKEGQWNVEVY

SEQ ID NO: 4431 - protein, 366 aa, Flaveria ramosissima
MAAAVSVVVSLPSSKSSAISSRTSLFSQDRFSFTKVPYYKSVSTNGKLLSIKAQITTEAEAEAPAKVEKVSKKQEEGVVVNKYRPKEPYIGRCLLNTKITGDDAPGETWHMVFSTEGEIPYKEGQSIGVIPDGIDPKNGKPHKLRLYSIASSAIGDFGDSKTVSLCVKRLVYTNDKGEEVKGVCSNFLCDLKPGAEVQITGPVGKEMLMPKDPNATIIMLATGTGIAPFRSFMWKMFFEKHEDYQFNGLAWLFLGVPTSSSLLYKEEFEKMKEMKPDNLRVDFAVSREQTNEKGEKMYIQTRMAQYDRELWELLKKDNTFVYMCGLKGMEKGIDDIMTTLAAEEGIDWVQYKKQLKKEGQWNVEVY

SEQ ID NO: 4432 - protein, 366 aa, Flaveria ramosissima
MAAAVSVVVSLPSSKSTAISSRTSLFSQDRVSFTKVPYYKSVSTNGKLLSIRAQITTEAEAEAPVKVEKVSKKQEEGVVVNKYRPKEPYIGRCLLNTKITGDDAPGETWHMVFSTEGEIPYKEGQSIGVIPDGIDPKSGKPHKLRLYSIASSAIGDFGDSKTVSLCVKRLVYTNDKGEEVKGVCSNFLCDLKPGAEVQITGPVGKEMLMPKDPNATIIMLATGTGIAPFRSFMWKMFFEKHEDYQFNGLAWLFLGVPTSSSLLYKEEFEKMKEMKPDNLRVDFAVSREQTNEKGEKMYIQTRMAQYDRELWKLLKKDNTFVYMCGLKGMEKGIDDIMTTLAAEEGIDWVQYKKQLKKEGQWNVEVY

SEQ ID NO: 4433 - protein, 366 aa, Flaveria ramosissima
MAAAVSVVVSLPSSKSSAISSRTSLFSQDRVSFTKVPYNKSVSTNGKLLSIRAQITTEAEAEAPAKVEKVSKKQEEGVVVNKYRPKEPYIGRCLLNTKITGDDAPGETWHMVFSTEGEIPYKEGQSIGVIPDGIDPKNGKPHKLRLYSIASSAIGDFGDSKTVSLCVKRLVYTNDKGEEVKGVCSNFLCDLKPGAEVQITGPVGKEMLMPKDPNATIIMLATGTGIAPFRSFMWKMFFEKHEDYQFNGLAWLFLGVPTSSSLLYKEEFEKMKEMKPDNLRVDFAVSREQTNEKGEKMYIQTRMAQYDRELWELLKKDNTFVYMCGLKGMEKGIDDIMTTLAAEEGIDWVQYKKQLKKEGQWNVEVY

SEQ ID NO: 4434 - protein, 366 aa, Flaveria ramosissima
MAAAVSVVVSLPSSKSSAISSRTSLFSQDRFSFTKVPYNKSVSTNGKLLSIRAQITTEAEAEAPAKVEKVSKKQEEGVVVNKYRPKEPYIGRCLLNTKITGDDAPGETWHMVFSTEGEIPYKEGQSIGVIPDGIDPKNGKPHKLRLYSIASSAIGDFGDSKTVSLCVKRLVYTNDKGEEVKGVCSNFLCDLKPGAEVQITGPVGKEMLMPKDPNATIIMLATGTGIAPFRSFMWKMFFEKHEDYQFNGLAWLFLGVPTSSSLLYKEEFEKMKEMKPDNLRVDFAVSREQTNEKGEKMYIQTRMAQYDRELWELLKKDNTFVYMCGLKGMEKGIDDIMTTLAAEEGIDWVQYKKQLKKEGQWNVEVY

SEQ ID NO: 4435 - protein, 366 aa, Flaveria ramosissima
MAAAVSVVVSLPSSKSSAISSRTSLFSQDRFSFTKVPYNKSVSTNGKLLSIRAQITTEAEAEAPAKVEKVSKKQEEGVVVNKYRPKEPYIGRCLLNTKITGDDAPGETWHMVFSTEGEIPYKEGQSIGVIPDGIDPKNGKPHKLRLYSIASSAIGDFGDSKTVSLCVKRLVYTNDKGEEVKGVCSNFLCDLKPGAEVQITGPVGKEMLMPKDPNATIIMLATGTGIAPFRSFMWKMFFEKHEDYQFNGLAWLFLGVPTSSSLLYKEEFEKMKEMKPDNLRVDFAVSREQTNEKGEKMYIQTRMAQYDRELWELLKKDNTFVYMCGLKGMEKGIDDIMTTLAAEEGIDWIQYKKQLKKEGQWNVEVY

SEQ ID NO: 4436 - protein, 363 aa, Fragaria vesca
MAAAVTAAVSFPSSKSSTLPTRTSLICPERITLKKVYREASASGRVVSVRAQVTTTEAAPPAKAVKHSKKQEEGVVVNKYKPKNPYTGRVLLNTKITGDDAPGETWHMVFSTDGEMPYREGQSIGVIPDGIDPKNGKPHKLRLYSIASSALGDFGDSKTVSLCVKRLVYTNEAGETVKGVCSNFLCDLKPGGEVTMTGPVGKEMLMPKDPNATIVMLATGTGIAPFRSFLWKMFFEKHEDYKFEGLAWLFLGVPTSSSLLYKEEFEKMKEKAPDNFRLDFAVSREQTNEKGEKMYIQTRMAQYAEELWELLKKDNTYIYMCGLKGMEKGIDDIMVSLAAKDGIDWLDYKKQLKKAEQWNVEVY

SEQ ID NO: 4437 - protein, 309 aa, Nicotiana tabacum
AQVTTEAPAKVEKISKKQDEGVVVNKFRPKEPYVGRCLLNTKITGDDAPGETWHMVFSTEGEIPYREGQSIGVIADGVDANGKPHKLRLYSIASSALGDFGDSKTVSLCVKRLVYTNDKGEEVKGVCSNFLCDLKPGAEVNITGPVGKEMLMPKDPNATVVMLATGTGIAPFRSFLWKMFFEKHEDYKFNGLAWLFLGVPTSSSLLYKEEFEKMKEKAPENFRLDFAVSREQTNEKGEKMYIQTRMAQYAEELWGLLQKDNTFVYMCGLKGMESGIDDIMTSLAARDGIVWADYKKQLKKAEQWNVEVY

SEQ ID NO: 4438 - protein, 362 aa, Gossypium hirsutum
  Sequence also found in Organisms: Gossypium raimondii
MAMTVNAAVSLPSSKSSTLSFKNSVTVPERINFNKSVLYPKNVSLGGNVVSIRAQVTTEAPAKAPKISKKDDEGIVVNKFKPKEPYIGKCLLNTKITGDDAPGETWHMVFSTEGEVPYREGQSIGVIPDGIDKNGKPHKLRLYSIASSALGDFGNSQTVSLCVKRLVYTNEQGEIVKGVCSNFLCDLKPGAEVKITGPVGKEMLLPKDPNATIIMLATGTGIAPFRSFLWKMFFEKHDDYKFNGLAWLFLGVPTSSSLLYPEEFEKMKEKAPNNLRVDYAISREQTNEQGEKMYIQTRMAQYAEELWELLKKDNTYVYMCGLKGMEKGIDDIMTSLAAKDGIDWIEYKRQMKKGEQWNVEVY

SEQ ID NO: 4439 - protein, 362 aa, Eutrema halophilum
  Sequence also found in Organisms: Eutrema parvulum
MAAAISAAVSFPSSKSSTLPTKTSFVSHQRIFLNKSTLCYRDACIGGRVVSVKAQVTTEAPVKVEKESKKQEEGIVVNKFKPKNPYTGRCLLNTRITGDDAPGETWHIVFSTDGEVPYREGQSIGVIPEGIDKNGKPHKLRLYSIASSAIGDFGDSKTVSLCVKRLVYTNDNGELVKGVCSNFLCDLKPGDEAKITGPVGKEMLMPKDPNATVIMLGTGTGIAPFRSFLWKMFFEEHEDYKFNGLAWLFLGVPTSSSLLYKEEFEKMKEKNPENFRLDFAVSREQTNDKGEKMYIQTRMAEYAEELWELLKKDNTFVYMCGLKGMEKGIDEIMVSLAAKDGIDWLEYKKQLKRSEQWNVEVY

SEQ ID NO: 4440 - protein, 359 aa, Amaranthus tuberculatus
AVPFPTTKSSNLSTRTSSIISTDKISYKKVPLYHRNACGVGKVGAIRAQVTSDVAAPPAKVEKHSKKMEEGVVLNKYKPKEPYVGRCLLNTKITGDDAPGETWHMVFSHEGEVPYREGQSIGVIADGVDKNGKPHKLRLYSIASSALGDFGDSKTVSLCVKRLVYTNEAGEIVKGVCSNYLCDLKPGAEVKITGPVGKEMLMPKDPNATIIMLATGTGIAPFRSFLWKMFFEKHDDYKFNGLAWLFLGVPTSSSLLYKEEFEKMKEKAPENFRLDFAVSREQTNEKGEKMYIQTRMAQYDKELWELLKKDNTYVYMCGLKGMEKGIDDIMVPLAAAEGIDWIEYKRQLKKAEQWNVEVY

SEQ ID NO: 4441 - protein, 364 aa, Ambrosia trifida
MAASVSAVVSLPSSKATIVSTRTSLISQERVSFTKVPHYKNVSTSGRFLSIRAQITTEAEAPAKVEKISKKQEEGVVTNKYRPKEPYVGRCLLNTKITGDDAPGETWHMVFSTEGEIPYKEGQSIGVIPDGIDPKNGKPHKLRLYSIASSAIGDFGDSKTVSLCVKRLIYTNDQGVEVKGVCSNFLCDLKPGSEVQITGPVGKEMLMPKDPNATIIMLATGTGIAPFRSFLWKMFFEKHEDYEFNGLAWLFLGVPTGSSLLYKEEFEKMKDMKPDNFRLDFAVSREQTNEKGEKMYIQTRMAQYDRELWELLKKDNTYVYMCGLKGMEKGIDDIMVTLAAEDGIDWVTYKKQLKREGQWNVEVY

SEQ ID NO: 4442 - protein, 366 aa, Vicia sativa
MAAAVTAAVSLPYSNSTSLPIRTSIVAPERLVFKKVSLNNVSISGRVGTIRAQITTTTTETVAPVTKVVKHSKKQDEGIVVNKFKPKEPYVGRCLLNTKITGDDAPGETWHMVFTTEGAVPYREGQSIGIVPDGIDKNGKPHKLRLYSIASSAIGDFGDSKTVSLCVKRLVYTNDAGEVVKGVCSNFLCDLKPGSEVKITGPVGKEMLMPKDPNATVIMLGTGTGIAPFRSFLWKMFFEKHEDYKFNGLAWLFLGVPTSSSLLYKEEFEKMKEKAPENFRLDFAVSREQVNDKGEKMYIQTRMAQYAEELWELLKKDNTFVYMCGLKGMEKGIDDIMVSLAAKDGIDWIEYKRTLKKAEQWNVEVY

SEQ ID NO: 4443 - protein, 368 aa, Chenopodium quinoa
MAAAVTAAVSFPSTTKSSSLSSRTSSIISPDKISYKKVPLYYRNVSATGKVGPIRAQITSDVEAPPPAKVEKHSKKMEEGIVVNKYKPKNPYIGRCLLNTKITGDDAPGETWHMVFSHEGEIPYREGQSVGVIPDGEDKNGKPHKLRLYSIASSALGDFGDAKTVSLCVKRLIYTNDAGETVKGVCSNFLCDLKPGAEVKLTGPVGKEMLMPKDPNATIIMLGTGTGIAPFRSFLWKMFFEKHDDYKFNGLAWLFLGVPTSSSLLYKEEFEKMKEKAPDNFRLDFAVSREQTNENGEKMYIQTRMAQYANELWEMLKKDNTYVYMCGLKGMEKGIDDIMGSLAAAEGIDWLEYKRTLKKAEQWNVEVY

SEQ ID NO: 4444 - protein, 365 aa, Fagopyrum esculentum
MAAAVTAAVSFPCTTKSTNLSSRPSISPDKISYNYKKISLQYNRGNGSVGFIRAQITTDAPPPPVKVEKVSKKMEEGVVTNKFRPKEPYTGRCLLNTKITGDDAPGETWHMVFSTEGELPYREGQSVGVIPDGIDKNGKPHKVRLYSIASSALGDFGDSKTVSLCVKRLVYTNDQGEVVKGVCSNFLCDLKPGSEVKLTGPVGKEMLMPIDQNATIIMLATGTGIAPFRSFLWKMFFEKHEDYKFNGLAWLFLGVPTSSSLLYKEEFELMKEKSPENFRLDFAVSREQTNEKGEKMYIQTRMAQYANELWELLKKDNTFVYMCGLKGMEKGIDEIMAPLAAAEGIEWIDFKKQLKKQEQWNVEVY

SEQ ID NO: 4445 - protein, 190 aa, Flaveria ramosissima
MAAAVGVVVSLPSSKSSAFSSRTSLFSQDRVSFTKVPYYKSLSTNGKLLSIRAQITTEAATEAPAKLEKVSKKQEEGVVVNKYRPKEPYIGRCLLNTKITGDDAPGETWHMVFSTEGKIPYKEGQSIGVIPDGIDPKSGKPHKLRLYSIASSAIGDFGDSKTVSLCVKRLVYTNDKGEEVKGFVLTSCVT

SEQ ID NO: 4446 - protein, 366 aa, Flaveria ramosissima
MAAAVGVVVSLPSSKSSAISSRTSLFSQDRVSFTKVPYYKSLSTNGKLLSIRAQITTEAETEAPAKLEKLSKKQEEGVVVNKYRPKEPYTGRCLLNTKITGDDAPGETWHMVFSTEGKIPYKEGQSIGVIPDGIDPKSGKPHKLRLYSIASSAIGDFGDSKTVSLCVKRLVYTNDKGEEVKGVCSNFLCDLKPGAEVQITGPVGKEMLMPKDPNATIIMLATGTGIAPFRSFMWKMFFEKHEDYQFNGLAWLFLGVPTSSSLLYKEEFEKMKEMKPDNLRVDFAVSREQTNEKGEKMYIQTRMAQYDKELWELLKKDNTFVYMCGLKGMEQGIDDIMTTLAAEEGIDWTQYKKQLKKEGQWNVEVY

SEQ ID NO: 4447 - protein, 360 aa, Musa acuminata
MASAAVTAAVSLPSSKPSLSPASLERISFHKTCLHPRSTAAAKAGRLVTVRAQVTTEAPAKVAKVSKKDDEGVVTNKYKPKEPYIGRCLINTKITGDDAPGETNHIVFSTEGEIPYREGQSIGVIADGIDKNGKPHKLRLYSIASSAIGDFGDSKTVSLCVKRLVYTNEQGEIVKGVCSNFLCDLKPGAAVKITGPVGKEMLMPKDPNATVVMLATGTGIAPFRAFLWKMFFEKHENYKFNGLAWLFLGVPTSSSLLYKEEFEKMKELAPENFRLDFAVSREQTNEKGEKMYIQTRMAQYASELWELLKKDNTFVYMCGLKGMEKGIDDIMVSLAAKDGIDWLTYKRELKKAEQWNVEVY

SEQ ID NO: 4448 - protein, 364 aa, Allium cepa
MASSAAVTTAVSLPNSKSSSLVLSSRTSIASGINFNKTALYSRNVTTNNKSSSIRAQVTTETPTKAVKVSKKNDEGVITNTYKPKDPYVGRCLLNTKITGDDAPGETWHMVFSTEGKVQYREGQSIGVIADGVEKNGKPHKLRLYSIASSAIGDFGDSKTVSLCVKRLVYTNDQGEIVKGVCSNFLCDLQPGSEVKITGPVGKEMLMPKDPNATIIMLGTGTGIAPFRSFLWKMFFEKHDDYKFNGLAWLFLGVPTSSSLLYKEEFEKMKEIGKDNFRLDFAVSREQTNEKGEKMYIQTRMAQYAEELWELLKKDNTYVYMCGLKGMEKGIDDIMLSLAAKDGIDWLAYKKELKKAEQWNVEVY

SEQ ID NO: 4449 - protein, 343 aa, Vinca minor
TSIIFPERVNFNKVPLYYRSVSAGGKVVSIRAQVTTEAPATAKVEKVSKKNEEGVVVNKYKPKDPYIGRCLLNTKITGDDAPGETWHMVFSTEGEVPYREGQSIGVIPDGIDPKNGKPHKLRLYSIASSAIGDFGDSKTVSLCVKRLVYTNDKGELVKGVCSNFLCDLKPGAEAKITGPIGKEMLMPKDPNATIIMLATGTGIAPFRGFLWKMFFEKHDDYQFNGLGWLFLGVPTSSSLLYKEEFEKMKEKYPENFRLDFAVSREQTNEQGEKMYIQTRMAQYAEELWQLLKKDNTFVYMCGLKGMEKGIDDIMGSLAARDGIDWLDYKRQLKKAEQWNVEVY

SEQ ID NO: 4450 - protein, 364 aa, Papaver somniferum
MAAALTAAVSIPASNSSSLQTRTSISSSERISFNKSCLYSRNGCASRRVFSIKAEVTTDTTPPAKVEKISKKYEEGVVVNKFKPKNPFTGKVLLNTKITADDAPGETWHMVFHTDGEVPYREGQSIGIIPEGIDKNGKPHKLRLYSIASSALGDLGDSKTVSLCVKRLVYTNDQGEEVKGVCSNFLCDLQPGSEVKITGPVGKEMLMPKDPNATIIMLATGTGIAPFRSFLWKMFFEKHEDYKFNGLAWLFLGVPTSSSLLYQQEFQKMVEKAPENFRLDYAVSREQTNEKGEKMYIQTRMAQYAEELWELLKKDNTFIYMCGLKGMEKGIDDIMDSLAARDGIVWTDFKKSLKKAGQWNVEVY

SEQ ID NO: 4451 - protein, 266 aa, Castanea mollissima
MASAVNASVSLPSSTSSSLTTRTSTVYSERVSFSKNIFYSRNVYVGKKMVQIRAQVTTETPAKVQKVSKKDDEGVIVNKFKPKEPYIGKCLLNSKITADDAPGETWHMVFTTEGEVPYREGQSIGIIADGIDKNGKPHKLRLYSIASSALGDFGNSKTVSLCVKRLVYTNDKGEIVKGVCSNFLCDLKPGADVKITGPVGKEMLMPKDPNATVIMLATGTGIAPFRSFLWKMVFEKHENYKFNGLAWLFWVFQQLAHCSTRRSLRR

SEQ ID NO: 4452 - protein, 364 aa, Chrysanthemum coronarium
MASSVSAVVSLSSSKTTAISTRSSFISQERVSFAKVPSYKNVSSGKLLSIRAQVTTDTETPPAKVEKISKKQEEGVVTNTYKPKEPYVGRCLLNTKITGDDAPGETWHMVFTTEGLIKYKEGQSIGVIPDGIDPKNGKPHKLRLYSIASSAIGDFGDSQTVSLCVKRLVYTNDQGEEVKGVCSNFLCDLKPGCEVQITGPVGKEMLMPKDPNATVIMLATGTGIAPFRSFMWKMFFEKHEDYKFNGLAWLFLGVPTSSSLLYKEEFEKMKEMKPDNLRVDFAVSREQTNEKGEKMYIQTRMAQYDRELWELLKKDNTFVYMCGLKGMEKGIDDIMVSLAAEDGIDWITYKKQLKKEGQWNVEVY

SEQ ID NO: 4453 - protein, 369 aa, Musa acuminata
MASAAVTAAVGSLPSSKSSSLSKTPSISPATLERTSFHKACLYSRSVSTANARKKLVAVRAQVTTEAPAKVAKVSKKNDEGVVTNKYKPKEPYVGTCLLNTKITGDDAPGETWHMVFSTEGEVPYREGQSIGVIADGIDKNGKPHKLRLYSIASSALGDFGDAKTVSLCVKRLVYTNEQGEVVKGVCSNFLCDLKPGAEVKITGPVGKEMLMPKDPNATVIMLGTGTGIAPFRSFLWKMFFEKHDDYEFNGLAWLFLGVPTSSSLLYKEEFEKMKERAPDNFRVDYAVSREQANEKGEKMYIQTRMAEYAGELWELLKKDNTFVYMCGLKGMEKGIDDIMVSLAANDGIDWLSYKRELKRAEQWNVEVY

SEQ ID NO: 4454 - protein, 360 aa, Musa acuminata
MASAAVTAAVSLPSSKPSLSPASLERISFHKTCLHPRSTAAAKAGRLVTVRAQVTTEAPAKVAKVSKKDDEGVVTNKYKPKEPYIGRCLINTKITGDDAPGETNHIVFSTEGEIPYREGQSIGVIADGIDKNGKPHKLRLYSIASSAIGDFGDSKTVSLCVKRLVYTNEQGEIVKGVCSNFLCDLKPGAAVKITGPVGKEMLMPKDPNATVVMLGTGTGIAPFRAFLWKMFFEKHENYKFNGLAWLFLGVPTSSSLLYKEEFEKMKELAPENFRLDFAVSREQTNEKGEKMYIQTRMAQYASELWELLKKDNTFVYMCGLKGMEKGIDDIMVSLAAKDGIDWLTYKRELKKAEQWNVEVY

SEQ ID NO: 4455 - protein, 364 aa, Papaver somniferum
MAAALTAAVSIPASNSSSLQTRTSISSSERISFNKTCLYSRNGCASRRVFSIKAEVTTDTTPPAKVEKISKKYEEGVVVNKFKPKNPFTGKVLLNTKITADDAPGETWHMVFHTDGEVPYREGQSIGIIPEGIDKNGKPHKLRLYSIASSALGDLGDSKTVSLCVKRLVYTNDQGEEVKGVCSNFLCDLQPGSDVKITGPVGKEMLMPKDPNATIIMLATGTGIAPFRSFLWKMFFEKHEDYKFNGLAWLFLGVPTSSSLLYQQEFQKMTEKAPENFRLDYAVSREQTNEKGEKMYIQTRMAQYAEELWQLLKKDNTFIYMCGLKGMEKGIDDIMDSLAARDGIVWTDFKKSLKKAGQWNVEVY

SEQ ID NO: 4456 - protein, 362 aa, Quercus alba
MASAVNASVSLPSSSSSSLTTRASTIYSERVSFSKNIFYSRNVYVGKKMVQIRAQVTTATPAKVEKVSKKDDEGVVVNKFKPKDPYIGKCLLNSKITADDAPGETWHMVFTTEGEVPYREGQSIGVIPDGIDKNGKPHKLRLYSIASSALGDFGNSKTVSLCVKRLVYTNDKGEMVKGVCSNFLCDLKPGADVKITGPVGKEMLMPKDPNATVIMLATGTGIAPFRSFLWKMFFEKYENYKFNGLAWLFLGVPTTSSLLYKEEFAKMKEKAPENFRVDYAVSREQTNDKGEKMYIQTRMAQYAEELWELLKKDNTYVYMCGLKGMEKGIDDIMVSLAAKDGIDWLEYRRQLKKSEQWNVEVY

SEQ ID NO: 4457 - protein, 361 aa, Raphanus sativus
MAAAIGAAVSYPSSKSSSLPSKTSFVSPQRIFLNNKSRVCYREACIYRGRVKAQVSTETPVKVVKESKKQEEGIVVNKFKPKEPYTGRCLLNTRITGDDAPGETWHIVFSTEGEVPYREGQSIGVIPEGIDKNGKPHKLRLYSIASSAIGDFGDSKTVSLCVKRLVYTNESGELVKGVCSNFLCDLKPGDEAKITGPVGKEMLMPKDPNATIIMLGTGTGIAPFRSFLWKMFFEEHEDYKFNGLAWLFLGVPTSSSLLYKEEFEKMKEKNPENFRLDFAVSREQTNEKGEKMYIQTRMAEYAEELWELLKKDNTFVYMCGLKGMEKGIDEIMVSLAAKDGIDWLEYKKQLKKSEQWNVEVY

SEQ ID NO: 4458 - protein, 196 aa, Lippia dulcis
MAAAVSAAVSLPTSKSASLSARTSIISPERINFNKASLHYRNVSSKVAPIRAEVSTEAPPKKEKHSKKQEEGVVVNKFRPKDPYIGKCLLNTKITADDAPGETWHMLFSTEGEVPYREGQSIGIIPDGIDKNGKPHKLRLYSIASSAIGDLGDSKTVSLCVKRLIYTNDQGEIVKGVCSNFLCDLTPGAEVKILDL

SEQ ID NO: 4459 - protein, 358 aa, Helianthus annuus
CLPSIFQSTLISTRPSLVSQDRVSFTKVPYYKNVTTNGKPLSIRAQITTEAQAEATAKVEKVSKKQEEGVVTNKYKPKEPYIGRCLLNTKITGDDAPGETWHMVFSTEGEIPYREGQSIGVIPDGIDPKNGKPHKLRLYSIASSALGDFGDSKTVSLCVKRLVYTNDKGEEVKGVCSNFLCDLKPGAGVQITGPVGKEMLMPKDPNATVIMLATGTGIAPFRSFMWKMFFEKHEDYQFNGLAWLFLGVPTSSSLLYKEEFEKMKEMKPDNLRVDFAVSREQTNEKGEKMYIQTRMAQYDRELWELLKKDNTFVYMCGLKGMEKGIDDIMTTLAAEDGIEWATYKKQLKKEGQWNVEVY

SEQ ID NO: 4460 - protein, 348 aa, Amaranthus tuberculatus
PSSRTSSIISNDKISYKKVPLYHRNVCGVGKVGAIRAQVTSDVAAPPAKVEKHSKKMEEGVVLNKYKPKEPYVGRCLLNTKITGDDAPGETWHMVFSHEGEVPYREGQSIGVIADGVDKNGKPHKLRLYSIASSALGDFGDSKTVSLCVKRLVYTNEAGEIVKGVCSNYLCDLKPGAEVKITGPVGKEMLMPKDPNATIIMLATGTGIAPFRSFLWKMFFEKHDDYKFNGLAWLFLGVPTSSSLLYKEEFEKMKEKAPENFRLDFAVSREQTNEKGEKMYIQTRMAQYDKELWELLKKDNTYVYMCGLKGMEKGIDDIMVPLAAAEGIDWIEYKRQLKKAEQWNVEVY

SEQ ID NO: 4461 - protein, 362 aa, Ricinus communis
MAATVNAAVSLPTTKSSSSLPARISTTPERISFNKGFLYSRNVSFSGRTLTVKAQVTTEAPAKVVKESKKNDEGVTVNKFKPKNPYVGTCLLNTKITGDDAPGETWHMVFSTEGEIPYREGQSIGIIPDGIDKNGKPYKLRLYSIASSALGDFGDSKTVSLCVKRLVYTNEQGEIVKGVCSNFLCDLKPGAAVTMTGPVGKEMLMPKDPNATIIMLATGTGIAPFRSFLWKMFFEKHEDYKFNGLAWLFLGVPTSSSLLYPDEFQKMKEKAPENFRVDYAVSREQTNDKGDKMYIQTRMAQYAEELWELLKKDNTYVYMCGLKGMEKGIDDIMVNLAARDGIDWIEYKRQLKKSEQWNVEVY

SEQ ID NO: 4462 - protein, 362 aa, Brassica juncea
MAAAAIGAAVSYPSSKSSSLPSKTSFVSPQRIFLNNKSTLCYREACIYRGRVKAQVSTEAPVKVAKESKKQEEGITVNKFKPKEPYTGRCLLNTRITGDDAPGETWHIVFTTEGEVPYREGQSIGVIPEGIDKNGKPHKLRLYSIASSAIGDFGDSKTVSLCVKRLVYTNESGELVKGVCSNFLCDLKPGDEAKITGPVGKEMLMPKDPNATIIMLGTGTGIAPFRSFLWKMFFEEHEDYKFNGLAWLFLGVPTSSSLLYKEEFEKMKEKNPENFRLDFAVSREQTNEKGEKMYIQTRMAEYAEELWELLKKDNTFVYMCGLKGMEKGIDEIMVSLAAKDGIDWLEYKKQLKKSEQWNVEVY

SEQ ID NO: 4463 - protein, 369 aa, Papaver somniferum
MATSLTAAVSLPSSKSSSSSTSALSSRTSSIFSDRISFPKNSAYTGGISISNNAVTITSQVTTTEAAPVKVEKISKKDDEGIVVNKFKPKNPYIGRCLLNTKITGDDAPGETWHMVFTTEGEVPYREGQSIGIIPEGVDKNGKPHKLRLYSIASSAIGDFGDSKTVSLCVKRLVYTNDQGEEVKGVCSNFLCDLKPGSEVTITGPIGKEMLMPKDPNATIIMLGTGTGIAPFRSFLWKMFFEKHENYKFNGLAWLFLGVPTSSSLLYKEEFELMKEKAPENFRLDFAVSREQTNDKGEKMYIQTRMAQYAEELWELLKKDNTFVYMCGLKGMEKGIDDIMVSLAAKDGIDWLEYKRTLKKAEQWNVEVY

SEQ ID NO: 4464 - protein, 145 aa, Flaveria ramosissima
HFIQSPWPLQSALCLPSSYKSTTISTRTSLISTRRVSSRGGVYKMCLLVVVLLSIRAQVTTEAEAPAKVEKVSKKQEEGVVTNKYRPKEPYIGRCLLNTKITGDDAPGETWHMVFSTEGEIPYKEGQSIGVIPDGIDPKTESHTN

SEQ ID NO: 4465 - protein, 354 aa, Pteridium aquilinum
FSFYQRPPLFLLESRSSLQKDSPSRRFLFTTEMFPVEGEWFLSEPRLRPRLLAKKVVKESKKNEEGVVVNKFKPKNPYTGRCLLNTKITGDDAPGETWHMVFSTEGEVPYREGQSIGVIPDGIDKNGKPHKLRLYSIASSALGDFGDSKTVSLCVKRLVYTNENGELVKGVCSNFLCDMKPGSEVKITGPVGKEMLMPKDPNATIIMLATGTGIAPFRSFLWKMFFEKHDDYKFNGLAWLFLGVPTGSSLLYKEEFEKMKEKYPDNFRLDFAVSREQTNEKGEKMYIQTRMDQYSKELWELLKKDNTYVYMCGLKGMEKGIDDIMVSLAAEDGIDWTEYKRQLKKSEQWNVEVY

SEQ ID NO: 4466 - protein, 366 aa, Artemisia annua
MASSVSAVVSLSSANTAAISTRSSFISQERVSFAKVPSYKNVSSGKLLSIRAQVATDTDTPPAPAKVEKISKKQEEGVIINTYRPKEPYVGRCLLNTKITGDDAPGETWHMVFTTEGKIKYREGQSVGVIPDGIDPKNGKPHKLRLYSIASSALGDFGDSKTVSLCVKRLVYTNDQGEEVKGVCSNFLCDLKPGAEVQMTGPVGKEMLMPKDPNATVIMLATGTGIAPFRSFLWKMFFEKHEDYQFNGLAWLFLGVPTSSSLLYKEEFEYMKERKPDNLRVDFAVSREQTNEKGEKMYIQTRMAQYDRELWELLKKDNTFVYMCGLKGMEKGIDDIMVSLAAEDGIDWVTYKKQLKKEGQWNVEVY

SEQ ID NO: 4467 - protein, 358 aa, Musa acuminata
MATAAVTAAVSLPSSKSSALNRTPSVSPAARLQSRKVPAADARKLVSVRAQVTTEAPAKVAKVSKKDDEGVVTNKFKPKDPYTGTCLLNTKITGDDAPGETWHMVFSTEGEIPYREGQSIGVIPDGVDKNGKPHKLRLYSIASSALGDFGDSKTVSLCVKRLVYTNEQGEIVKGVCSNFLCDLKPGADVKITGPVGKEMLMPKDPNATIIMLATGTGIAPFRSFLWKMFFEKHHDYKFNGLAWLFLGVPTSSSLLYKEEFEKMKEKSPDNFRVDYAVSREQTNEKGEKMYIQTRMAEYAEELWQLLKKENTYVYMCGLKGMEKGIDDIMVSLAAKDGIDWLTYKRELKRAEQWNVEVY

SEQ ID NO: 4468 - protein, 363 aa, Sesamum indicum
MAAAVSAAVSLPSSKSTSLASRTSIISPERINFNKVPLYNRNVSLAGNKVVPIRAQVATEAPAKVEKEHKKQEEGVVVNVFKPKDPYIGRCLLNTKITGDDAPGETWHMVFSTEGKLPYREGQSIGVIADGEDKNGKPHKLRLYSIASSAIGDFGDSKTVSLCVKRLVYQNEQGETVKGVCSNFLCDLKPGDPVKITGPVGKEMLMPTDPNATIIMLATGTGIAPFRSFLWKMFFEKHDDYKFNGLAWLFLGVPTSSSLLYKEEFEKMKERHGDSFNLDFAISREQTNAQGDKMYIQTRMAEYKVELWDLFKKPNTFVYMCGLKGMEKGIDEIMIPIAAEEGIDWIEYKKRMKRDERWNVEVY

SEQ ID NO: 4469 - protein, 360 aa, Arabidopsis thaliana
MAAAISAAVSLPSSKSSSLLTKISSVSPQRIFLKKSTVCYRRVVSVKAQVTTDTTEAPPVKVVKESKKQEEGIVVNKFKPKNPYTGRCLLNTKITGDDAPGETWHIVFTTEGEVPYREGQSIGVIPEGIDKNGKPHKLRLYSIASSAIGDFGDSKTVSLCVKRLVYTNDGGEIVKGVCSNFLCDLKPGDEAKITGPVGKEMLMPKDPNATIIMLGTGTGIAPFRSFLWKMFFEEHEDYKFNGLAWLFLGVPTSSSLLYKEEFEKMKEKNPDNFRLDFAVSREQTNEKGEKMYIQTRMAEYAEELWELLKKDNTFVYMCGLKGMEKGIDDIMVSLAAKDGIDWLEYKKQLKRSEQWNVEVY

SEQ ID NO: 4470 - protein, 361 aa, Raphanus sativus
MAAAIGAAVSFPSSKSSSLHTKSSFVSPQRIFLNNKSTVCYREACIYGGRVKAQVTTETPVKVAKESKKQEEGIVVNKFKPKEPYTGRCLLNTRITGDDAPGETWHIVFSTEGEVPYREGQSIGVIPEGIDKNGKPHKLRLYSIASSAIGDFGDSKTVSLCVKRLVYTNESGELVKGVCSNFLCDLKPGDEAKITGPVGKEMLMPKDPNATIIMLGTGTGIAPFRSFLWKMFFEEHEDYKFNGLAWLFLGVPTSSSLLYKEEFEKMKEKNPENFRLDFAVSREQTNEKGEKMYIQTRMAEYAEELWELLKKDNTFVYMCGLKGMEKGIDEIMVSLAAKDGIDWLEYKKQLKKSEQWNVEVY

SEQ ID NO: 4471 - protein, 363 aa, Brassica juncea
MAAAAAIGAAVSYPSSKSSSLPSKTSFVSPQRIFLNNKSTLCYREACIYGGRVKAQVTTEAPVKVAKESKKQEEGIVVNKFKPKEPYTGRCLLNTRITGDDAPGETWHIVFTTEGEVPYREGQSIGIIPEGIDKNGKPHKLRLYSIASSAIGDFGDSKTVSLCVKRLVYTNESGELVKGVCSNFLCDLKPGDEAKITGPVGKEMLMPKDPNATIIMLGTGTGIAPFRSFLWKMFFEEHEDYKFNGLAWLFLGVPTSSSLLYKEEFEKMKEKNPENFRLDFAVSREQTNEKGEKMYIQTRMAEYAEELWELLKKDNTFVYMCGLKGMEKGIDEIMVSLAAKDGIDWLEYKKQLKKSEQWNVEVY

SEQ ID NO: 4472 - protein, 346 aa, Ricinus communis
MAAAVTAAVSFPSTKSTSLPSRTSIIAPERTTLKKVPVYYRDVVSAGKRVVSIRAQVTTEAEAPVKVKKESKKNEEGIVVNKFKPKNPYTGRCLLNTKITGDDAPGETWHMVFSTEGEVPYREGQSIGVIPDGIDKNGKPHKLRLYSIASSALGDFGDSKTVSLCVKRLVYTNDKGELVKGVCSNFLCDLKPGAEVQITGPVGKEMLMPKDPNATIVMLGTGTGIAPFRSFLWKMFFEKHEDYKFNGLAWLFLGVPTSSSLLYKEEFEKMKEIAPDNFRLDFAVSREQTNEKGEKMYIQTRMAQYAEELWELLKKDNTFVYMCGLKGMEKGIDDIMASLAAKEGKK

SEQ ID NO: 4473 - protein, 343 aa, Chenopodium quinoa
MAAAVTAAVSFPSTTKSSSLSSRTSSIISPDKICYKKVPLYYRNVSVTGKVGPIRAQITSDVEAPPPPPAKVEKHSKKMEEGIVVNKYKPKNPYIGRCLLNTKITGDDAPGETWHMVFSHEGEIPYREGQSVGVIPDGEDKNGKPHKLRLYSIASSALGDFGDAKTVSLCVKRLIYTNDAGETVKGVCSNFLCDLKPGAEVKLTGPVGKEMLMPKDPNATIIMLGTGTGIAPFRSFLWKMFFEKHDDYKFNGLAWLFLGVPTSSSLLYKEEFEKMKEKAPDNFRLDFAVSREQTNENGEKMYIQTRMAEYANELWEMLKKDNTYVYMCGLKGMERESMTLWFH

SEQ ID NO: 4474 - protein, 368 aa, Musa acuminata
MATAAVTAAVSLPCSKSSALNRTPSVSPVSLERISFQKAARLQSRKVPAPDARKLVSVRAQVTTEAPAKVVKVSKKDDEGVVTNKFKPKDPYTGTCLLNTKITGDDAPGETWHMVFSTEGEIPYREGQSIGVIPDGVDKNGKPHKLRLYSIASSALGDFGDSKTVSLCVKRLVYTNEQGEIVKGVCSNFLCDLKPGADVKITGPVGKEMLMPKDPNATIIMLATGTGIAPFRSFLWKMFFEKHHDYKFNGLAWLFLGVPTSSSLLYKEEFEKMKEKSPDNFRVDYAVSREQTNEKGEKMYIQTRMAEYAEELWQLLKKENTYVYMCGLKGMEKGIDDIMVSLAAKDGIDWLTYKRELKRAEQWNVEVY

SEQ ID NO: 4475 - protein, 349 aa, Trifolium pratense
SNTTSLPIRTSVVAPDRLVFKKVSLNNVSISGRVGTIRAQVTTQAEAPAKVVKISKKQDEDIVVNKFKPKEPYIGRCLLNTKITGDDAPGETWHMVFTTEGEVPYREGQSIGIIPDGIDKNGKPHKLRLYSIASSALGDFGDSKTVSLCVKRLVYTNDAGEVVKGVCSNFLCDLKPGSEVKITGPIGKEMLMPKDPNATVIMLGTGTGIAPFRSFLWKMFFEKHEDYKFNGLAWLFLGVPTSSSLLYKEEFEKMKEKAPENFRLDFAVSREQVNDKGEKMYIQTRMAQYAEELWELLKKDNTFVYMCGLKGMEKGIDDIMVSLAAKDGIDWVEYKRQLKKSEQWNVEVY

SEQ ID NO: 4476 - protein, 365 aa, Brassica juncea
MAAAAAIGAAVSYPSSKSSSLPSKTSFVSPQRIFLNNNNKSTLCYREACIYGGRVKAQVTTEAPVKVAKESKKQEEGIVVNKFKPKEPYTGRCLLNTRITGDDAPGETWHIVFTTEGEVPYREGQSIGVIPEGIDKNGKPHKLRLYSIASSAIGDFGDSKTVSLCVKRLVYTNESGELVKGVCSNFLCDLKPGDEAKITGPVGKEMLMPKDPNATIIMLGTGTGIAPFRSFLWKMFFEEHEDYKFNGLAWLFLGVPTSSSLLYKEEFEKMKEKNPENFRLDFAVSREQTNDKGEKMYIQTRMAEYAEELWELLKKDNTFVYMCGLKGMEKGIDEIMVSLAAKDGIDWFEYKKQLKKSEQWNVEVY

SEQ ID NO: 4477 - protein, 329 aa, Fagus grandifolia
ASAVNAAVSFPSSTSSSLPTRTSTVYSERISFSKNVFYSRNVYVGRKLFHIRAQVTQAPAKVEKVSKKDDEGVVVNKFKPKEPFIGKCLLNSKITADDAPGETWHMVFTTEGEVPYREGQSIGIIPDGIDKNGKPHKLRLYSIASSALGDFGNSKTVSLCVKRLVYTNDQGEEVKGVCSNFLCDLKPGADVKITGPIGKEMLMPKDPNATVIMLATGTGIAPFRSFLWKMFFEKHESYKFNGLAWLFLGVPTSSSLLYKDEFGKMKEKAPENFRVDYAVSREQKMTRVRRCTSKPEWHNMQRSYGSYSKKITPMYICVGSREWRRGLMT

SEQ ID NO: 4478 - protein, 234 aa, Theobroma cacao
MALTVNAAVSLPSSKSSSLSFKSSITISERMNFNKSVWYSRNVSAGGNVVSIKAQVTTEAPAKVVKVSKKDDEGVVVNKFKPKNPYIGKCLLNTKITGDDAPGETWHMVFSTEGEVPYREGQSIGVTPEGIDKNGKPHKLRLYSIASSALGDFGTSQTVSLCVKRLVYTNEQGEIVKGVCSNFLCDLKPGADGTITGTCWERDAYAKRSKCHHHKACNWNWNCSFPFILMEDVL

SEQ ID NO: 4479 - protein, 363 aa, Brassica rapa
MAAAAAIGAAVSYPSSKSSSLPSKTSFVSPQRIFLNNKSTLCYREACVYGGRVKAQVSTEAPVKVAKESKKQEEGIVVNKFKPKEPYTGRCLLNTRITGDDAPGETWHIVFTTEGEVPYREGQSIGIIPEGIDKNGKPHKLRLYSIASSAIGDFGDSKTVSLCVKRLVYTNESGEVVKGVCSNFLCDLKPGDEAKITGPVGKEMLMPKDPNATIIMLGTGTGIAPFRSFLWKMFFEEHEDYKFNGLAWLFLGVPTSSSLLYKEEFEKMKEKNPENFRLDFAVSREQTNDKGEKMYIQTRMAEYAEELWELLKKDNTFVYMCGLKGMEKGIDEIMVSLAAKDGIDWFEYKKQLKKSEQWNVEVY

SEQ ID NO: 4480 - protein, 362 aa, Brassica napus
MAAAAIGAAVSYPSSKSSSLPSKTSFVSPQRIFLNNKSTLCYREACVYGGRVKAQVSTEAPVKVAKESKKQEEGIVVNKFKPKEPYTGRCLLNTRITGDDAPGETWHIVFTTEGEVPYREGQSIGIIPEGIDKNGKPHKLRLYSIASSAIGDFGDSKTVSLCVKRLVYTNESGEVVKGVCSNFLCDLKPGDEAKITGPVGKEMLMPKDPNATIIMLGTGTGIAPFRSFLWKMFFEEHEDYKFNGLAWLFLGVPTSSSLLYKEEFEKMKEKNPENFRLDFAVSREQTNDKGEKMYIQTRMAEYAEELWELLKKDNTFVYMCGLKGMEKGIDEIMVSLAAKDGIDWFEYKKQLKKSEQWNVEVY

SEQ ID NO: 4481 - protein, 974 aa, Cajanus cajan
MPVRQMKDSSEQHLVIKPHLQNPMNPAKKTTKAAQNGKDPPPQENHNQTLSHAKNKGRRRGRGGRKPDQGDVMMRPSCRPCTAPLTSRANGNVENGCITDTGFPTSSKSLNFARRPGYGQVGTKCIVKANHFFAELPDKDLNQYDVTITPEVSSRTVNRSIIAELVRLYKESDLGMRLPAYDGRKSLYTAGQLPFAWREFKIKLVDEEDGVNGPKREREYRVVIKFVARANLHHLGQFLAGKRADAPQEALQILDIVLRELSTKRYCPIGRSFFSHDIRTPQRLGEGLQSWCGFYQSIRPTQMGLSLNIDMASAAFIEPLPVVEFVGQLLGKDVLSRPLSDADRIKIKKALRGVKVEVTHRGSVRRKYRVSGLTSQPTRELVFPVDENSTMKSVVEYFQEMYGFTIQYTHLPCLQVGNQKKANYLPMEACKIVEGQRYTKRLNEKQITALLKVTCQRPRDRENDILRTIQHNAYDQDPYAKEFGIKISEKLASVEARILPAPWLKYHESGKEKNCLPQVGQWNMMNKKMINGMTVSRWACINFSRSVQDSVARTFCNELSQMCQVSGMEFNPEPVIPIYNAKPEQVGKALKHVYHVSASKTKGKELELLLAILPDNNGSLYGDLKRICETDLGLISQCCLTKHVFKITKQYLANVSLKINVKMGGRNTVLLDAVSCRIPLVSDIPTIIFGADVTHPENGEDSSPSIAAVVASQDWPEVTKYAGLVCAQAHRQELIQDLYKTWHDPVRGTVSGGMIRDLLVSFRKATGQKPLRIIFYRDGVSEGQFYQVLLYELDAIRKACASLEPNYQPPVTFIVVQKRHHTRLFANNYRDRSSTDRSGNILPGTVVDSKICHPTEFDFYLCSHAGIQGTSRPAHYHVLWDENNFTADGIQSLTNNLCYTYARCTRSVSVVPPAYYAHLAAFRARFYMEPDMQENGSNGDGNGHSSKGTRVAGDYSVKPLPDLKENVKRVMFYC

SEQ ID NO: 4482 - protein, 974 aa, Glycine max
MPVRQMKESSEQHLVIKPHLQNPMNQAKKTTKAAQNGKGPPPQENHNQTLPNSKNKGRRRGRGGRKSDQGDVMMRPSCRPCTAPLTSSANGNAENGCISDTGFPTSSKSLTFARRPGYGQVGTKCIVKANHFFAELPDKDLNQYDVTITPEVSSRTVNRSIIAELVRLYKESDLGMRLPAYDGRKSLYTAGQLPFAWREFKIKLVDEEDGVNGPKREREYRVVIKFVARANLYHLGQFLAGKRADAPQEALQILDIVLRELSTKRYCPIGRSFFSPDIRTPQRLGEGLESWCGFYQSIRPTQMGLSLNIDMASAAFIEPLPVVEFVGQLLGKDVLSRPLSDADRIKIKKALRGVKVEVTHRGSVRRKYRVSGLTSQPTRELVFPVDENSTMKSVVEYFQEMYGFTIQYTHLPCLQVGNQKKANYLPMEACKIVEGQRYTKRLNEKQITALLKVTCQRPRDRENDILRTVQHNAYDQDPYAKEFGIKISEKLASVEARILPAPWLKYHESGKEKNCLPQVGQWNMMNKKMINGMTVSRWACINFSRSVQDSVARTFCNELAQMCQVSGMEFNPEPVIPIYNAKPEQVEKALKHVYHVAGSKTKAKELELLLAILPDNNGSLYGDLKRICETDLGLISQCCLTKHVFKITKQYLANVSLKINVKMGGRNTVLLDAVSCRIPLVSDIPTIIFGADVTHPENGEDSSPSIAAVVASQDWPEVTKYAGLVCAQAHRQELIQDLYKTWQDPVRGTVSGGMIRDLLVSFRKATGQKPLRIIFYRDGVSEGQFYQVLLYELDAIRKACASLEPNYQPPVTFIVVQKRHHTRLFANNYRDRSSTDRSGNILPGTVVDSKICHPTEFDFYLCSHAGIQGTSRPAHYHVLWDENNFTADGIQSLTNNLCYTYARCTRSVSVVPPAYYAHLAAFRARFYMEPDMQDNGSAGDGNGYGAKATRAAGDYSVKPLPDLKENVKRVMFYC

SEQ ID NO: 4483 - protein, 974 aa, Glycine max
MPVRQMKESSEQHLVIKPHLQNPMNQAKKTTKAAQNGKGPPPQENHNQTSPHSKNKGRRRGRGGRKPDQGDVMMRPSCRPCTATLTSTANENAENGCISDMGFPTSSKSLTFAPRPGYGQVGTKCIVKANHFFAELPDKDLNQYDVTITPEVSSRTVNRSIIAELVRLYKESDLGMRLPAYDGRKSLYTAGQLPFAWREFKIKLIDEEDGVNGPKREREYRVVIKFVARANLYHLGQFLAGRRADAPQEALQILDIVLRELSTKRYCPIGRSFFSPDIRTPQRLGEGLESWCGFYQSIRPTQMGLSLNIDMASAAFIEPLPVVEFVGQLLAKDVLSRPLSDADRIKIKKALRGVKVEVTHRGSVRRKYRVSGLTSQPTRELVFPVDENSTMKSVVEYFQEMYGFTIQYTHLPCLQVGNQKKANYLPMEACKIVEGQRYTKRLNEKQITALLKVTCQRPRDRENDILRTVQHNAYDQDPYAKEFGIKISEKLASVEARILPAPWLKYHESGKEKNCLPQVGQWNMMNKKMINGMTVSRWACINFSRSVQDSVARTFCNELAQMCQVSGMEFNPESVIPIYNAKPEQVEKALKHVYHVSGSKIKGKELELLLAILPDNNGSLYGDLKRICETDLGLISQCCLTKHVFKITKQYLANVSLKINVKMGGRNTVLLDAVSSRIPLVSDMPTIIFGADVTHPENGEELSPSIAAVVASQDWPEVTKYAGLVCAQAHRQELIQDLYKTWQDPVRGTVSGGMIRDLLVSFRKATGQKPLRIIFYRDGVSEGQFYQVLLYELDAIRKACASLEPNYQPPVTFIVVQKRHHTRLFANNYRDRSSTDRSGNILPGTVVDTKICHPTEFDFYLCSHAGIQGTSRPAHYHVLWDENNFTPDGIQSLTNNLCYTYARCTRSVSVVPPAYYAHLAAFRARFYMEPDMQDNGSAGDGNGHGAKATRAAGDYSVKPLPDLKENVKRVMFYC

SEQ ID NO: 4484 - protein, 982 aa, Lotus japonicus
MPLRQMKEGSEQHLVIKPHLQNQNPMCTPAKKVPKATTQNGQGPSPPQENHSQTSPHPRNKGRRRGRGGRKCDQGDVLMRPSCRPCTATSSSANGNVQNGYTSGNVDMGFPTSSKSLSFARRPGFGQVGTKCIVKANHFFAELPDKDLNQYDVTITPEVSSRAVNRSIIAELVRLYKESDLGMRLPAYDGRKSLYTAGQLPFAWREFKIKLVDEQDRVNVPKREREYNVVIKFVARANLHHLGQFLAGKRADAPQEALQILDIVLRELSNKRYCPIGRSFFSPDIRTPQRLGEGLESWCGFYQSIRPTQMGLSLNIDMASAAFIEPLPVVEFVGQLLAKDVLSRPLSDADRIKIKKALRGVKVEVTHRGSVRRKYRVSGLTSQPTRELVFPVDENSTMKSVVEYFQEMYGFTIQYAHLPCLQVGNQKKANYLPMEACKIVEGQRYTKRLNEKQITSLLKVTCQRPRDRENDILQTVQHNAYDQDPYAKEFGLNISEKLASVEARILPAPWLKYHESGKEKNCLPQVGQWNMMNKKMINGMTVNRWACINFSRSVQDSVARTFCNELAQMCQVSGMEFNPEPVIPIYNAKPEQVVKALKHVYHVSSNKTKGKELELLLAILPDNNGSLYGDLKRICETDLGLISQCCLTKHVFKITKQYLANVSLKINVKMGGRNTVLLDALSCRIPLVSDIPTIIFGADVTHPENGEDSSPSIAAVVASQDWPEVTKYAGLVCAQAHRQELIQDLYKTWQDPVRGTVSGGMIRDLLVSFRKATGQKPLRIIFYRDGVSEGQFYQVLLYELDAIRKACASLEPNYQPPVTFIVVQKRHHTRLFPNNHKDRSSTDKSGNIMPGTVVDSKICHPTEFDFYLCSHAGIQGTSRPAHYHVLWDENNFTADGIQSLTNNLCYTYARCTRSVSVVPPAYYAHLAAFRARFYMEPDMQENGSSGDGNTSNSSKGTRVAGECGVKPLPALKENVKRVMFYC

SEQ ID NO: 4485 - protein, 976 aa, Cicer arietinum
MPVRQMKESLEQHIVIKPHLQNPMNTSNNSPNASQNFKGPPQQPSLENHSQTSPQPRNKGRRRGRGGRKSDQGDILMRPSSRPCTTTNGNVENGYISSEKDVGFPTSSKSLSFARRPGYGQVGTKCIVKANHFFAELPDKDLNQYDVTITPEVSSRTVNRSIIAELVRLYKESDLGTRLPAYDGRKSLYTAGQLPFSWKEFKIKLVDEEDGINCTKRVKEYVVVIKFVARANLHHLGQFLAGKRADAPQEALQILDIVLRELSTKRYCSIGRSFFSPDIRRPQRLGEGLESWCGFYQSIRPTQMGLSLNIDMASAAFIEPLPVVEFVGQLLGKDVLSRPLSDADRIKIKKGLRGVKVEVTHRGSVRRKYRVSGLTSQPTRELVFPVDENSTMKSVVEYFQEMYGFTIQYTHLPCLQVGNQKKANYLPMEACKIVEGQRYTKRLNEKQITSLLKVTCQRPRDRENDILQTVQHNAYDQDPYAKEFGINISEKLASVEARILPAPWLKYHESGKEKNCLPHVGQWNMMNKKMINGMTVNRWACINFSRSVQDSVARTFCNDLAQMCQVSGMEFNLEPVIPIYNAKPEQVEKALKHVYHVSTNKTKGKELELLLAILPDNNGSLYGDLKRICETDLGLISQCCLTKHVFKITKQYLANVSLKINVKMGGRNTVLLDAVCYRIPLVSDIPTIIFGADVTHPENGEDSSPSIAAVVASQDWPEVTKYAGLVCAQAHRQELIQDLYKTWHDPVRGTVSGGMIRDLLISFRKATGQKPLRIIFYRDGVSEGQFYQVLLYELDAIRKACASLEPNYQPPVTFIVVQKRHHTRLFPNNHRDRSSTDKSGNILPGTVVDSKICHPTEFDFYLCSHAGIQGTSRPAHYHVLWDENNFTADGIQSLTNNLCYTYARCTRSVSVVPPAYYAHLAAFRARFYMEPDMQENGSNGDGNSSHSSKGTRTTGECGVKPLPALKDNVKRVMFYC

SEQ ID NO: 4486 - protein, 974 aa, Cicer arietinum
MPLRQMKESSEQHLVIKPNLQNPMNQAKKVTRAVQNGKGPPPLTQEPHNQTSPQARTGGRRRSRVGGRKSDQGDVLMRPSCRPCTVVKNTENGNTVSSDVEMSFPTSSKSLSFAPRPGYGQVGTKCIVKANHFFAELPDKDLNQYDVTITPEVLSKAVNRSIIAELVRLYKESDLGMRLPAYDGRKSLYTAGVLPFSWREFKIKLIEEEDAINGPKREREYKVVIKFVARANLHHLGQFLAGKRADAPQEAIQILDIVLRELASKRFCPIGRSFFSPDIRAPQRLGEGLESWCGFYQSIRPTQMGLSLNIDMASAAFIEPLPVVEFVGQLLGKDVLSRQLSDADRIKIKKALRGVKVEVTHRGSVRRKYRVSGLTSQPTRELVFPVDENSTMKSVVEYFQEMYGFTIKHTHLPCLQVGGNQKKANYLPMEACKIVEGQRYTKRLNEKQITSLLKVTCQRPRDRENDILRTIQHNAYDQDPYAKEFGIKVSEKLATVEARILPAPWLKYHESGKEKNCLPQVGQWNMMNKKMINGMNVSRWACINFSRSVQDSVARTFCNELAQMCQVSGMEFNLDPVIPIYNAKPEQVEKALKHVYHVSSNKIKGKELELLLAILPDNNGSLYGDLKRICETDLGLISQCCLTKHVFKITKQYLANVSLKINVKMGGRNTVLVDAVSCRIPLVSDIPTIIFGADVTHPENGEDSSPSIAAVVASQDWPEVTKYAGLVCAQPQRQELIQDLYKTWHDPVRGVVSGGMIRDLLVSFRKATGQKPLRIIFYRDGVSEGQFYQVLLYELDAIRKACASLEPNYQPPVTFIVVQKRHHTRLFANNHRDRNSTDRSGNILPGTVVDTKICHPTEFDFYLCSHAGIQGTSRPAHYHVLWDENNFTADGIQSLTNNLCYTYARCTRSVSVVPPAYYAHLAAFRARFYTEPDLQETGSNGGGRGSKTTRAAGDCGVKPLPALKENVKRVMFYC

SEQ ID NO: 4487 - protein, 972 aa, Phaseolus vulgaris
MPVRQMRESSEQHLVIKPHLQNPMNGAKKVSRAVQNGKGPPPPPLPQEPHNQTSPHARNKGRRRSRGGRKCDQGDVLMRPIVTSGFGNGSTMCGEIEMGYPTSSKSLSFAPRPGYGQVGIKCIVKANHFFAELPDKDLNQYDVSITPEVSSKAVNRSIIAELVRLYKESDLGMRLPAYDGRKSLYTAGPLPFSWREFKIKVVDDEAGVNGPKREREYRVVIKFVARANLHHLGQFLAGKRADAPQEALQILDIVLRELSSKRFCPIGRSFFSPDIRTPQRLGEGLESWCGFYQSIRPTQMGLSLNIDMASAAFIEPLPVVEYVGQLLGKDILSRQLSDADRIKIKKALRGVKVEVTHRGSVRRKYRVSGLTSQPTRELVFPVDENSTMKSVVEYFQEMYGFTIKYTHLPCLQVGNQKKANYLPMEACKIVEGQRYTKRLNEKQITALLKVTCQRPRDRENDILRTIQHNAYDQDPYAKEFGIKISEKLASVEARILPAPWLKYHESGKEKNCLPQVGQWNMMNKKMINGMTVSRWACINFSRSVQDTVALTFCTELAQMCQVSGMEFNPEPVIPIYNAKPEHVEKALKHVYHVSTNKTKGKELELLLAVLPDNNGSLYGDLKRICETDLGLISQCCLTKHVFKITKQYLANVSLKINVKMGGRNTVLVDAVSCRIPLVSDIPTIIFGADVTHPENGEDSSPSIAAVVASQDWPEVTKYAGLVCAQAHRQELIQDLYKMWHDPVRGLVSGGMIRDLLISFRKATGQKPLRIIFYRDGVSEGQFYQVLLYELDAIRKACASLEPNYQPPVTFIVVQKRHHTRLFANNHRDRNSTDKSGNILPGTVVDSKICHPTEFDFYLCSHAGIQGTSRPAHYHVLWDENNFTADGIQSLTNNLCYTYARCTRSVSVVPPAYYAHLAAFRARFYMEPEMQENGSSGGGGGGGSKATRAGGECGVVKPLPALKENVKRVMFYC

SEQ ID NO: 4488 - protein, 669 aa, Cajanus cajan
MGLSLNIDMASAAFIEPLPVVEYVGQLLGKDILARQLSDADRIKIKKALRGVKFEVTHRGSVRRKYRVSGLTSQPTRELMFPVDENSTMKSVVEYFQEMYGFTIKYTHLPCLQVGNQKKANYLPMEACKIVEGQRYTKRLNEKQITALLKVTCQRPRDRENDILRTIQHNAYDQDPYAKEFGIKISEKLASVEARILPAPWLKYHESGKEKNCLPQVGQWNMMNKKMINGMTVSWWACINFSRSVQDSVARTFCTELAQMCQVSGMEFNPEPIIPIYNAKPEHVEKALKHVYHVSTNKTKGKELELLLAILPDNNGSLYGDLKRICETDLGLISQCCLTKHVFKITKQYLANVSLKINVKMGGRNTVLVDAVSCRIPLVSDIPTIIFGADVTHPENGEESSPSIAAVVASQDWPEVTKYAGLVCAQAHRQELIQDLYKMWHDPVRGLVSGGMIRDLLISFRKATGQKPLRIIFYRDGVSEGQFYQVLLYELDAIRKACASLEPNYQPPVTFIVVQKRHHTRLFANNHRDRNSTDKSGNILPGTVVDSKICHPTEFDFYLCSHAGIQGTSRPAHYHVLWDENNFTADGIQSLTNNLCYTYARCTRSVSVVPPAYYAHLAAFRARFYMEPDLQENGSTGGGGSKAKPAGGECGVKPLPALKENVKRVMFYC

SEQ ID NO: 4489 - protein, 978 aa, Medicago truncatula
MPVMQLKESSEQHIVIKTNLQNPKNTPKASSQNGKAPPPTSIQNNNQTSPPQPRNKGRRRGRGGRKSDQGEILTRPSSRPCTEITSAINGNVENGYNSGDIDVGFPTSSKSMNFTRRPGFGQVGTKCIVKANHFFAELPDKDLNQYDVTITPEVSSRTVNRSIIAELVRLYKESDLGMRLPAYDGRKSLYTAGQLPFSWKDFTIKLVDEEDAVNCPKRVKEYRVVIKFVARANLHHLGQFLAGKRADAPQEALQILDIVLRELSTKRYCPIGRSFFSPDIRRPQRLGEGLESWCGFYQSIRPTQMGLSLNIDMASAAFIEPLPVVEFVGQLLGKDVLSRPLSDADRIKIKKGLRGVKVEVTHRGSVRRKYRVSGLTSQPTRELVFPVDENSTMKSVVEYFQEMYGFTIQYTHLPCLQVGNQKKANYLPMEACKIVEGQRYTKRLNEKQITSLLKVTCQRPRDRENDILQTVQHNAYDQDPYAKEFGINISEKLASVEARILPTPWLKYHESGKEKNCLPHVGQWNMMNKKMINGMTVNRWACINFSRSVQDSVARTFCNDLAQMCQVSGMEFNLEPVIPIYNAKPEQVEKALKHVYHVSTNKTKGKELELLLAILPDSNGSLYGDLKRICETDLGIISQCCLTKHVFKITKQYLANVSLKINVKMGGRNTVLLDAASYRIPLVSDIPTIIFGADVTHPENGEDSSPSIAAVVASQDWPEVTKYAGLVCAQAHRQELIQDLYKTWHDPARGTVSGGMIRDLLISFRKATGQKPLRIIFYRDGVSEGQFYQVLLYELDAIRKACASLEPNYQPPVTFIVVQKRHHTRLFPNNHRDRSSTDKSGNILPGTVVDTKICHPTEFDFYLCSHAGIQGTSRPAHYHVLWDENNFTADGIQSLTNNLCYTYARCTRSVSIVPPAYYAHLAAFRARFYMEPEMQENGSTGDGNSSHSSKGTTRAAGECGVKPLPALKDNVKRVMFYC

SEQ ID NO: 4490 - protein, 979 aa, Medicago truncatula
MPLRQMKESSEQHLVIKPHQQNSMSQAKKVTKAVQNGKGPPLVSQEQQNQTSPPQVKSGGRRRSRNGRKSDQVDVLMRPSCRPCTVVKSNENGHVVENGNTVSSDVEMSFPTSSKSLSFAQRPGYGQAGTKCIVKANHFFAELPDKDLNQYDVTITPEVSSKAVNRSIIAELVRLYKESDLGMRLPAYDGRKSLYTAGVLPFSWREFKIKLIEEEDGINGPKREREYKVVIKFVARANLHHLGQFLAGKRADAPQEAIQILDIVLRELASKRFCPIGRSFYSPDIRAPQRLGEGLESWCGFYQSIRPTQMGLSLNIDMASAAFIEPLPVVEFVGQLLGKDVLSRQLSDADRIKIKKSLRGVKVEVTHRGSVRRKYRVSGITSQPTRELVFPVDENSTMKSVVEYFQEMYGFTIKHTHLPCLQVGGNQKKANYLPMEACKIVEGQRYTKRLNEKQITSLLKVTCQRPRDRENDILRTVQHNAYDQDPYAKEFGIKVSEKLASVEARILPAPWLKYHESGKEKNCLPQVGQWNMMNKKMINGMTVSRWACINFSRGVQDSVARTFCNELAQMCQVSGMEFNLEPVIPIYNAKPEQVEKALKHVYHVSSNKTKGKELELLLVILPDNNGSLYGDLKRICETDLGLISQCCLTKHVFKITKQYLANVSLKINVKMGGRNTVLVDAVSCRIPLVSDIPTIIFGADVTHPENGEDSSPSIAAVVASQDWPEVTKYAGLVCAQPQRQELIQDLYKTWHDPVRGVVSGGMIRDLLVSFRRATGQKPQRIIFYRDGVSEGQFYQVLLYELDAIRKACASLEPNYQPPVTFIVVQKRHHTRLFANNHRDRNSTDRSGNILPGTVVDTKICHPTEFDFYLCSHAGIQGTSRPAHYHVLWDENNFTADGIQSLTNNLCYTYARCTRSVSVVPPAYYAHLAAFRARFYTEPDLQETGSTGGRGSKTTRAAGDCGVKPLPALKENVKRVMFYC

SEQ ID NO: 4491 - protein, 972 aa, Glycine max
MPVRQMRESSEQHLVIKPHLQNPMNGAKKVPRAVQNGKGPPPPPLPQQELPHNQTSPHVRNKGRRRSRGGGRKCDQGDVLMRPIVASGVENGSTMCGEIEMSCPTSSKSLSFAPRPGYGQVGTKCIVKANHFFAELPDKDLNQYDVSITPEVSSKAVNRSIIAELVRLYKESDLGMRLPAYDGRKSLYTAGPLPFSWREFKIKVVDDEDRVNGPKRERDYRVVIKFVARANLHHLGQFLAGKCAEAPQEALQILDIVLRELSSKRFCPIGRSFFSPDIRTPQRLGEGLESWCGFYQSIRPTQMGLSLNIDMASAAFIEPLPVVEYVGQLLGKDILSRQLSDADRIKIKKALRGVKVEVTHRGSVRRKYRVSGLTCQPTRELVFPVDENSTMKSVVEYFQEMYGFTIKYTHLPCLQVGNQKKANYLPMEACKIVEGQRYTKRLNEKQITALLKVTCQRPRDRENDILQTIQHNAYGQDPYAKEFGIKISEKLASVEARILPAPWLKYHESGKEKNCLPQVGQWNMMNKKMINGMTVSQWACINFSRSVQDSVARTFCTELAQMCQVSGMEFNPEPVIPIYNAKPEHVEKALKHVYHASTNKTKGKELELLLAILPDNNGSLYGDLKRICETDLGLISQCCLTKHVFKITKQYLANVSLKINVKMGGRNTVLVDAVSCRIPLVSDIPTIIFGADVTHPENGEDSSPSIAAVVASQDWPEVTKYAGLVCAQAHRQELIQDLYKMWHDPVRGLVSGGMIRDLLISFRKATGQKPLRIIFYRDGVSEGQFYQVLLYELDAIRKACASLEPNYQPPVTFIVVQKRHHTRLFANNHRDRNSTDKSGNILPGTVVDSKICHPTEFDFYLCSHAGIQGTSRPAHYHVLWDENNFTADGIQSLTNNLCYTYARCTRSVSVVPPAYYAHLAAFRARFYMEPDLQQENGSSGGGSKATRAGGVCGGVKPLPALKENVKRVMFYC

SEQ ID NO: 4492 - protein, 992 aa, Citrus clementina
MPIRQMKDSSEQHLVIKTHLQNTMNQSQKQPKTAQNGKGPPHQELQNSKPHNQTSPPTKNRGRRRGRGGRKSDQNDVFMRPSSRPCTVAHKPVNQVCDLVGSNANGAVGNGRSLCATEMGFPTSSKSLSFAPRPGYGQVGTKCIVKANHFFAELPDKDLNQYDVTITPEVASRTVNRAIMAELVRLYKESDLGMRLPAYDGRKSLYTAGELPFVWKEFKIKLVDELDGINGPKRVREYKVVIKFAARANMHHLGQFLAGKRADAPQEALQILDIVLRELSTKRYCPIGRSFFSPSIRTPQRLGDGLESWCGFYQSIRPTQMGLSLNIDMASAAFIEPLPVIEFVAQLLGKDVLSRTLSDSDRVKIKKALRGVKVEVTHRGTVRRKYRVSGLTSQPTRELVFPVDDNSTMKSVVEYFQEMYGFTIQHTHLPCLQVGNQKKANYLPMEACKIVEGQRYTKRLNERQITALLKVTCQRPRDRENDILQTVQQNAYDQDLYAKEFGIKISEKLASVEARILPAPWLKYHENGKEKDCLPQVGQWNMMNKKMINGMTVSRWACINFSRSVQESVARGFCNELAQMCQVSGMEFNPEPVIPIHNARPDQVEKALKHVYHLSMSKTKGKELELLLAILPDNNGSLYGDLKRICETDLGIISQCCLTKHVFKISKQYLANVSLKINVKMGGRNTVLLDAISCRIPLVSDIPTIIFGADVTHPENGEDSSPSIAAVVASQDWPEVTKYAGLVCAQAHRQELIQDLYKTWHDPVRGTVSGGMIRDLLISFRKATGQKPLRIIFYRDGVSEGQFYQVLLYELDAIRKACASLEPNYQPPVTFIIVQKRHHTRLFANNHRDRSSTDRSGNILPGTVVDSKICHPTEFDFYLCSHAGIQGTSRPAHYHVLWDENNFTADGIQSLTNNLCYTYARCTRSVSVVPPAYYAHLAAFRARFYMEPDMQENGSTDGSGHTSTKSTRAVGESGVRPLPALKENVKRVMFYC

SEQ ID NO: 4493 - protein, 992 aa, Citrus sinensis
MPIRQMKDSSEQHLVIKTHLQNTMNQSQKQPKTAQNGKGPPHQELQNSKPHNQTSPPTKNRGRRRGRGGRKSDQNDVFMRPSSRPCTVAHKPVNQVCDLVGSNANGAVGNGRSLCATEMGFPTSSKSLSFAPRPGYGQVGTKCIVKANHFFAELPDKDLNQYDVTITPEVASRTVNRAIMAELVRLYKESDLGMRLPAYDGRKSLYTAGELPFVWKEFKIKLVDELDGINGPKRVREYKVVIKFAARANMHHLGQFLAGKRADAPQEALQILDIVLRELSTKRYCPIGRSFFSPSIRTPQRLGDGLESWCGFYQSIRPTQMGLSLNIDMASAAFIEPLPVIEFVAQLLGKDVLSRTLSDSDRVKIKKALRGVKVEVTHRGTVRRKYRVSGLTSQPTRELVFPVDDNSTMKSVVEYFQEMYGFTIQHTHLPCLQVGNQKKANYLPMEACKIVEGQRYTKRLNERQITALLKVTCQRPRDRENDILQTVQQNAYDQDLYAKEFGIKISEKLASVEARILPAPWLKYHENGKEKDCLPQVGQWNMMNKKMINGMTVSRWACINFSRSVQESVARGFCNELAQMCQVSGMEFNPEPVIPIHNARPDQVEKALKHVYHSSMSKTKGKELELLLAILPDNNGSLYGDLKRICETDLGIISQCCLTKHVFKISKQYLANVSLKINVKMGGRNTVLLDAISCRIPLVSDIPTIIFGADVTHPENGEDSSPSIAAVVASQDWPEVTKYAGLVCAQAHRQELIQDLYKTWHDPVRGTVSGGMIRDLLISFRKATGQKPLRIIFYRDGVSEGQFYQVLLYELDAIRKACASLEPNYQPPVTFIIVQKRHHTRLFANNHRDRSSTDRSGNILPGTVVDSKICHPTEFDFYLCSHAGIQGTSRPAHYHVLWDENNFTADGIQSLTNNLCYTYARCTRSVSVVPPAYYAHLAAFRARFYMEPDMQENGSTDGSGHTSTKSTRAVGESGVRPLPALKENVKRVMFYC

SEQ ID NO: 4494 - protein, 993 aa, Manihot esculenta
MPIRQMKESSEQHLVIKTHLQNTMNHPQKHPKTSQNGKGPPPQETHNSKTQNQTLPPAKNRGRRRGRGGRKSDQGDAGMRPSSRPCTLAHKPVNPAGDLLASAPNGSIGNAGSTCEIEMGLGFPTSSKSLSYAARPGYGQMGTKCVVKANHFFAELPDKDLNQYDVTITPEVASRTTNRAIMAELVRLYKESDLGMRLPAYDGRKSLYTAGQLPFAWKEFTIKLVDEEDGINGPKREREYKVVIKFVARANMHHLGQFLAGKRADAPQEALQILDIVLRELSTKRYCPIGRSFFSPDIRAPQRLGDGLESWCGFYQSIRPTQMGLSLNIDMASAAFIEPLPVIEFVAQLLGKDVLSRPLSDSDRIKIKKALRGVKVEVTHRGHVRRKYRVSGLTSQPTRELVFPVDDNSTMKSVVEYFQEMYGFTIQHSHLPCLQVGNQKKANYLPMEACKIVEGQRYTKRLNERQITALLKVTCQRPRDRENDILQTVQHNAYDQDPYAKEFGIKISEKLASVEARILPAPWLKYHETGREKDCLPQVGQWNMMNKKMINGMTVSRWACINFSRSVQESVARGFCNELAQMCQVSGMEFNPEPVIPIYNARPDQVEKALKHVYHSSMSKTKGKELELLLAILPDNNGSLYGDLKRICETDLGLISQCCLTKHVFKISKQYLANVSLKINVKMGGRNTVLLDAISCRIPLVSDIPTIIFGADVTHPENGEDSSPSIAAVVASQDWPEVTKYAGLVCAQAHRQELIQDLYKTWQDPVRGTVSGGMIRDLLVSFRKATGQKPLRIIFYRDGVSEGQFYQVLLYELDAIRKACASLEPNYQPPVTFIVVQKRHHTRLFANNHRDRSSTDKSGNILPGTVVDSKICHPTEFDFYLCSHAGIQGTSRPAHYHVLWDENNFTADGIQSLTNNLCYTYARCTRSVSVVPPAYYAHLAAFRARFYMEPEMQENGSSGVGSGHGSKGTRVGESGVRPLPALKENVKRVMFYC

SEQ ID NO: 4495 - protein, 990 aa, Prunus mume
MPIRKMKESSEQHLVIKTHLQNPVNPVQKQPKTAQNGKGPPPQEPHNPKTHNQISPPTKNRGRRRGRGGRKSDQGDVCMRPSSRHCTVAHIPASPSFASPPVASTPNGYVENGGNSCSMEMGFPTSSKSLSFARRPGFGQVGIKCIVKANHFFAELPEKDLNHYDVCITPEVASRSVNRAIMAELVRLYKESDLGMRLPAYDGRKSLYTAGELPFAWKEFNIKLVDEPDGINGRKRERDYKVVIKFVARANMHHLGQFLAGKCADAPQEALQILDIVLRELSNKRYCPIGRSFFSPDIRTPQRLGEGLESWCGFYQSIRPTQMGLSLNIDMASAAFIEPLPVIEFVAQLLGKDVLSRTLSDSDRVKIKKALRGVKVEVTHRGSVRRKYRVSGLTSQPTRELVFPVDENLTMKSVIEYFQEMYGFTIQQGHLPCLQVGNQKKANYLPMEACKIVEGQRYTKRLNEKQITALLKVTCQRPRDRENDILQTVQHNAYDQDPYAKEFGIKISEKLASVEARILPAPWLKYHETGKEKNCLPQVGQWNMMNKKMINGMTVSRWACINFSRSVQESVARGFCNELAQMCQVSGMEFNPEPVIPIYNARPEQVEKALKHVYHASMNKTKGKDLELLLAILPDNNGSLYGDIKRICETDLGLISQCCLTKHVFKISKQYLANVSLKINVKMGGRNTVLLDAISCRIPLVSDIPTIIFGADVTHPENGEDSSPSIAAVVASQDWPEVTKYAGLVCAQAHRQELIQDLYKTWQDPVRGTVSGGMIRDLLVSFRKATGQKPLRIIFYRDGVSEGQFYQVLLYELDAIRKACASLEPNYQPPVTFIVVQKRHHTRLFANNHRDRSSIDKSGNILPGTVVDTKICHPTEFDFYLCSHAGIQGTSRPAHYHVLWDENNFTADGIQSLTNNLCYTYARCTRSVSVVPPAYYAHLAAFRARFYMEPDMQENGSTGHTAKGTRAAGETGVRPLPALKENVKRVMFYC

SEQ ID NO: 4496 - protein, 987 aa, Manihot esculenta
MPIRQMKESSEQHLVIKTHLQNTMNQPQKHHKTPQNGKGPPSQETHSKSQTSPPTKNRGRRRNRGGRKSDQGDVCMRPSSRPCTVAHKPVNPAGNPLARAPNGNAGNICEMEMGLGFPTSSKSLSFAPRPGYGQLGTKCIVKANHFFAELPDKDLNHYDVTITPEVASRAKNRAIMAELVRLYKESDLGRRLPAYDGRKSLYTAGELPFAWKEFVIKLVDEEDGINGPKREREYKVVIKFVARANMHHLGQFLAGKRADAPQEALQILDIVLRELSTKRYCPIGRSFFSPDIRAPQRLGDGLESWCGFYQSIRPTQMGLSLNIDMASAAFIEPLPVIEFVAQLLGKDVLSRPLCDSDRIKIKKALRGVKVEVTHRGNIRRKYRVSGLTSQPTRELVFPVDDNSTMKSVVEYFQEMYGFTIQHTHLPCLQVGNQKKANYLPMEACKIVEGQRYTKRLNERQITALLKVTCQRPRDRENDILQTVQHNAYDHDPFAKEFGIKISEKLASVEARILPAPWLKYHETGKEKDCLPQVGQWNMMNKKMINGMTVSRWSCINFSRSVQESVARGFCNELAQMCQVSGMEFNPEPVIPIYNARPDQVEKALKHVYHASMNKTKGKELELLLAILPDNNGSLYGDLKRICETDLGLISQCCLTKHVFKISKQYLANVSLKINVKMGGRNTVLLDAISCRIPLVSDIPTIIFGADVTHPENGEDSSPSIAAVVASQDWPEVTKYAGLVCAQAHRQELIQDLYKTWQDPVRGTVSGGMIRDLLVSFRKATGQKPLRIIFYRDGVSEGQFYQVLLYELDAIRKACASLEPNYQPPVTFIVVQKRHHTRLFANNHRDRSSIDKSGNILPGTVVDSKICHPTEFDFYLCSHAGIQGTSRPAHYHVLWDENNFTADGIQSLTNNLCYTYARCTRSVSVVPPAYYAHLAAFRARFYTEPEMQENGSSGGGSGYGTKGARAGETGVRPLPALKENVKRVMFYC

SEQ ID NO: 4497 - protein, 990 aa, Prunus persica
MPIRKMKESSEQHLVIKTHLQNPVNPVQKQPKTAQNGKGPPPQEPHNPKTHNQISPPTKNRGRRRGRGGRKSDQGDVCMRPSSRHCTVAHIPASPSFASPPVASTPNGYVENGGNSCSMEMGFPTSSKSLSFARRPGFGQVGIKCIVKANHFFAELPEKDLNHYDVCITPEVASRSVNRAIMAELVRLYRESDLGMRLPAYDGRKSLYTAGELPFAWKEFNIKLVDEPDGINGRKRERDYKVVIKFVARANMHHLGQFLAGKCADAPQEALQILDIVLRELSNKRYCPIGRSFFSPDIRTPQRLGEGLESWCGFYQSIRPTQMGLSLNIDMASAAFIEPLPVIEFVAQLLGKDVLSRTLSDSDRVKIKKALRGVKVEVTHRGSVRRKYRVSGLTSQPTRELVFPVDENLTMKSVIEYFQEMYGFTIQQGHLPCLQVGNQKKANYLPMEACKIVEGQRYTKRLNEKQITALLKVTCQRPRDRENDILQTVQHNAYDQDPYAKEFGIKISEKLASVEARILPAPWLKYHETGKEKNCLPQVGQWNMMNKKMINGMTVSRWACINFSRSVQESVARGFCNELAQMCQVSGMEFNPEPVIPIYNARPEQVEKALKHVYHASMNKTKGKDLELLLAILPDNNGSLYGDIKRICETDLGLISQCCLTKHVFKISKQYLANVSLKINVKMGGRNTVLLDAISCRIPLVSDIPTIIFGADVTHPENGEDSSPSIAAVVASQDWPEVTKYAGLVCAQAHRQELIQDLYKTWQDPVRGTVSGGMIRDLLVSFRKATGQKPLRIIFYRDGVSEGQFYQVLLYELDAIRKACASLEPNYQPPVTFIVVQKRHHTRLFANNHRDRSSIDKSGNILPGTVVDTKICHPTEFDFYLCSHAGIQGTSRPAHYHVLWDENNFTADGIQSLTNNLCYTYARCTRSVSVVPPAYYAHLAAFRARFYMEPDMQENGSTGHTAKGTRAAGETGVRPLPALKENVKRVMFYC

SEQ ID NO: 4498 - protein, 980 aa, Gossypium hirsutum
MPIRQMKESSEQHLVIKSHLQNTMNTVQRPPKTAQNGKGPPQAHEPHNNTKQPHNQATSPPSKNRGRRRGRGGKKSDQLDVCMRPSSRPCTVAHKPVNQASCGMEMGFPTSSKSLNFAPRPGYGQVGTKCIVKANHFFAQLPDKDLNQYDVTITPEVASRTVNRAIIAELVRLYKESDLGTRLPAYDGRKSLYTAGELPFAWKEFVVKLVDEEDGINGPKREREYKVVIKFVARANMHHLGQFLAGKRADAPQEALQILDIVLRELSSKRYCPIGRSFFSPDIRAPQRLGDGLESWCGFYQSIRPTQMGLSLNIDMASAAFIEPLPVIEFVAQLLGKDVLSRPLSDSDRVKIKKALRGVKVEVTHRGNVRRKYRVSGLTSQPTRELVFPVDDNSTMKSVVEYFQEMYSFTIQHTHLPCLQVGNQKKANYLPMEACKIVEGQRYTKRLNERQITALLKVTCQRPRDRENDILQTVQHNAYDQDPYAKEFGIKISEKLASVEARILPAPWLKYHETGKEKDCLPQVGQWNMMNKKMINGMTVSRWACINFSRSVQESVARGFCNELAQMCQVSGMEFNPEPVIPIYSARPEQVEKALKHVYHASMKTKGKELELLLAILPDNNGSLYGDLKRICETDLGLISQCCLTKHVFKISKQYLANVALKINVKMGGRNTVLLDAISCRIPLVSDIPTIIFGADVTHPENGEDSSPSIAAVVASQDWPEVTKYAGLVCAQAHRQELIQDLYKTWHDPVRGTVSGGMIRDLLISFRKATGQKPLRIIFYRDGVSEGQFYQVLLYELDAIRKACASLEPNYQPLVTFIVVQKRHHTRLFANNHRDRSSTDKSGNILPGTVVDSKICHPSEFDFYLCSHAGIQGTSRPAHYHVLWDENNFTADGIQSLTNNLCYTYARCTRSVSVVPPAYYAHLAAFRARFYLEPEMQDNNSSTGAGSGQAKGGGTKAAGESGVRPLPALKENVKRVMFYC

SEQ ID NO: 4499 - protein, 995 aa, Vitis vinifera
MPMRQMKESSEQHLVIKTHLQNSMNPVQKPPKTAQNGKGPPSHEPQNAKPHSQTSPSSKNRGRRRGRGGRKSDQSDVFMRPSSRPCTVADKPVLAHQAGPLVTDIPHGCVENGGNMCEMEMGFPSSSKSLTFAPRPGYGQLGTKCIVKANHFFTELPEKDLNQYDVTITPEVSSRTVNRAIMNELVKLYKESDLGMRLPAYDGRKSLYTAGELPFAWKEFKVKLVDEEDGINGPKREREYKVVIKFVARANLHHLGQFLAGKRADAPQEALQILDIVLRELSTRRYCPVGRSFFSPDIRAPQRLGEGLESWCGFYQSIRPTQMGLSLNIDMSSAAFIEALPVIEFVGQLLGKDVLSRPLSDSDRVKIKKALRGVKVEVTHRGNVRRKYRVSGLTSQPTRELVFPVDDNSTMKSVVEYFQEMYGFTIQHAHLPCLQVGNQKKANYLPLEACKIVEGQRYTKRLNERQITALLKVTCQRPRDQENDILQTVQHNAYDQDPYAKEFGIKISEKLASVEARILPAPWLKYHETGKEKDCLPQVGQWNMMNKKMINGMTVSRWACINFSRSVQESVARGFCNELAQMCQVSGMEFNPEPVIPIYMARPDQVEKALKHVYHASMNKLKGKELELLLAILPDNNGSLYGDLKRICETDLGLISQCCLTKHVFKISKQYLANVSLKINVKMGGRNTVLLDAISCRIPLVSDIPTIIFGADVTHPENGEDSSPSIAAVVASQDWPEVTKYAGLVCAQAHRQELIQDLYKTWHDPVRGTVSGGMIRDLLVSFRKATGQKPLRIIFYRDGVSEGQFYQVLLYELDAIRKACASLEPNYQPPVTFIVVQKRHHTRLFANNHRDRNSTDRSGNILPGTVVDSKICHPTEFDFYLCSHAGIQGTSRPAHYHVLWDENNFTADGIQSLTNNLCYTYARCTRSVSVVPPAYYAHLAAFRARFYMEPDMQENGSNGGGGGGHAAKATRASGETGVRPLPALKENVKRVMFYC

SEQ ID NO: 4500 - protein, 475 aa, Glycine max
MPVRQMREGSEQHIVIKPHLQNPMNGAKKVPRAVQNGKGSPPPPLSQQELPHNQTSPHARNKGRRRSRGGGRKCDQGDVLMRPIVTSGVENGSTMCGEKEMSYPTSSKSLSFAPRPGYGQVGTKCIVKANHFFAELPDKDLNQYDVSITPEVSSKTVNRSIIAELVRLYKESDLGMRLPAYDGRKSMYTAGPLPFSWREFKIKVVDDEDGVNGSKREREYRVVIKFVARANLHHLGQFLAGKRADAPQETLQILDIVLRELSSKRFCPIGRSFFSPDIRTPQRLGEGLESWCGFYQSIRPTQMGLSLNIDMASAAFIEPLPVVEYVDQLLGKDILSRQLSDADRIKIKKALRGVKVEVTHRGSVRRKYRVSGLTSQPTRELVFPVDENSTMKSVVEYFQEMYGFTIKYTHLPCLQVGNQKKANYLPMEACKIVEGQRYTKRLNEKQITALLKVTCQRPRDRENDILQVFCWFLTD

SEQ ID NO: 4501 - protein, 986 aa, Ricinus communis
MPIRQMKESSEQHLVLKTHLQNTMNQPQKHHKIAQNGKGPPQSQETHNSKPQNQTSPPTKNRGRRRGRGGRKSDQGDVFTRPSSRPCTVVHKPVNQAGGLLANAPNGNSGNICEMEMGLGFPTSSKSLTYARRPGYGQLGTKCIVKANHFFAELLDKDLNQYDVTITPEVASRTTNRAIMAELVRLYKESDLGMRLPAYDGRKSLYTSGELPFAWKEFIIKLVDEDDGVNGPKREREYKVVIKFVARANMHHLGQFLAGKRADAPQEALQILDIVLRELSTRRYCPVGRSFFSPDIRAPQRLGDGLESWCGFYQSIRPTQMGLSLNIDMASAAFIEPLPVIELVAQLLGKDVLSRPLSDADRIKIKKALRGVKVEVTHRGNVRRKYRVSGLTSQPTRELVFPVDDNSTMKSVVEYFQEMYGFTIQHTHLPCLQVGNQKKANYLPMEACKIVEGQRYTKRLNERQITALLKVTCQRPRDRENDILQTVQHNAYDQDPYAKEFGIKISEKLASVEARILPAPWLKYHDTGKEKDCLPQVGQWNMMNKKMINGMTVSRWACINFSRSVQESVARGFCSELAQMCQVSGMEFNPEPVIPIYSARPEQVEKALKHVYHASMNKTKGKELELLLAILPDNNGTLYGDLKRICETDLGLISQCCLTKHVFKISKQYLANVSLKINVKMGGRNTVLLDAISCRIPLVSDIPTIIFGADVTHPENGEDSSPSIAAVVASQDWPEVTKYAGLVCAQAHRQELIQDLYKTWQDPVRGTVSGGMIRDLLVSFRKATGQKPLRIIFYRDGVSEGQFYQVLLYELDAIRKACASLEPNYQPPVTFIVVQKRHHTRLFANNHRDRSSTDKSGNILPGTVVDSKICHPTEFDFYLCSHAGIQGTSRPAHYHVLWDENNFTADGIQSLTNNLCYTYARCTRSVSVVPPAYYAHLAAFRARFYMEPEMQDNGSTGTRGTRAAGETGVRPLPALKENVKRVMFYC

SEQ ID NO: 4502 - protein, 988 aa, Tripterygium wilfordii
MPIRQMKESSDQHLVIKTHLKNSMNPPQKTPKTAQNGKGPPLQEHQNTKIQNQPSPPSRNRRRRGRGGRKSDQGDACLRPSSRPCTVACKPVNSAGDLLATIPNGSTENGGNVCEMDMGFPTSSKSLSFAPRPGYGQVGTKCIVKANHFLAELPEKDLNQYDVTITPEVSSRTVNRAIMAELVRLYKESDLGMRLPAYDGRKSLYTAGELPFAWKEFTIKLVDEDDGTNGPKREREYRVVIKFVARANLHHLGQFLAGNRADAPQEALQILDIVLRELSVKRYCPIGRSFFSSDIRAPQRLGDGLESWCGFYQSIRPTQMGLSLNIDMASAAFIEPLPVIEFAGQLLGKDVLSRPLSDSDRVKIKKALRGVKVEVTHRGNVRRKYRVSGLTSQPTRELVFPVDENSTMKSVVEYFQEMYGFTIQHSHLPCLQVGNQKKANYLPMEACKIVEGQRYTKRLNEKQITALLKVTCQRPRERENDILQTVQHNAYDQDPYANEFGIKISEKLASVEARILPAPWLKYHETGKEKDCLPQVGQWNMMNKKMINGMTVNRWACINFSRSVQENVARGFCSELAQMCQVSGMEFNPDPVIPIYTARPEQVEKALKHVYHVSMNKTKGKELELLLAILPDNNGSLYGDLKRICETDLGLLTQCCLTKHVFKISKQYLANVSLKINVKMGGRNTVLLDAISCRIPLVSDIPTIIFGADVTHPENGEDSSPSIAAVVASQDWPEVTKYAGLVCAQAHRQELIQDLYKTWQDPVRGTVSGGMIRDLLISFRKATGQKPLRIIFYRDGVSEGQFYQVLLYELDAIRKACASLEPNYQPPVTFIVVQKRHHTRLFANNHRDRSSTDKSGNILPGTVVDTKICHPTEFDFYLCSHAGIQGTSRPAHYHVLWDENNFTADGIQSLTNNLCYTYARCTRSVSVVPPAYYAHLAAFRARFYLEPDVQENGSNGSGHATKTTRTGDAGVRPLPALKENVKRVMFYC

SEQ ID NO: 4503 - protein, 994 aa, Theobroma cacao
MPIRQMKENSEQHLVIKNHLQNTMNPVQRAPKTAQNGKGPPAAHEPQNTKLPHNQTSPPTKNKGRRRGRGGRKSDQGDVCMRPSSRPCTVAHKPVNPAAGDLVAASSNGPIQNGHNLRGMEMGFPTSSKSSNFAPRPGYGQVGTKCIVKANHFFAELPDKDLNQYDVTISPEVASRMVNRAIMAELVRLYKESDLGMRLPAYDGRKSLYTAGELPFAWKEFIIKLVDEEDGINGPKREREYKVVIKFVARANMHHLGQFLAGKRADAPQEALQILDIVLRELSMKRYCPIGRSFFSPDIRAPQRLGDGLESWCGFYQSIRPTQMGLSLNIDMASAAFIEPLPVIDFVAQLLGKDVLSRPSSDSDRVKIKKALRGVKVEVTHRGNVRRKYRVSGLTSQPTRELMFPVDDNSTMKSVVEYFQEMYGFTIQHTHLPCLKVGNQRKANYLPMEACKIVEGQRYTKRLNERQITALLKVTCQRPRDRENDILQTVQHNSYDQDPYANEFGIKISEKLASVEARILPAPWLKYHETGKEKDCLPQVGQWNMMNKKMINGMTVNRWACINFSRSVQESVARGFCNELAQMCQVSGMEFNSEPVIPIYSARPEQVEKALKHVYHASMNKTKGKELELLLAILPDNNGSLYGDLKRICETDLGLISQCCLTKHVFKISKQYLANVALKINVKMGGRNTVLLDAISCRIPLVSDIPTIIFGADVTHPENGEDSSPSIAAVVASQDWPEVTKYAGLVCAQAHRQELIQDLYKTWQDAVRGTVSGGMIRDLLVSFRKATGQKPLRIIFYRDGVSEGQFYQVLLYELDAIRKACASLEPNYQPPVTFIVVQKRHHTRLFANNHRDRSSTDKSGNILPGTVVDSKICHPTEFDFYLCSHAGIQGTSRPAHYHVLWDENNFTADGIQSLTNNLCYTYARCTRSVSVVPPAYYAHLAAFRARFYMEPEMQENGSTVGGAGHTKGTRAAGESGVRPLPALKENVKRVMFYC

SEQ ID NO: 4504 - protein, 984 aa, Cucumis sativus
MPVRQMKESSEQHLVIKTHLQNTVQKAPKSTQNGKGPPNLEHQNIKFRNPSSPPSKNRGRRRSRGGRKSDQGDVFMRPSSRPCTVARKPDEPEFNAGAMVASTNPNGGIISGMQMGFRNSSKSLSFAPRPGFGQVGTKCIVKANHFFAELPDKDLNQYDVTITPEVASRTVNRAIMAELVRLYRESDLGKRLPAYDGRKSLYTAGELPFVWKEFTIKLVDEEDGVSGPKREREYKVLIKFVARANLHHLGQFLAGKRADAPQEALQILDIVLRELSSKRYCPIGRSFFSPDIRSPQRLGDGLESWCGFYQSIRPTQMGLSLNIDMASAAFIEPLPVLEFVAQLLGKDVLSRPLSDSDRVKIKKALRGVKVEVTHRGNVRRKYRVSGLTSQPTRELVFPVDDNSTMKSVVEYFQEMYGFTIQHAHLPCLQVGNQKKANYLPMEACKIVGGQRYTKRLNEKQITALLKVTCQRPRDRENDILQTVQHNAYDNDPYAKEFGIKISEKLASVEARILPPPWLKYHDTGKEKDCLPQVGQWNMMNKKMINGMTVNRWACINFSRSVQESVARGFCSELAQMCQVSGMEFNPEPVIPIYNARPEQVEKALKHVYHASMNKTKGKELELLLAILPDNNGSLYGDLKRICETDLGLISQCCLTKHVFKISKQYLANVSLKINVKMGGRNTVLLDAISCRIPLVSDIPTIIFGADVTHPENGEDSSPSIAAVVASQDWPEVTKYAGLVCAQAHRQELIQDLYKTWQDPVRGTVSGGMIRDLLISFRKATGQKPLRIIFYRDGVSEGQFYQVLLYELDAIRKACASLEPNYQPPVTFIVVQKRHHTRLFANNYRDRSSTDKSGNILPGTVVDSKICHPTEFDFYLCSHAGIQGTSRPAHYHVLWDENNFTADGIQSLTNNLCYTYARCTRSVSVVPPAYYAHLAAFRARFYMEPEMQENGSAGRSAKSTRVTGECGVRPLPALKENVKRVMFYC

SEQ ID NO: 4505 - protein, 996 aa, Populus trichocarpa
MPVRQMKESSEQHLVIKTHMQNSMNQPQKHHKTAQNGKGPPQPLQESSNTKPQNQASPPAKNRGRRRGRGGRKSDQGDVCTRPSSRPCTVAHKPVLNPTGDLLANASNGHIENSKNVCEMEMGLGFPTSSKSLSLAPRPGYGQVGTKCIVKANHFLAELPDKDLNQYDVTITPEVASRTMNRDIMAELVRLYKDSDLGMRLPAYDGRKSLYTAGELPFAWKEFIIKLIDEEDGINGPKRGREYKVVIKFVARANMYHLGQFLAGKRADAPQEALQILDIVLRELSSKRYCPVGRSFFSPDIRAPQRLGDGLESWCGFYQSIRPTQMGLSLNIDMASAAFIEPLPVIEFVAQLLGKDILSRPLSDSDRVKIKKGLRGVKVEVTHRGSVRRKYRVSGLTSQPTRELVFPVDDNSTMKSVVEYFQEMYGFTIQHTHLPCLQVGNQKKANYLPMEACKIVEGQRYTKRLNERQITALLRVTCQRPRDRENDILQTVQHNAYDQDPYAKEFGIKISEKLASVEARILPAPWLKYHETGKEKDCLPQVGQWNMMNKKMINGMTVSRWACINFSRSVQESVARGFCNELAQMCQVSGMEFNSEPVIPIYNARPEHVEKALKHVYHASTNRTKGKELELLLAILPDNNGSLYGDLKRICETDLGLITQCCLSKHVFKISKQYLANLSLKINVKMGGRNTVLLDAISCRIPLVSDIPTIIFGADVTHPENGEDSSPSIAAVVASQDWPEVTKYAGLVCAQAHRQELIQDLYKTWQDPVRGTVSGGMIRDLLISFRKATGQKPLRIIFYRDGVSEGQFYQVLLYELDAIRKACASLEPNYQPPVTFIVVQKRHHTRLFANNHRDRNSTDKSGNILPGTVVDSKICHPTEFDFYLCSHAGIQGTSRPAHYHVLWDENNFTADGIQSLTNNLCYTYARCTRSVSVVPPAYYAHLAAFRARFYTEPVMQENGSAGSGACHGAKGTRTGESGVRPLPALKENVKRVMFYC

SEQ ID NO: 4506 - protein, 674 aa, Fagus grandifolia
MGLSLNIDMAAAAFIEPLPVIEFVAQLLSKDVLSRPLSDSDRVKIKKALRGVKVEVTHRGNVRRKYRVSGLTSQPTRELVFPVDDNSNMKSVVEYFQEMYGFTIQHTHLPCLQVGNQKKANYLPMEACKIVEGQRYTKRLNERQITSFLKVTCQRPRDRENDILQTVQQNAYDLDPYAKEFGIKISEKLASVEARILPAPWLKYHETGKEKDCLPQVGQWNMMNKKMINGMTVSRWACINFSRSVQENIARGFCNELAQMCQVSGMEFNPEPVIPIYNARPEQVEKALKHIYHTAMNKTKGKDLELLLAILPDNNGSLYGDIKRICETDLGLISQCCLTKYVFKINKQQYLANVSLKINVKMGGRNTVLLDAISCRIPLVSDIPTIIFGADVTHPENGEDSSPSIAAVVASQDWPEVTKYAGLVCAQAHRQELIQDLYKTWHDPVRGLISGGMIRDLLVSFRKATGQKPLRIIFYRDGVSEGQFYQVLLYELDAIRKACASLEPNYQPPVTFIVVQKRHHTRLFANNHRDKSSIDKKSGNVLPGTVVDSKICHPTEFDFYLCSHAGIQGTSRPAHYHVLWDENNFTPDGIQSLTNNLCYTYARCTRSVSVVPPAYYAHLAAFRARFYMEPEMQENGSSGGGGGHGNKGTRAAGESGVKPLPALKENVKRVMFYC

SEQ ID NO: 4507 - protein, 996 aa, Populus trichocarpa
MPIRQMKESSEQHLVIKTHMQNSINQPQKHHKTAQNGKGPPQPLQESSNTKPQNQTSPPAKNRGRRRGRGGRKSDQGDVCMRPCSRPCTVVHKPVVNPIGDLLSTTSSGPIETGKNVCEMEMGPGFPTSSKSLSFARRPGYGQVGSKCIVKANHFFAELPDKDLNQYDVTITPEVASRTMNRAIMAELVRLYKESDLGMRLPAYDGRKSLYTAGKLPFAWKEFAIKLVDAQDGISGPKREREYKVVIKFVARANMYHLSQFLAGKHADAPQEALQILDIVLRELSTKRYCPVGRSFFSPDIRAPQRLGDGLESWCGFYQSIRPTQMGLSLNIDMASAAFIEPLPVIEFVAQLLGKDVLSRPLSDSDRVKIKKGLRGVKVEVTHRGSVRRKYRVSGLTSQPTRELVFPVDDNSTMKSVVEYFQEMYGFTIQHAHLPCLQVGNQKKANYLPMEACKIVEGQRYTKRLNERQITALLKVTCQRPRDRENDILQTVQNNAYDQDPYAKEFGIKISEKLASVEARILPAPWLKYHETGKEKDCLPQVGQWNMMNKKMINGMTVSRWACINFSRSVQESVARGFCNELAQMCQVSGMEFNSEPVIPIYNARPEHVEKALKHVYHASTNRTKGKELELLLAILPDNNGSLYGDLKRICETDLGLLTQCCLSKHVFKISKQYLANVSLKINVKMGGRNTVLLDAISCRIPLVSDIPTIIFGADVTHPENGEDSSPSIAAVVASQDWPEVTKYAGLVCAQAHRQELIQDLYKTWQDPVRGTVSGGMIRDLLISFRKATGQKPLRIIFYRDGVSEGQFYQVLLYELDAIRKACASLEPNYQPPVTFIVVQKRHHTRLFANNHRDRTSTDKSGNILPGTVVDSKICHPTEFDFYLCSHAGIQGTSRPAHYHVLWDENNFTADGIQSLTNNLCYTYARCTRSVSVVPPAYYAHLAAFRARFYTEPVMQETGSAGSGAGHGAKGTRTGESGVRPLPALKENVKRVMFYC

SEQ ID NO: 4508 - protein, 918 aa, Trifolium pratense
RSRNGRKSDQVDVLMRPSCRPCTTVVKNNDNGHVENGSIITSSDVEMSFPTSSKSLSFAQRPGYGQVGTKCIVKANHFFAELPDKDLNQYDVTITPEVSSKAVNRSIIAELVRLYKESDLGMRLPAYDGRKSLYTAGVLPFSWREFKIKLIEEEDGINGPKREREYKVVIKFVARANLHHLGQFLAGKRADAPQEAIQILDIVLRELASKRFCPIGRSFYSPDIRTPQRLGEGLESWCGFYQSIRPTQMGLSLNIDMASAAFIEPLPVVEFVGQLLGKDVLSRQLSDADRIKIKKSLRGVKVEVTHRGSVRRKYRVSGITSQPTRELVFPVDENSTMKSVVEYFQEMYGFTIKHTHLPCLQVGGNQKKANYLPMEACKIVEGQRYTKRLNEKQITSLLKVTCQRPRDRENDILRTVQHNAYDQDPYAKEFGIKISEKLASVEARILPAPWLKYHESGKEKNCLPQVGQWNMMNKKMINGMTVSRWACINFSRGVQDSVARTFCNELAQMCQVSGMEFNLEPVIPIYNAKPEQVEKALKHVYHVSSNKTKGKELELLLVILPDNNGSLYGDLKRICETDLGLISQCCLTKHVFKITKQYLANVSLKINVKMGGRNTVLVDAVSCRIPLVSDIPTIIFGADVTHPENGEDSSPSIAAVVASQDWPEVTKYAGLVCAQPQRQELIQDLYKTWHDPVRGVVSGGMIRDLLVSFRRATGQKPQRIIFYRDGVSEGQFYQVLLYELDAIRKACASLEPNYQPPVTFIVVQKRHHTRLFANNHRDRNSTDRSGNILPGTVVDTKICHPTEFDFYLCSHAGIQGTSRPAHYHVLWDENNFTADGIQSLTNNLCYTYARCTRSVSVVPPAYYAHLAAFRARFYTEPDLQETGSTGGRGSKTTRAAGDCGVKPLPALKENVKRVMFYC

SEQ ID NO: 4509 - protein, 991 aa, Sesamum indicum
MPMRQMKENSEQHFVIKSQLQNPMNSAQKNPKTAQNGKGPPNQESQNAKAQNQCSPPSRNRGRRRGRGGRKSDQGDVFMRPSSRPCTAADKPVMRETSQAIVPALSNGSVGNGGSLCQSEMGFPSSSKSLTFPTRPGFGQLGTKCIVKANHFFAELPDKDLNQYDVTITPEVSSRAVNRAIMAELVKMYKESDLGMRLPAYDGRKSLYTAGELPFAWKEFTIKLIDEEDNVNGPKREREYKVVIKFVARANLHHLGQFLAGKRADGPKEALQILDIVLRELSMKRFCPVGRSFFSPDIRRPQRLGDGLEAWCGFYQSIRPTQMGLSLNIDMASAAFIEALPVIEFVAQLLGKDVLSRPLSDSDRIKVKKALRGVKVEVTHRGDVRRKYRVSGITSQPTRELVFPVDDNSMKSVVEYFQEMYGFTIQYTHLPCLQVGNQKKANYLPMEACKIVEGQRYTKRLSEKQITALLKVTCQRPRDRENDILQTVQHNAYEQDPYAKEFGIRISEKLASVEARVLPAPWLKYHETGKEKDCLPQVGQWNMMNKKMINGMTVSRWACINFSRSVQDSVARGFCNELAQMCQVSGMEFNPEPVIPIYAARPDQVEKALKHVYHACMNKLKGKELELLLAILPDNNGSLYGDLKRICETDLGLISQCCLTKHVFKINKQYLANVSLKINVKMGGRNTVLLDAISCRIPLVSDIPTIIFGADVTHPENGEESSPSIAAVVASQDWPEVTKYAGLVCAQAHRQELIQDLYKTWHDPVRGTVSGGMIRDLLVSFRKATGQKPQRIIFYRDGVSEGQFYQVLLFELDAIRKACASLEPNYQPPVTFIVVQKRHHTRLFANNHRDKSSTDKSGNILPGTVVDSKICHPTEFDFYLCSHAGIQGTSRPAHYHVLWDENNFTADGIQSLTNNLCYTYARCTRSVSVVPPAYYAHLAAFRARFYMEPDGQEGGCAGGQGGGKGTRVAGESGVRPLPALKENVKRVMFYC

SEQ ID NO: 4510 - protein, 924 aa, Trifolium pratense
RSRNGRKSDQVDVLMRPSCRPCTTVVKNNDNGHVENGSIITSSDVEMSFPTSSKSLSFAQRPGYGQVGTKCIVKANHFFAELPDKDLNQYDVTITPEVSSKAVNRSIIAELVRLYKESDLGMRLPAYDGRKSLYTAGVLPFSWREFKIKLIEEEDGINGPKREREYKVVIKFVARANLHHLGQFLAGKRADAPQEAIQILDIVLRELASKRFCPIGRSFYSPDIRTPQRLGEGLESWCGFYQSIRPTQMGLSLNIDMASAAFIEPLPVVEFVGQLLGKDVLSRQLSDADRIKIKKSLRGVKVEVTHRGSVRRKYRVSGITSQPTRELVFPVDENSTMKSVVEYFQEMYGFTIQYTHLPCLQVGNQKKANYLPMEACKIVEGQRYTKRLNEKQITSLLKVTCQRPRDRENDILQTIQHNAYDQDPYAKEFGINISEKLASVEARILPAPWPKYHESGKEKNCLPHVGQWNMMNKKMINGMAVNRWACINFSKSVQDSVARTFCNDLALMCQVSGMEFNLEPVIPIYNAKPEQVEKALKHVYHVSSNKTKGKELELLLAILPDNNGSLYGDLKRICETDLGLISQCCLTKHVFKITKQYLANVSLKINVKMGGRNTVLLDAVSYRIPLVSDIPTIIFGADVTHPENGEDTSPSIAAVVASQDWPEVTKYAGLVCAQAHRQELIQDLYKTWHDPVRGTVSGGMIRDLLISYRKATGQKPLRIIFYRDGVSEGQFYQVLLYELDAIRKACASLEPNYQPPVTFIIVQKRHHTRLFPNNHRDRSSTDKSGNILPGTVVDTKICHPTEFDFYLCSHAGIQGTSRPAHYHVLWDENNFTADGIQSLTNNLCYTYARCTRSVSVVPPAYYAHLAAFRARFYMEPDIQQENGSSGDGNSSHNSSKGTTRAAGECGVKPLPALKDNVKRVMFYC

SEQ ID NO: 4511 - protein, 994 aa, Gossypium raimondii
MPIRQMKDNSEQHLVIKNHLQNTMNPIQRTPKTAQNGKGPPAGHEPHNTKQSHNHTSPPTKNKGRRRGRGGRKSDQGDVCMRPSSRHCTVAQKPVNPGSADILAATSNGSIQNDHNLSGMEMGFPTSSKSLNFASRPGFGQVGTKCIVKANHFFAELPDKDLNQYDVTITPEVTSRTMNRAIMAELVKLYKGSVLGMRLPAYDGRKSLYTAGEFPFSWKEFSVKLVDEDDGINGPKREREYKVVVKFVARANMHHLGQFLAGKRADAPQEALQILDIVLRELSTKRYCPIGRSFFSPDIRAPQRLGDGLESWCGFYQSIRPTQMGLSLNIDMASAAFIEPLPVIEFVAQLLGKDLLSRPLSDSDRVKIKKALRGVKVEVTHRGNVRRKYRVSGLTSQPTRELVFPVDDNSTMKSIVEYFQEMYGFTIQHTHLPCLQVGNQRKANYLPMEACKIVEGQRYTKRLNERQITALLKVTCQRPRDREHDILQTVQHNAYNQDPYAKEFGVKISEKLASVEARILPAPWLKYHETGKEKDCLPQVGQWNMMNKKMINGMTVSRWACINFSRSVQESVARGFCIELAQMCQVSGMEFNPEPVIPIYSARPELVEKALKHVYNATMNKTKGKELELLLAILPDNNGSLYGDLKRICETDLGLISQCCLTKHVFKISKQYLANVALKINVKTGGRNTVLLDAISCRIPLVSDIPTIIFGADVTHPENGEDSSPSIAAVVASQDWPEVTKYAGLVCAQAHRQELIQDLYKTWQDPVRGTVSGGMIRDLLVSFRKATGQKPLRIIFYRDGVSEGQFYQVLLYELDAIRKACASLEPNYQPPVTFIVVQKRHHTRLFANSHRDRSSTDKSGNILPGTVVDSKICHPTEFDFYLCSHAGIQGTSRPAHYHVLWDENNFTADGIQSLTNNLCYTYARCTRSVSVVPPAYYAHLAAFRARFYMEPEMQENGSNSCSNGQAKGTRAVGESGVRPLPALKENVKRVMFYC

SEQ ID NO: 4512 - protein, 980 aa, Eucalyptus grandis
MPTRQMKESAEQNHQHLVIKTARLQNPMNNQPQKSPKTTQNGKGPPTPSPPSKSRGRRRRGRGERKSDQSDVCARPSSRPCTGEIVVPRAPPNGCAQNGGGNRADFPASSRSLSLARRPGYGQVGTRCIVKANHFFAVLPEKDLNQYDVSITPEVASRTVNRAIMAELLRLYRESDLGMRLPAYDGRKSLYTAGELPFSWKEFNIKLLDEEDGINGPKRVREYKVVIKFVARANMHHLSQFLAGKRTDAPQEALQVLDIVLRELSTKRFCPIGRSFFSPNLRTPQQLGDGLESWCGFYQSIRPTQMGLSLNIDMASAAFIEPLPVIEFVAQLLGKDVLSRQLSDSDRIKIKKALRGVKVEVTHRGSVRRKYRVSGLTSQPTRELVFPVDDNLNMKSVVEYFQEMYGFTILHTHLPCLQVGNQKKANYLPMEACKIVEGQRYTKRLNEKQITALLKVTCQRPRDRENDILRTVQQNAYDQDPYAKEFGIKISEKLASVEARILPAPWLKYHETGKEKDCLPQVGQWNMMNKKMINGMTVNRWACINFSRSVQESVAKGFCSELAQMCQVSGMEFNTQPVIPIYIAKPEQVEKALKHVYHACINKTKGKELELLLAILPDNNGSLYGDLKRICETDLGIISQCCLTKHVFKITKQYLANVSLKINVKMGGRNTVLLDAISCRIPLVSDIPTIIFGADVTHPENGEDSSPSIAAVVASQDWPEVTKYAGLVCAQAHRQELIQDLYKTWNDPVRGTVSGGMIRDLLVSFRKATGQKPLRIIFYRDGVSEGQFYQVLLYELDAIRKACASLEPNYQPPVTFIVVQKRHHTRLFANNHRDKSSTDKSGNIMPGTVVDTKICHPTEFDFYLCSHAGIQGTSRPAHYHVLWDENNFTADGIQSLTNNLCYTYARCTRSVSVVPPAYYAHLAAFRARFYMEPEAQENGSMGSGGGNGDHKTKGARITGESGVRPLPALKENVKRVMFYC

SEQ ID NO: 4513 - protein, 987 aa, Euphorbia peplus
MPTRQMKDGSEQHLVIKTHLQNTMNQPQKHLKTSQNGKGPPSPSQAEAQTQTSPSTTKNRGRRRGRGGRKSDQGEAFMRPSSRPCVNQNPSSPCDVLVKSPNGCGGNVSEMQMGLGFPNSSKSLSYAHRPGYGQLGTKCIVKANHFFAELPDKDLNHYDVTITPEVASRAINRAIIAELVRLHKESDLGMRLPAYDGRKSLYTAGELPFAFKEFTIQLVDEDDGTNAPKRVKEYKVVIKFVARANLHHLGQFLAGKRADAPQEALQILDIVLRELSNKRYCSIGRSFFSPDIRRPQRLGEGLESWCGFYQSIRPTQMGLSLNIDMASAAFIEPLPVIEFVAQLLGKDVLSRPLSDADRIKIKKGLRGVKVEVTHRGNVRRKYRVSGLTSQPTRELVFPIDDNSTMKSVVEYFQEIYGFTIVHTHLPCLQVGNQKKANYLPMEACKIVEGQRYTKRLNERQITALLKVTCQRPRDRENDILKTVQHNSYDQDPYAKEFGIKISEKLASVEARILPAPWLKYHETGKEKDCLPQVGQWNMMNKKMINGMTVSRWACINFSRNVQESVVRGFCNELGQMCQVSGMEFNPEPVIPIYNARPDQVEKALKHVYHASANKTKGKELELLLAILPDNNGTLYGDLKRICETDLGLISQCCLTKHVIKISKQYLANVSLKINVKMGGRNTVLLDAISCRIPLVSDIPTIIFGADVTHPENGEDSSPSIAAVVASQDWPEVTKYAGLVCAQAHRQELIQDLYKTWQDPVRGSVSGGMIRDLLVSFRKATGQKPLRIIFYRDGVSEGQFYQVLLYELDAIRKACASLEPNYQPPVTFIIVQKRHHTRLFANNHKDRSSTDKSGNILPGTVVDTKICHPTEFDFYLCSHAGIQGTSRPAHYHVLWDENNFTADGIQSLTNNLCYTYARCTRSVSVVPPAYYAHLAAFRARFYMEPELQENGSSGGSGNHGMKVTRSGESGVRPLPALKENVKRVMFYC

SEQ ID NO: 4514 - protein, 992 aa, Fragaria vesca
MPIRKMKESSEQHLVIKTHIQNSANPVQKAPKTAQNGKGPPTPEPQNPKTQNQTSPPTKNRGRRRGRGGRKSDQGDVFMRPSSRHCTVAHIPALPNLAGGGPIVTTTNGSLENGGNSCAMEMGFPTSSKSLSFAPRPGYGQAGIKCVVKANHFFAELPDKDLNHYDVSITPEVTSRVVNRAIMAELVRLYRESDLGMRLPAYDGRKSLYTAGELPFVWKEFNIKLSDEEERIDGRKREREYKVVIKFVARANMYHLSQFLAGKCADAPQEALQILDIVLRELSAKRYCPIGRSFFSPNIRTPQRLGEGLESWCGFYQSIRPTQMGLSLNVDMASAAFIEPLPVIEFVAQLLGKDVLSRTLSDADRVKIKKALRGVKVEVTHRGSVRRKYRVSGLTSQPTRELVFPVDENSTMKSVIEYFQEMYGFTIQHGHLPCLQVGGNQKKANYLPMEACKIVEGQRYTKRLNEKQITALLKVTCQRPRDRENDILQTVQQNAYDQDPYANEFGIKISEKLASVEARILPAPWLKYHETGKEKNCLPQVGQWNMMNKKMINGMPVSRWACINFSRSVQESVARGFCSELGQMCQVSGMEFNPEPVIPIYNARPEQVEKALKHVYHASMNKTKGKELELLLAILPDNNGSLYGDIKRICETDLGLISQCCLTKHVFKISKQYLANVSLKINVKMGGRNTVLLDAISCRIPLVSDIPTIIFGADVTHPENGEDTSPSIAAVVASQDWPEVTKYAGLVCAQPHRQELIQDLYKTWQDPVRGTVSGGMIRDLLVSFRKATGQKPLRIIFYRDGVSEGQFYQVLLYELDAIRKACASLEPNYQPPVTFIIVQKRHHTRLFANNHRDRSSVDKSGNILPGTVVDTKICHPTEFDFYLCSHAGIQGTSRPAHYHVLWDENNFTPDGIQSLTNNLCYTYARCTRSVSVVPPVYYAHLAAFRARFYMGPDLQENGSIGHAGKGTRTAGESGVRPLPALKENVKRVMFYC

SEQ ID NO: 4515 - protein, 955 aa, Gossypium raimondii
MPIRQMKESSEQHLVIKSHLQNTMNTVQRPPKTAQNGKGPPQAHEPHNNTKQPHNQATSPPSKNRGRRRGRGGKKSDQLDVCMRPSSRPCTVAHKPVNQASCGMEMAFPTSSKSLNFAPRPGYGQVGTKCIVKANHFFAQLPDKDLNQYDVTITPEVASRTVNRAIIAELVRLYKESDLGTRLPAYDGRKSLYTAGELPFAWKEFVVKLVDEEDGINGPKREREYKVVIKFVARANMHHLGQFLAGKRADAPQEALQILDIVLRELSSKRYCPIGRSFFSPDIRAPQRLGDGLESWCGFYQSIRPTQMGLSLNIDMASAAFIEPLPVIEFVAQLLGKDVLSRPLSDSDRVKIKKALRGVKVEVTHRGNVRRKYRVSGLTSQPTRELVFPVDDNSTMKSVVEYFQEMYSFTIQHTHLPCLQVGNQKKANYLPMEACKIVEGQRYTKRLNERQITALLKVTCQRPRDRENDILQTVQHNAYDQDPYAKEFGIKISEKLASVEARILPAPWLKYHETGKEKDCLPQVGQWNMMNKKMINGMTVSRWACINFSRSVQESVARGFCNELAQMCQVSGMEFNPEPVIPIYSAKLSSILPDNNGSLYGDLKRICETDLGLISQCCLTKHVFKISKQYLANVALKINVKMGGRNTVLLDAISCRIPLVSDIPTIIFGADVTHPENGEDSSPSIAAVVASQDWPEVTKYAGLVCAQAHRQELIQDLYKTWHDPVRGTVSGGMIRDLLISFRKATGQKPLRIIFYRDGVSEGQFYQVLLYELDAIRKACASLEPNYQPLVTFIVVQKRHHTRLFANNHRDRSSTDKSGNILPGTVVDSKICHPSEFDFYLCSHAGIQGTSRPAHYHVLWDENNFTADGIQSLTNNLCYTYARCTRSVSVVPPAYYAHLAAFRARFYLEPEMQDNNSSTGAGSGQAKGGGTKAAGESGVRPLPALKENVKRVMFYC

SEQ ID NO: 4516 - protein, 953 aa, Malus domestica
MAKVHHPRNPKKPKPHNQTSPPTKNRGRRRGRGGRKSDQGDVCMRPSSRHCAVAHLPTSPSLGGAASVANAPNGYGGNLVSMDMGFPTSSKSLSFAPRPGYGQVGIKCVVKANHFFAELPEKDLNHYDVRITPEVASTAVNRAIMAELVRLYKESDLGMRLPAYDGRKSLYTAGELPFAWKEFNIKLVEEQDGIVGRTRERVYNVVIKFVARANMHHLGQFLAGKCADAPQEALQILDIVLRELSNKRYCPIGRSFFSPDIRTPQRLGEGLESWCGFYQSIRPTQMGLSLNIDMASAAFIEPLPVIEFVAQLLGKDVLSRTLSDADRVKIKKALRGVKVEVTHRGSVRRKYRVSGLTSQPTRELVFPVDENLTMKSVIEYFQEMYGFTIQHGHLPCLQVGNQKKANYLPMEACKIVEGQRYTKRLNEKQITALLKVTCQRPRDRENDILQTVQHNAYDQDPYAKEFGIKISEKLASVEARILPAPWLKYHETGKEKNCLPQVGQWNMMNKKMINGMTVSRWACINFSRGVQESVARGFCSELAQMCQVSGMEFNPEPVIPIHNARPEQVEKALKHVYHASMNKTKGKDLELLLAILPDNNGSLYGDIKRICETDLGLISQCCLTKYVFKISKQYLANVSLKINVKMGGRNTVLLDAISCRIPLVSDIPTIIFGADVTHPENGEDSSPSIAAVVASQDWPEVTKYAGLVCAQAHRQELIQDLYKTWQDPVRGTVSGGMIRDLLVSFRKATGQKPLRIIFYRDGVSEGQFYQVLLYELDAIRKACASLEPNYQPPVTFIVVQKRHHTRIFANNHRDRSSVDKSGNILPGTVVDTKICHPTEHDFYLCSHAGIQGTSRPAHYHVLWDENNFTADGIQSLTNNLCYTYARCTRSVSVVPPAYYAHLAAFRARFYLEPDMQENGSTGHTAKGTRATGESGVRPLPALKENVKRVMFYC

SEQ ID NO: 4517 - protein, 794 aa, Solanum phureja
MPIRQMKESSEQHIVIKPHLQNTMNPVQKTPKTPQNGKGPPNQEPQNNKIHNQTSPPSRNRGRRRGRGGRKSDQGETFMRPSSRPCTAASKPVIAASVEATNVSGVENNGSSSGFPSSSKSLCFAPRPGYGQLGTKCIVKANHFLADLPDKELNQYDVTVIPEVSSRTVNRAIMAELVKLYKESHLGMRLPAYDGRKSLYTAGELPFKWKEFTIKLIDEDDVINGPKREREYKVVIKFVARANLHHLSEFLAGKRADGPKEALQILDIVLRELSIKRYCPVGRSFFSPDIRKPQPLGDGLEAWCGFYQSIRPTQMGLSLNIDMASAAFIEALPVMEFVAQLLGKDVSSRPLSDSDRVKIKKALRGVKVEVTHRGNVRRKYRVSGLTTQPTRELVFPVDDNLTMKSVVEYFQEMYGFTIKNTHLPCLQVGNQKKANYLPMEACKIVEGQRYTKRLSEKQITSLLKVTCQRPRDRENSILQTVQHNDYNEDPYAKEFGIKISEKQASVEARVLPAPWLKYHETGKEKDCLPQVGQWNMMNKKMINGMTVNRWACINFSRSVQESVARGFCNELAQMCQVSGMEFNPEPIIPIYMARPDQVEKALKHVYHSCVNKLKGKELELLLVILPDNNGSLYGDIKRICETDLGLITQCCLTKHVFKISKQYLANVSLKINVKMGGRNTVLLDAISCRIPLVSDIPTIIFGADVTHPENGEDSSPSIAAVVASQDWPEVTKYAGLVCAQAHRQELIQDLYKTWHDPARGTVSGGMIRDLLISFRKATGQKPQRIIFYRQGWSE

SEQ ID NO: 4518 - protein, 979 aa, Eutrema halophilum
MPIRQMKETSETHLVIKPNLQPLKQHNPKTVQTGKIPPPLPPPAASSPSPPSKNRGRRRNRGGRKSDQGDVCMRPSSRPRKPPVQTTSTAVSGGEIVAAVNHQMQMGVSKNSNFAPRPGFGQLGTKCIVKANHFLADLPTKDLNQYDVTITPEVSSKSVNRAIIAELVRLYKESDLGTRLPAYDGRKSLYTAGELPFKWKEFTVKIVDEDDGIINGPKRERSYKVAIKFVARANMHHLGEFLAGKRADGPQEALQILDIVLRELSVKRFCPVGRSFFSPDIRTPQRLGEGLESWCGFYQSIRPTQMGLSLNIDMASAAFIEPLPVIEFVAQLLGKDVLSKPLSDSDRVKIKKGLRGVKVEVTHRANVRRKYRVAGLTTQPTRELMFPVDENSTMKSVIEYFQEMYGFTIQHTHLPCLQVGNQKKASYLPMEACKIVEGQRYTKRLNEKQITALLKVTCQRPRDRENDILRTVQHNAYDQDPYAKEFGVKISEKLASVEARILPAPWLKYHENGKEKDCLPQVGQWNMMNKKMINGMTVSRWACVNFSRSVQENVARGFCNELGQMCEVSGMEFNPEPVIPIYSARPDQVEKALKHVYHTAMNKTKGKELELLLAILPDNNGSLYGDLKRICETELGLISQCCLTKHVFKISKQYLANVSLKINVKMGGRNTVLLDAISCRIPLVSDIPTIIFGADVTHPENGEESSPSIAAVVASQDWPEVTKYAGLVCAQAHRQELIQDLYKTWQDPVRGTVSGGMIRDLLISFRKATGQKPLRIIFYRDGVSEGQFYQVLLYELDAIRKACASLEPNYQPPVTFIVVQKRHHTRLFANNHRDKSSTDRSGNILPGTVVDTKICHPTEFDFYLCSHAGIQGTSRPAHYHVLWDENNFTADGIQSLTNNLCYTYARCTRSVSVVPPAYYAHLAAFRARFYMEPEIMQDNGSPGKKSAKTTTLGDSGGGRGGVKPLPALKENVKRVMFYC

SEQ ID NO: 4519 - protein, 956 aa, Malus domestica
MPIRKKESSEQHLVIKPHLQNPVNPVQKAPKTAQNGKGPPPQEPQNPKLHNQTSPPAKNRGRRRGRGGRKSDQGDVCMRPSSRHCAVAHLPASPSLGGAAPLATSPNGYVENGGNSVSMEMGFPTSSKSLSFAPRPGYGQVGIKCIVKANHFFAELPEKDLNHYDVSITPEVASRALNRAIMAELVRLYKESDLGMRLPAYDGRKSLYTAGELPFAWKEFNIKLVDEPDGISWPKFLAGKCADAPQEALQILDIVLRELSNKRYCPIGRSFFSPNIRTPQRLGEGLESWCGFYQSIRPTQMGLSLNIDMASAAFIEPLPVIEFVAQLLGKDVLSRTLSDADRVKIKKALRGVKVEVTHRGSVRRKYRVSGLTSQPTRELVFPVDENLTMKSVIEYFQEMYGFTIQHGHLPCLQACKIVEGQRYTKRLNEKQITALLKVTCQRPRDRENDILQQTVQHNAYDQDPYAKEFGIKISEKLASVEARILPAPWLKYHETGKEKNCLPQVGQWNMMNKKMINGMTVSRWACINFSRGVQESVARGFCSELAQMCQVSGMEFNSEPVIPIYNARPEQVEKALKHVYHASMNKTKGKDLELLLAILPDNNGSLYGDIKRICETDLGLISQCCLTKYVFKISKQYLANVSLKINVKMGGRNTVLLDAISCRIPLVSDIPTIIFGADVTHPENGEDSSPSIAAVVASQDWPEVTKYAGLVCAQAHRQELIQDLYKTWQDPVRGTVSGGMIRDLLVSFRKATGQKPLRIIFYRDGVSEGQFYQVLLYELDAIRKACASLEPNYQPPVTFIVVQKRHHTRLFANNHRDRSSIDKSGNILPGTVVDTKICHPTEHDFYLCSHAGIQGTSRPAHYHVIWDENNFTADGIQSLTNNLCYTYARCTRSVSVVPPAYYAHLAAFRARFYLEPDMQENGSTGHTAKGTRAAGESGVRPLPALKENVKRVMFYC

SEQ ID NO: 4520 - protein, 994 aa, Nicotiana benthamiana
MPIRQMKEGSEQHMVIKSQLQNTMNPLQKNPKTAQNGKGPPITEPQTNKIHNTTSSPPSRNRGRRRGRGGRKSDQGEAFMRPSSRPCTAASKPVIVAAENVINVSVSSSSCQLVAAGSGFPSSSKSLCFTPRPGYGQLGTKCIVKANHFLAELPDKDLNQYDVTVTPEVSSRSVNRAILAELVKLYKESDLGMRLPAYDGRKSLYTAGELPFKWKEFTIKLIDEDDVINGPKREREYKVVIKFVARANLHHLSQFLAGKCADGPQEALQILDIVLRELSIKRYCPVGRSFFSPDIRKPQPLGDGLEAWCGFYQSIRPTQMGLSLNIDMASAAFIEALPVIEFVAQLLGKDVSSRPLSDSDRVKIKKALRGVKVEVTHRGNVRRKYRVSGLTSQPTRELVFPVDDNSTMKSVVEYFQEMYGFTIKYTHLPCLQVGNQKKANYLPMEACKIVEGQRYTKRLSEKQITALLKVTCQRPRDRENSILQTVQHNDYSEDPYAKEFGIKISEKQASVEARVLPAPWLKYHETGKEKDCLPQVGQWNMMNKKMINGMTVSRWACINFSRSVQESVARGFCNELAQMCQVSGMEFNPEPVIPIYMARPDQVEKALKHVYHAYVNKLKGKELELLLVILPDNNGPLYGDIKRICETDLGLISQCCLTKHVFKISKQYLANVSLKINVKMGGRNTVLLDAISCRIPLVSDIPTIIFGADVTHPENGEDSSPSIAAVVASQDWPEVTKYAGLVCAQAHRQELIQDLYKTWHDPARGTVSGGMIRDLLISFRKATGQKPQRIIFYRQYLVYRDGVSEGQFYQVLLFELDAIRKACASLEPNYQPPVTFIVVQKRHHTRLFANNHKDRSSTDRSGNILPGTVVDTKICHPTEFDFYLCSHAGIQGTSRPAHYHVLWDENNFTADGIQSLTNNLCYTYARCTRSVSVVPPAYYAHLAAFRARFYMEPEMAENGGSPHKGGKGIREGGESGVRPLPALKENVKRVMFYC

SEQ ID NO: 4521 - protein, 989 aa, Petroselinum crispum
MPIRQLKEGSEQHLVIKPHLNNSVNQVQKQLKTARNGKSPPGQENQNAKAHNQSSPPSKSRGRRRGRGGRKSDQGDACMRPSTRPCTAEYSPVAQVSARSGAAVEVHNSNLGTLCEVGRNFPSSSKSLSFAQRPGYGQLGTKCVVKANHFFAELPEKDLNHYDVSITPEVSSRNMNRAIMAELVKLYKESDLGMRLPAYDGRKSLYTAGELPFAWKEFDIKLTDEDDGVNGPKRVREYKVVIKFVARANLHHLGQFLAGKRADAPQEALQILDIVLRELSNKRYCPVGRSFFSPNIRKPQRLGEGLESWCGFYQSIRPTQMGLSLNIDMASAAFIEALPVIEFVAQLLGKDVLTKTLSDSDRVKIKKALRGLKVEVTHRGHIRRKYRVSGITSQPTRELVFPVDDNSNMKSVVEYFQEMYGFTIQHTHLPCLQVGNQRKANYLPLEACKIVEGQRYTKRLNEKQITALLKVTCQRPRDREHDILQTVQHNAYDQDPYAKEFGMNISEKLASVEARVLPAPWLKYHENGKEKDCLPQVGQWNMMNKKMINGMTVSRWACINFSRSVQENVARGFCSELARMCQVSGMEFNPEPVIPIYTAWPDDVEKALKHVYHACTNKLKGKDLELLLVILPDNNGSLYGDLKRICETDLGLISQCCLTKHVFKISKQYLANVSLKINVKMGGRNTVLLDAISCRIPLVSDIPTIIFGADVTHPENGEDSSPSIAAVVASQDWPEVTKYAGLVCAQAHRQELIQDLYKTWQDPARGTVSGGMIRELLVSFRKATGQKPLRIIFYRDGVSEGQFYQVLLYELDAIRKACASLEPNYQPPVTFIVVQKRHHTRLFANNHRDRSSTDKSGNVLPGTIVDTKICHPTEFDFYLCSHAGIQGTSRPAHYHVLWDENNFTADGIQSLTNNLCYTYARCTRSVSVVPPAYYAHLAAFRARFYMEPELQENGCGVGQGTKNTRGVGESGVRPLPALKENVKRVMFYC

SEQ ID NO: 4522 - protein, 982 aa, Solanum lycopersicum
MPIRQMKESSEQHIVIKPHLQNTMNPVQKNPKTTQNGKGPPNQEPPNNKIHIQTSPPSRNRGRRRGRGGKKSDQGETFMRPSSRPCTAASKPVIAASVEATNVSGVESNGTSSGFPSSSKSLCFAPRPGYGQLGTKCIVKANHFLADFPDKELNQYDVTVIPEVSSRTVNRAIMAELVKLYKESHLGMRLPAYDGRKSLYTAGELPFKWKEFTIKLIDEDDVINGPKREREYKVVIKFVARANLHHLSEFLAGKRADGPKEALQILDIVLRELSIKRYCPVGRSFFSPDIRKPQPLGDGLEAWCGFYQSIRPTQMGLSLNIDMASAAFIEALPVIEFVAQLLGKDVSSRPLSDSDRVKIKKALRGVKVEVTHRGNVRRKYRVSGLTTQPTRELVFPVDDNLTMKSVVEYFQEMYGFTIKNTHLPCLQVGNQKKANYLPMEACKIVEGQRYTKRLSEKQITSLLKVTCQRPRDRENSILQTVQHNDYNEDPYAKEFGIKISEKQASVEARVLPAPWLKYHETGKEKDCLPQVGQWNMMNKKMINGMTVNRWACINFSRSVQESVARGFCNELTQMCQVSGMEFNPDPIIPIYMARPDQVEKALKHVYHSCVNKLKGKELELLLVILPDNNGSLYGDIKRICETDLGLITQCCLTKHVFKISKQYLANVSLKINVKMGGRNTVLLDAISCRIPLVSDIPTIIFGADVTHPENGEDSSPSIAAVVASQDWPEVTKYAGLVCAQAHRQELIQDLYKTWHDPARGTVSGGMIRDLLISFRKATGQKPQRIIFYRDGVSEGQFYQVLLFELDAIRKACASLEPNYQPPVTFIVVQKRHHTRLFANNHKDRSSIDRSGNILPGTVVDTKICHPTEFDFYLCSHAGIQGTSRPAHYHVLWDENNFTADGIQSLTNNLCYTYARCTRSVSVVPPAYYAHLAAFRARFYMEPDMPETNSGSPHQGSSKAIRETGVRPLPALKENVKRVMFYC

SEQ ID NO: 4523 - protein, 985 aa, Daucus carota
MPIRQLKEGSEQHLVIKPQLQNTMNPVHKQLKVAQNGKGSTGKETQNVKLQNQSSPPSKSRGRRRGRGGRKSDQGEAFMRPSTRPCTAEYTVSPPVTTRSVTAVEVDNNNGGKLCEIVKAFPSSSKTLSFAQRPGYGQIGTRCVVKANHFLAELPEKELNHYDVTIMPEVSSRNVNRAIMAELVKLYKESDLGMRLPAYDGRKSLYTAGELPFAWREFNIKLTVEDDGVNGPKRVREYKVVIKFVARANLHHLGQFLAGKHADAPQEALQILDIVLRELSNKRYCPVGRSFFSPDIRKPQRLGEGLESWCGFYQSLRPTQMGLSLNIDMASAAFIEPLPVIEFVAQLLGKDVVSRTLSDSDRIKIKKALRGVKVEVTHRGSVRRKYRVSGLTSQPTRELVFPVDDDLNMKSVVEYFQEMYDFTIQHTHLPCLQVGNQRKANYLPLEACKIVEGQRYTKRLNDKQITALLKVTCQRPRDRENDILQTVKHNAYDQDLYANEFGMRISEKLASVEARVLPAPWLKYHENGKEKDCLPQIGQWNMMNKKMINGMTVSRWACINFSRSVQENVARGFCSELARMCQVSGMEFNPEPVIPIYTAWPDDVEKALKHVYHASVNKLKGKDLELLLAILPDNNGSLYGDLKRICETDLGLISQCCLTKYVFKISKQYLANVSLKINVKMGGRNTVLLDAISCRIPLVSDIPTIIFGADVTHPENGEDSSPSIAAVVASQDWPEVTKYAGLVCAQAHRQELIQDLYKTWQDPARGTISGGMIRDLLVSFRKATGQKPLRIIFYRDGVSEGQFYQVLLYELDAIRKACASLEPNYQPPVTFIVVQKRHHTRLFANNHRDRSSTDKSGNILPGTVVDTKICHPTEFDFYLCSHAGIQGTSRPAHYHVLWDENNFTADGIQSLTNNLCYTYARCTRSVSVVPPAYYAHLAAFRARFYLEPELQENGQGNKNTRGIGESGVRPLPALKENVKRVMFYC

SEQ ID NO: 4524 - protein, 989 aa, Petroselinum crispum
MPIRQLKEGSEQHLVIKPHLNNSVNQVQKQLKTARNGKSPPGQENQNAKAHNQSSPPSKSRGRRRGRGGRKSDQGDACMRPSTRPCTAEYSPVAQVSARSGAAVEVHNSNLGTLCEVGRNFPSSSKSLSFAQRPGYGQLGTKCVVKANHFFAELPEKDLNHYDVSITPEVSSRNMNRAIMAELVKLYKESDLGMRLPAYDGRKSLYTAGELPFAWKEFNIKLTAEDDGANGPKRVQEYKVVIKFVARANLHHLGQFLAGKHADAPQEALQILDIVLREVSNKRYCPVGRSFFSPDIRKPQRLGEGLESWCGFYQSLRPTQMGLSLNIDMASAAFIEPLPVIEFVAQLLGKDVVSRTLSDSDRVKIKKALRGMKVEVTHRGNVRRKYRVSGLTSQPTRELVFPVDDNSNMKSVVEYFQEMYDFTIQHTHLPCLQVGNQRKANYLPLEACKIVEGQRYTKRLNDKQITALLKVTCQRPRDRENDILQTVKHNAYDQDLYAKEFGMKISEKLASVEARVLPAPWLKYHENGKEKDCLPQVGQWNMMNKKMINGMTVSRWACINFSRSVQENVARGFCSELARMCQVSGMEFNPEPVIPIYTAWPDDVEKALKHVYHASVNKLKGKDLELLLAILPDNNGSLYGDLKRICETDLGLISQCCLTKYVFKISKQYLANVSLKINVKMGGRNTVLLDAISCRIPLVSDIPTIIFGADVTHPENGEDSSPSIAAVVASQDWPEVTKYAGLVCAQAHRQELIQDLYKTWQDPARGTVSGGMIRDLLVSFRKATGQKPLRIIFYRDGVSEGQFYQVLLFELDAIRKACASLEPNYQPPVTFIVVQKRHHTRLFANNHRNRSSTDKSGNILPGTVVDTKICHPTEFDFYLCSHAGIQGTSRPAHYHVLWDENNFTADGIQSLTNNLCYTYARCTRSVSVVPPAYYAHLAAFRARFYLEPELQENGCGVGQGMKNTRGFGESGVRPLPALKENVKRVMFYC

SEQ ID NO: 4525 - protein, 447 aa, Trigonella foenum-graecum
MCCQDHCRMLIALRLRKALEELKVEVTHRGSVRRKYRVSGLTSQPTRELVFPVDENSTMKSVVEYFQEMYGFTIQYTHLPCLQVGNQKKANYLPMEACKIVEGQRYTKRLNEKQITSLLKVTCQRPRDRENDILQTVQHNAYDQDPYAKEFGINISDKLTSVEARILPAPWLKYHESGKEKNCLPHVGQWNMMNKKMINGMTVNRWACINFSRSVQDSVARTFCNDLAQMCQVSGMEFNLEPVIPIYNAKPEQVEKALKHVYHVSTNKTKGNELELLLAILPDSNGSLYGDLKRICETDLGIISQCCLTKHVFKITKQYLANVSLKINVKMGGRNTVLLDAASYRIPLVSDIPTIIFGADVTHPENGEDSSPSIAAVVASQDWPEVTKYAGLVCAQAHRQELIQDLYKTWHDPVRGTVSGGMIRDLLIPLERPQDKSRYELYFTGMV

SEQ ID NO: 4526 - protein, 989 aa, Petroselinum crispum
MPIRQLKEGSEQHFVIKPHLQNSMNSVPKQLKSSQNGKVLVGQESQNVKTQNQSSPPSKSRGRRRGRGGRKSDQGDALMRPSTRPCTAEYTVTHPVTARCSTAVEVDNNNGGKLCEIVKAFPSSSKSLSFAQRPGYGQIGTKCVVKANHFLAELPEKELNHYDVAIMPEVSSRNVNRAIMAELVKLYKESDLGMRLPAYDGRKSLYTAGELPFAWKEFDIKLTDEDDGVNGPKRVREYKVVIKFVARANLHHLGQFLAGKRADAPQEALQILDIVLRELSNKRYCPVGRSFFSPNIRKPQRLGEGLESWCGFYQSIRPTQMGLSLNIDMASAAFIEALPVIEFVAQLLGKDVLTKTLSDSDRVKIKKALRGLKVEVTHRGHIRRKYRVSGITSQPTRELVFPVDDNSNMKSVVEYFQEMYGFTIQHTHLPCLQVGNQRKANYLPLEACKIVEGQRYTKRLNEKQITALLKVTCQRPRDREHDILQTVQHNAYDQDPYAKEFGMNISEKLASVEARVLPAPWLKYHENGKEKDCLPQVGQWNMMNKKMINGMTVSRWACINFSRSVQENVARGFCSELARMCQVSGMEFNPEPVIPIYTAWPDDVEKALKHVYHACTNKLKGKDLELLLVILPDNNGSLYGDLKRICETDLGLISQCCLTKHVFKISKQYLANVSLKINVKMGGRNTVLLDAISCRIPLVSDIPTIIFGADVTHPENGEDSSPSIAAVVASQDWPEVTKYAGLVCAQAHRQELIQDLYKTWQDPARGTVSGGMIRELLVSFRKATGQKPLRIIFYRDGVSEGQFYQVLLYELDAIRKACASLEPNYQPPVTFIVVQKRHHTRLFANNHRDRSSTDKSGNVLPGTIVDTKICHPTEFDFYLCSHAGIQGTSRPAHYHVLWDENNFTADGIQSLTNNLCYTYARCTRSVSVVPPAYYAHLAAFRARFYMEPELQENGCGVGQGTKNTRGVGESGVRPLPALKENVKRVMFYC

SEQ ID NO: 4527 - protein, 983 aa, Arabidopsis lyrata
MPIRQMKDSSETHLVIKTQPLKNHNPKTVQNGKIPPSPVTTPATVTQSQASSPSPPSKNRSRRRNRGGRKSDQGDVCMRPSSRPRKPPPPCQTTSAVVSASTAGEIVAVSHQMQMGVRKNSNFAPRPGFGTLGTKCIVKANHFLADLPTKDLNQYDVTITPEVSSKSVNRAIIAELVRLYKESDLGKRLPAYDGRKSLYTAGELPFTWKEFTVKIVDEDDGIINGPKRERSYKVAIKFVARANMHHLGEFLAGKRADCPQEAVQILDIVLRELSVKRFCPVGRSFFSPDIRTPQRLGEGLESWCGFYQSIRPTQMGLSLNIDMASAAFIEPLPVIEFVAQLLGKDVLSKPLSDSDRVKIKKGLRGVKVEVTHRANVRRKYRVAGLTTQPTRELMFPVDENCTMKSVIEYFQEMYGFTIQHTHLPCLQVGNQKKASYLPMEACKIVEGQRYTKRLNEKQITALLKVTCQRPRDRENDILRTVQHNAYDQDPYAKEFGMNISEKLASVEARILPAPWLKYHENGKEKDCLPQVGQWNMMNKKMINGMTVSRWACVNFSRSVQENVARAFCNELGQMCEVSGMEFNPEPVIPIYNARPDQVEKALKHVYHTAMNKTKGRELELLLAILPDNNGSLYGDLKRICETELGLISQCCLTKHVFKISKQYLANVSLKINVKMGGRNTVLLDAISCRIPLVSDIPTIIFGADVTHPENGEESSPSIAAVVASQDWPEVTKYAGLVCAQAHRQELIQDLYKTWQDPVRGTVSGGMIRDLLISFRKATGQKPLRIIFYRDGVSEGQFYQVLLYELDAIRKACASLEPNYQPPVTFIVVQKRHHTRLFANNHRDKSSTDRSGNILPGTVVDTKICHPTEFDFYLCSHAGIQGTSRPAHYHVLWDENNFTADGIQSLTNNLCYTYARCTRSVSIVPPAYYAHLAAFRARFYMEPEIMQDNGSPGKKNTKTTTVGDSGVKPLPALKENVKRVMFYC

SEQ ID NO: 4528 - protein, 937 aa, Gossypium hirsutum
PPTKNKGRRRGRGGRKSDQGDVCMRPSSRHCTVAQKPVNPGSADILAATSNGSIQNDHNLPGMEMGFPTSSKSLIFASRPGFGQVGTKCIVKANHFFAELPDKDLNQYDVTITPEVTSRTMNRAIMAELVKLYKGSVLGMRLPAYDGRKSLYTAGEFPFSWKEFSVKLVDEDDGINGPKREREYKVVVKFVARANMHHLGQFLAGKRADAPQEALQILDIVLRELSTKRYCPIGRSFFSPDIRAPQRLGDGLESWCGFYQSIRPTQMGLSLNIDMASAAFIEPLPVIEFVAQLVGKDLLSRPLSDSDRVKIKKALRGVKVEVTHRGNVRRKYRVSGLTSQPTRELVFPVDDNSTMKSIVEYFQEMYGFTIQHTHLPCLQVGNQRKANYLPMEACKIVEGQRYTKRLNERQITALLKVTCQRPRDREHDILQTVQHNAYNQDPYAKEFGVKISEKLASVEARILPAPWLKYHETGKEKDCLPQVGQWNMMNKKMINGMTVSRWACINFSRSVQESVARGFCIELAQMCQVSGMEFNPEPVIPIYSARPELVEKALKHVYNASMNKTKGKELELLLAILPDNNGSLYGDLKRICETDLGLISQCCLTKHVFKISKQYLANVALKINVKTGGRNTVLLDAISCRIPLVSDIPTIIFGADVTHPENGEDSSPSIAAVVASQDWPEVTKYAGLVCAQAHRQELIQDLYKTWQDPVRGTVSGGMIRDLLVSFRKATGQKPLRIIFYRDGVSEGQFYQVLLYELDAIRKACASLEPNYQPPVTFIVVQKRHHTRLFANSHRDRSSTDKSGNILPGTVVDSKICHPTEFDFYLCSHAGIQGTSRPAHYHVLWDENNFTADGIQSLTNNLCYTYARCTRSVSVVPPAYYAHLAAFRARFYMEPEMQENGSNSCSNGQAKGTRAVGESGVRPLPALKENVKRVMFYC

SEQ ID NO: 4529 - protein, 672 aa, Castanea mollissima
MGLSLNIDMASAAFIEPLPVIEFVAQLLSKDVLLRPLSDSDRVKIKKALRGVKVEVTHRGNVRRKYRVSGLTSQPTRELVFPVDDNSNMKSVVEYFQEMYGFTIQHTHLPCLQVGNQKKANYLPMEACKIVEGQRYTKRLNERQITALLKVTCQRPRDKENDILQTVQQNAYNQDPYAKEFGIKISEKLASVEARILPAPWLKYHETGKEKDCLPQVGQWNMMNKKMINGMTVSRWACINFSRSVQESVARGFCNELAQMCQVSGMEYNPEPVIPIYNARPEQVEKALKHVFHSAMNKTKGKELELLLAILPDNNGSLYGDLKRICETDLGLMSQCCLTKHVFKISKQYLANVSLKINVKMGGRNTVLLDAISCRIPLVSDIPTIIFGADVTHPENGEDSSPSIAAVVASQDWPEVTKYAGLVCAQAHRQELIQDLYKTWQDPVRGLVSGGMIRDLLVSFRKATGQKPLRIIFYRDGVSEGQFYQVLLYELDAIRKACASLEPNYQPPVTFIVVQKRHHTRLFANNHRDKSSTDKSGNILPGTVVDSKICHPTEFDFYLCSHAGIQGTSRPAHYHVLWDENNFTPDGIQSLTNNLCYTYARCTRSVSVVPPAYYAHLAAFRARFYMEPEMQENGSTGGGAGHGAKGTRAAGESGVRPLPALKENVKRVMFYC

SEQ ID NO: 4530 - protein, 975 aa, Brassica rapa
MPIRPMKETSETHLLIKPKHLPKAVQNAKAPPTPTQASSPSPPSKNRSRRRNRGGRKSDQGDVCMRPSSRPRKPPPQNAAPVAAVSGTEIVAVNHQMQMGVRGSSKNSNFAPRPGFGQLGTKCIVKANHFLADLPTKDLSHYDVTITPEVSSKSVNRAIIAELVRLYKESELGSRLPAYDGRKSLYTAGELPFTWKEFAVKIFDEDDGIINGPRRERSYKVAIKFVARANMHHLGEFLAGKRADGPQEALQILDIVLRELSVKRFCPVGRSFFSPDIRTPQRLGEGLQSWCGFYQSIRPTQMGLSLNIDMASAAFIEPLPVIEFVAQLLGKDVLSKPLSDSDRIKIKKGLRGVKVEVTHRANVRRKYRVAGLTTQPTRELMFPVDENATMKSVIEYFQEMYGFTIQHTHLPCLQVGNQKKASYLPMEACKIVEGQRYTKRLNEKQITALLKVTCQRPRDRENDILKTVQHNAYDQDPYAKEFGMNISEKLASVEARILPAPWLKYHENGKEKDCLPQVGQWNMMNKKMINGMTVSRWACVNFSRSVQENVARGFCNELGQMCEVSGMEFNPEPVIPIYSARPDQVEKALKHVYHTAMNKTKGKELELLLAILPDNNGSLYGDLKRICETELGLISQCCLTKHVFKISKQYLANVSLKINVKMGGRNTVLLDAISCRIPLVSDIPTIIFGADVTHPENGEESSPSIAAVVASQDWPEVTKYAGLVCAQAHRQELIQDLYKTWQDPVRGTVSGGMIRDLLISFRKATGQKPLRIIFYRDGVSEGQFYQVLLYELDAIRKACASLEPNYQPPVTFIVVQKRHHTRLFANNHRDKSSTDRSGNILPGTVVDTKICHPTEFDFYLCSHAGIQGTSRPAHYHVLWDENNFTADGIQSLTNNLCYTYARCTRSVSVVPPAYYAHLAAFRARFYMEPEIMQDNGSPGKKNTKTTTVGDHGVVGGGVKPLPALKENVKRVMFYC

SEQ ID NO: 4531 - protein, 669 aa, Petroselinum crispum
MGLSLNIDMASAAFIEPLPVIEFVAQLLGKDVVSRTLSDSDRVKIKKALRGMKVEVTHRGNVRRKYRVSGLTSQPTRELVFPVDDNSNMKSVVEYFQEMYDFTIQHTHLPCLQVGNQRKANYLPLEACKIVEGQRYTKRLNDKQITALLKVTCQRPRDRENDILQTVKHNAYDQDLYAKEFGMKISEKLASVEARVLPAPWLKYHENGKEKDCLPQVGQWNMMNKKMINGMTVSRWACINFSRSVQENVARGFCSELARMCQVSGMEFNPEPVIPIYTAWPDDVEKALKHVYHASVNKLKGKDLELLLAILPDNNGSLYGDLKRICETDLGLISQCCLTKYVFKISKQYLANVSLKINVKMGGRNTVLLDAISCRIPLVSDIPTIIFGADVTHPENGEDSSPSIAAVVASQDWPEVTKYAGLVCAQAHRQELIQDLYKTWQDPARGTVSGGMIRDLLVSFRKATGQKPLRIIFYRDGVSEGQFYQVLLFELDAIRKACASLEPNYQPPVTFIVVQKRHHTRLFANNHRNRSSTDKSGNILPGTVVDTKICHPTEFDFYLCSHAGIQGTSRPAHYHVLWDENNFTADGIQSLTNNLCYTYARCTRSVSVVPPAYYAHLAAFRARFYLEPELQENGCGVGQGMKNTRGFGESGVRPLPALKENVKRVMFYC

SEQ ID NO: 4532 - protein, 990 aa, Aquilegia formosa
MPIRQMKENSEQHFVIKPQVQNSMTQVQKNQKNLQNGKGPPTQNESQNAKINQHNSPPSKNRGRRRGRGGRKSDQSDIPMRPSSRPCTIVEKSMSEFPAIGKPVENGSVSVENGGNVCAMDMGFPSSSKSLRFAPRPGFGQAGTKCIVKANHFFAQLPEKDLNQYDVTITPEVVSRSLNRSIMAELVKLYKESDLGMRLPAYDGRKCLYTAGELPFTSREFNIKIVGEDDGMNEREYKVVIKFVARANLHHLGQFLSGKCADAPQEALQILDIVLRELSTKKYCAVGRSFFSPDIRKPQRLGEGLESWCGFYQSIRPTQMGLSLNIDMSSAVFIEPLPVIEYIAQLLGKDVFSRILSDSDRVKIKKALRGVKVEVTHRGNVRRKYRVSGLTSQPTRELVFPVDDDSNMKSVVEYFQEMYGFTIQHTHLPCLQVGNQKKANYLPMEACKIVEGQRYTKRLNEKQITSLLKVTCQRPKDRENDILQTVRKNAYDEDPYAEEFGIKISEKLACVEARILPAPWLKYHDTGKEKDCLPQVGQWNMMNKKMINGSTVSRWACINFSRSVQESVARGFCNELAQMCQISGMEYNPEPVIPIYSARPEHVEKALKHVCNAASNKLKGKELELLLVILPDSNGSLYGDLKRICETDLGLITQCCLTKHVFKINKQYLANVALKINVKMGGRNTVLLDAISCRIPLVSDIPTIIFGADVTHPENGEDSSPSIAAVVASQDWPEVTKYAGLVCAQAHRQELIQDLFKTWHDPVRGTVSGGMIRDLLISFRKATGQKPQRIIFYRDGVSEGQFYQVLLYELDAIRKACASLEPNYQPPVTFVIVQKRHHTRLFANNHKDRSSIDKSGNILPGTVVDSKICHPTEFDFYLCSHAGIQGTSRPAHYHVLWDENHFTADGIQSLTNNLCYTYARCTRSVSVVPPAYYAHLAAFRARFYMEPDLQENNSTGGSQPSVRATRGAGEVGVRPLPAVKDNVKRVMFYC

SEQ ID NO: 4533 - protein, 988 aa, Arabidopsis thaliana
MPIRQMKDSSETHLVIKTQPLKHHNPKTVQNGKIPPPSPSPVTVTTPATVTQSQASSPSPPSKNRSRRRNRGGRKSDQGDVCMRPSSRPRKPPPPSQTTSSAVSVATAGEIVAVNHQMQMGVRKNSNFAPRPGFGTLGTKCIVKANHFLADLPTKDLNQYDVTITPEVSSKSVNRAIIAELVRLYKESDLGRRLPAYDGRKSLYTAGELPFTWKEFSVKIVDEDDGIINGPKRERSYKVAIKFVARANMHHLGEFLAGKRADCPQEAVQILDIVLRELSVKRFCPVGRSFFSPDIKTPQRLGEGLESWCGFYQSIRPTQMGLSLNIDMASAAFIEPLPVIEFVAQLLGKDVLSKPLSDSDRVKIKKGLRGVKVEVTHRANVRRKYRVAGLTTQPTRELMFPVDENCTMKSVIEYFQEMYGFTIQHTHLPCLQVGNQKKASYLPMEACKIVEGQRYTKRLNEKQITALLKVTCQRPRDRENDILRTVQHNAYDQDPYAKEFGMNISEKLASVEARILPAPWLKYHENGKEKDCLPQVGQWNMMNKKMINGMTVSRWACVNFSRSVQENVARGFCNELGQMCEVSGMEFNPEPVIPIYSARPDQVEKALKHVYHTSMNKTKGKELELLLAILPDNNGSLYGDLKRICETELGLISQCCLTKHVFKISKQYLANVSLKINVKMGGRNTVLVDAISCRIPLVSDIPTIIFGADVTHPENGEESSPSIAAVVASQDWPEVTKYAGLVCAQAHRQELIQDLYKTWQDPVRGTVSGGMIRDLLISFRKATGQKPLRIIFYRDGVSEGQFYQVLLYELDAIRKACASLEPNYQPPVTFIVVQKRHHTRLFANNHRDKNSTDRSGNILPGTVVDTKICHPTEFDFYLCSHAGIQGTSRPAHYHVLWDENNFTADGIQSLTNNLCYTYARCTRSVSIVPPAYYAHLAAFRARFYLEPEIMQDNGSPGKKNTKTTTVGDVGVKPLPALKENVKRVMFYC

SEQ ID NO: 4534 - protein, 979 aa, Papaver somniferum
MPIRQMKESLEQHIVIKTQVQNTMNQVQKNSKTTQNGKSSQEPQNGKIQHQNSPPTKNRGRRRGRGGRKSDQGDILMRPSSRPCTTSVHKQPVNGFLPPPVNGGPVCMEMGFPTSSKNIRFAQRPGYGQLGTKCIVKANHFFAELPDKDLNHYDVTITPEVVSRTVNKAIMAELVRLYKESDLGMRLPAYDGRKSLYTAGALPFTYREFNIKVADEDDGTNAPRRERDYKVVIKFVARADLHHLGQFLTGKRADAPQEALQILDIVLRELASKRYCPIGRSFFSPNIRKPHRLGEGLESWCGFYQSIRPTQMGLSLNIDMSTAAFIEPLPVIEYVAQLLSKDVLSRPLSDADRVKIKKSLRGVKVEVTHRGGSVRRKYRVSGITSQPTRELVFPVDDDLNMKSVVEYFQEIYGFTIQHTHLPCLQVGNQKKANYLPMEACKIVEGQRYSKRLNEKQITSLLKVTCQRPRDKENDILQTVHHNSYDQDPYAKEFGLNISESMASVEARILPAPWLKYHDTGKEKDCLPLVGQWNMMNKKMINGSTVSRWACINFSRSVQESVARTFCHELAQMCQVSGMEFNPEPVIPIYTARADQVEKALKHVCHASVNKLKGKELDLVIAILPDNNGSLYGDIKRICETDLGLISQCCLTKHVFKINKQYLANVSLKINVKTGGRNTVLMDALSCRIPLVSDIPTIIFGADVTHPENGEDSSPSIAAVVASQDWPEVTKYAGLVCAQAHRQELIQDLYKTWHDPVRGTVNGGMIRDLLISFRKATGQKPQRIIFYRDGVSEGQFYQVLLYELDAIRKACASLEPNYQPPVTFIIVQKRHHTRLFANNHKDRSSVDKSGNILPGTVVDTKICHPTEFDFYLCSHAGIQGTSRPAHYHVLWDENNFTPDGIQSLTNNLCYTYARCTRSVSVVPPAYYAHLAAFRARFYLEPTSNDDDLAGQVGRSTWTGGCGVRPLPALKENVKRVMFYC

SEQ ID NO: 4535 - protein, 432 aa, Tabernaemontana elegans
PKQVKMGKGPPSQDPQNTKLHNQTSPPSRNRGRRRGRGGRKSDQSDVFMRPSSRPCTGANKPVVGEPAGAVEVTARNGCAENGKDGLSVASVPFPSSSKALSFTPRPGYGQLGTRCIVKANHFFVDLPDKDLNQYDVTITPEVASRAVNRSIIAELVKLYKESDLGRRLPAYDGRKSLYTAGELPFALKEFTIKLIDEEDGINGPKREREYKVVIKFVARANLHQLGQFLAGKRADGPQEALQILDIVLRELSMKRYCPVGRSFFSPDIRRPQRLGDGLEAWCGFYQSIRPTQMGLSLNIDMASAAFIEALPVIDFVAQLLGKDALSRQLSDSDRVKIKKALRGVKVEVTHRGNVRRKYRVSGLTSQPTRELVFPVDDNSTMKSVVEYFQEMYGFTIQYTHLPCLQVGNQKRLTTYQWRHVKLLRANAIQKG

SEQ ID NO: 4536 - protein, 960 aa, Petroselinum crispum
MPIRQLKEGSEQHLVIKPHLNNSVNQVQKQLKTARNGKSPPGQENQNAKAHNQSSPPSKSRGRRRGRGGRKSDQGDACMRPSTRPCTAEYSPVAQVSARSGAAVEVHNSNLGTLCEVGRNFPSSSKSLSFAQRPGYGQLGTKCVVKANHFFAELPEKDLNHYDVSITPEVSSRNMNRAIMAELVKLYKESDLGMRLPAYDGRKSLYTAGELPFAWKEFDIKLTDEDDGVNGPKRVREYKVVIKFVARANLHHLGQFLAGKRADAPQEALQILDIVLRELSNKRYCPVGRSFFSPNIRKPQRLGEGLESWCGFYQSIRPTQMGLSLNIDMASAAFIEALPVIEFVAQLLGKDVLTKTLSDSDRVKIKKALRGLKVEVTHRGHIRRKYRVSGITSQPTRELVFPVDDNSNMKSVVEYFQEMYGFTIQHTHLPCLQVGNQRKANYLPLEACKIVEGQRYTKRLNEKQITALLKVTCQRPRDREHDILQTVQHNAYDQDPYAKEFGMNISEKLASVEARVLPAPWLKYHENGKEKDCLPQVGQWNMMNKKMINGMTVSRWACINFSRSVQENVARGFCSELARMCQVSGMEFNPEPVIPIYTAWPDDVEKALKHVYHASVNKLKGKDLELLLAILPDNNGSLYGDLKRICETDLGLISQCCLTKYVFKISKQYLANVSLKINVKMGGRNTVLLDAISCRIPLVSDIPTIIFGADVTHPENGEDSSPSIAAVVASQDWPEVTKYAGLVCAQAHRQELIQDLYKTWQDPARGTVSGGMIRDLLVSFRKATGQKPLRIIFYRDGVSEGQFYQVLLFELDAIRKACASLEPNYQPPVTFIVVQKRHHTRLFANNHRNRSSTDKSGNILPGTVVDTKICHPTEFDFYLCSHAGIQGTSRPAHYHVLWDENNFTADGIQSLTNNLCYTYARCTRSVSVVPPAYYAHLAAFRARFYLEPELQENGCGVGQG

SEQ ID NO: 4537 - protein, 923 aa, Citrullus lanatus
MPVRQMKESSEQHLVIKTHLQNSVQKPPKSTQNGKGPPNLEHQNIKSRNPSSPPSKSRGRRRSRGGRKSDQGEVFMRPSSRPCTVARKPDEPEFNAGALVASTNPNGGNISGMQMGFRNSSKSLSFAPRPGFGQVGTKCIVKANHFFAELPDKDLNQYDVTITPEVASRTVNRAIMAELVRLYRESDLGKRLPAYDGRKSLYTAGELPFVWKEFDIKLVDEEDGVSGPKREREYKVVIKFVARANLHHLGQFLAGKRADAPQEALQILDIVLRELSSKRYCPIGRSFFSPDIRSPQRLGDGLESWCGFYQSIRPTQMGLSLNIDMASAAFIEPLPVLEFVAQLLGKVVWSRPLSDADRVKIKKALRGVKVEVTHRGNVRRKYRVSGLTSQPTRELVFPVDDNSTMKSVVEYFQEMYGFTIQHAHLPCLQVGNQKKANYLPMEACKIVGGQRYTKRLNEKQITALLKVTCQRPRDRENDILQTVQHNAYDNDPYAKEFGIKISEKLASVEARILPPPWLKYHDTGKEKDCLPQVGQWNMMNKKMINGMTVNRWACINFSRSVQESVARGFCSELAQMCQVSGMEFNPEPVIPIYNARPEQISKQYLANVSLKINVKMGGRNTVLLDAISCRIPLVSDIPTIIFGADVTHPENGEDSSPSIAAVVASQDWPEVTKYAGLVCAQAHRQELIQDLYKTWQDPVRGTVSGGMIRDLLVSFRKATGQKPLRIIFYRDGVSEGQFYQVLLYELDAIRKACASLEPNYQPPVTFIVVQKRHHTRLFANNYRDRSSTDKSGNILPGTVVDSKICHPTEFDFYLCSHAGIQGTSRPAHYHVLWDENNFTADGIQSLTNNLCYTYARCTRSVSVVPPAYYAHLAAFRARFYMEPEMQENGSAGRSAKSTRTTGESGVRPLPALKENVKRVMFYC

SEQ ID NO: 4538 - protein, 936 aa, Brassica napus
HLLRRTKNRSRRRNRGGRKSDQGDVCMRPSSRPRKPPPQNAPVAAVSGTEIVAVNHQMQMGVRGSSKNSNFAPRPGFGQLGTKCIVKANHFLADLPTKDLSHYDVTITPEVSSKSVNRAIIAELVRLYKESELGSRLPAYDGRKSLYTAGELPFTWKEFAVKIFDEDDGIINGPRRERSYKVAIKFVARANMHHLGEFLAGKRADGPQEALQILDIVLRELSVKRFCPVGRSFFSPDIRTPQRLGEGLQSWCGFYQSIRPTQMGLSLNIDMASAAFIEPLPVIEFVAQLLGKDVLSKPLSDSDRIKIKKGLRGVKVEVTHRANVRRKYRVAGLTTQPTRELMFPVDENATMKSVIEYFQEMYGFTIQHTHLPCLQVGNQKKASYLPMEACKIVEGQRYTKRLNEKQITALLKVTCQRPRDRENDILKTVQHNAYDQDPYAKEFGMNISEKLASVEARILPAPWLKYHENGKEKDCLPQVGQWNMMNKKMINGMTVSRWACVNFSRSVQENVARGFCNELGQMCEVSGMEFNPEPVIPIYSARPDQVEKALKHVYHTAMNKTKGKELELLLAILPDNNGSLYGDLKRICETELGLISQCCLTKHVFKISKQYLANVSLKINVKMGGRNTVLLDAISCRIPLVSDIPTIIFGADVTHPENGEESSPSIAAVVASQDWPEVTKYAGLVCAQAHRQELIQDLYKTWQDPVRGTVSGGMIRDLLISFRKATGQKPLRIIFYRDGVSEGQFYQVLLYELDAIRKACASLEPNYQPPVTFIVVQKRHHTRLFANNHRDKSSTDRSGNILPGTVVDTKICHPTEFDFYLCSHAGIQGTSRPAHYHVLWDENNFTADGIQSLTNNLCYTYARCTRSVSVVPPAYYAHLAAFRARFYMEPEIMQDNGSPGKKNTKTTTVGDHGVVGGGVKPLPALKENVKRVMFYC

SEQ ID NO: 4539 - protein, 967 aa, Mimulus guttatus
MPMRQMKEASDHQHCVVMKPQLPPPPNTATKNPKTAQTGKGAAAPPPPLLPQEPQNQSPSPPSRNRGRRRGRGGRKSDQGEVFMRPSSRPCTAADKPGTRETGRVMIDPVPPNGSGTSFPCSSKSLTFPTRPGFGQLGTKCIVKANHFFAQLPDKDLNQYDVTITPEVASRAVNRAIIAELVKVYKESDLGKRLPAYDGRKSLYTAGELPFARKEFIVKLVDEEDTINGPKRVREYKVAIKFVARANLHHLEQFLAGKRADGPKEALQILDIVLRELSVKRFCPVGRSFFSPDIRKPQRLGDGLEAWCGFYQSIRPTQMGLSLNIDMASAAFIEALPVIEFVAQLLGKDVLSRPLSDSDRIKVKKALRGVKVEVTHRRDVRRKYRVCGITTQPTRELVFPVDDDSNMKSVVEYFQEMYGFTIQHTHLPCLQVGNQKKANYLPMEVRCCWLVKIVEGQRYTKRHVITVQHNAYEEDPYANEFGIKISEKMTSVEARVLPAPWLKYHDTGKEKDCLPQVGQWNMMNKKMINGMNVNRWACINFSRSVQDSVARGFCNELAQMCQVSGMEFNPEPVIPIYIARPDQVEKALKHVYHACTNKLKGKELELLLAILPDNNGSLYGDLKRICETDLGIISQCCLTKHVFKINKQYLANVSLKINVKMGGRNTVLLDAISCRIPLVSDIPTIIFGADVTHPENGEESSPSIAAVVASQDWPEVTKYAGLVCAQAHRQELIQDLYKTWQDPVRGTVSGGMIRDLLVSFRKATGQKPQRIIFYRDGVSEGQFYQVLLFELDAIRKACASLEPNYQPPVTFIVVQKRHHTRLFANNHRDKSSTDKSGNVLPGTVVDSKICHPTEFDFYLCSHAGIQGTSRPAHYHVLWDENNFTADGIQSLTNNLCYTYARCTRSVSVVPPAYYAHLAAFRARFYLEPDLPESGSGGGGKVGRVAGETGVRPLPALKENVKRVMFYC

SEQ ID NO: 4540 - protein, 417 aa, Cannabis sativa
SSSKSLSFARRPGFGQVGTKCIVKANHFFAQLPDKDLNQYDVTITPEVASRNVNRAIMAELVRLYKETDLGMRLPAYDGRKSLYTAGELPFTWKEFNVKLIEEEDAVHGPKRERHYKVVLKFVAKANLHHLGQFLAGKRADAPQEALQILDIVLRELSNKRYCPVGRSFFSPDIRVPQRLGEGLESWCGFYQSIRPTQMGLSLNIDMASAAFIEPLPVIEFVGQLLGKDVLSRPLSDADRIKIKKALRGVKVEVTHRANIRRKYRVSGLTSQPTRELVFPVDENSTMKSVVEYFQEMYGFTIQHGHLPCLQVGNQKKANYLPMEACKIVEGQRYSKRLNEKQITALLKVTCQRPKDREQDILKTVEHNAYDQDPYAKEFGIRISEKLASVEARILPAPWLKYHDTGKEKNCLPQVGQ

SEQ ID NO: 4541 - protein, 1011 aa, Brassica oleracea
MCRLDKDKKRSVFCFIHSFCSGNRKREERMPIRPMKETSETHLLIKPKHLPKAVQNAKAPPTPATTTAAAQSQASSPSPPSKNRSRRRNRGGRKSDQGDVCMRPSSRPRKPPPQNAPVAAVSGTEIVAVNHQMQMGVRGSSKNSNFAPRPGFGQLGTKCIVKANHFLADLPTKDLSHYDVTITPEVSSKSVNRAIIAELVRLYKESELGSRLPAYDGRKSLYTAGELPFTWKEFAVKIFDEDDGIINGPRRERSYKVAIKFVARANMHHLGEFLAGKRADGPQEALQILDIVLRELSVKRFCPVGRSFFSPDIRTPQRLGEGLQSWCGFYQSIRPTQMGLSLNIDMASAAFIEPLPVIEFVAQLLGKDVLSKPLSDSDRIKIKKGLRGVKVEVTHRANVRRKYRVAGLTTQPTRELMFPVDENATMKSVIEYFQEMYGFTIQHTHLPCLQVGNQKKASYLPMEACKIVEGQRYTKRLNEKQITALLKVTCQRPRDRENDILKTVQHNAYDQDPYAKEFGMNISEKLASVEARILPAPWLKYHENGKEKDCLPQVGQWNMMNKKMINGMTVSRWACVNFSRSVQENVARGFCNELGQMCEVSGMEFNPEPVIPIYSARPDQVEKALKHVYHTAMNKTKGKELELLLAILPDNNGSLYGDLKRICETELGLISQCCLTKHVFKISKQYLANVSLKINVKMGGRNTVLLDAISCRIPLVSDIPTIIFGADVTHPENGEESSPSIAAVVASQDWPEVTKYAGLVCAQAHRQELIQDLYKTWQDPVRGTVSGGMIRDLLISFRKATGQKPLRIIFYRDGVSEGQFYQVLLYELDAIRKACASLEPNYQPPVTFIVVQKRHHTRLFANNHRDKSSTDRSGNILPGTVVDTKICHPTEFDFYLCSHAGIQGTSRPAHYHVLWDENNFTADGIQSLTNNLCYTYARCTRSVSVVPPAYYAHLAAFRARFYMEPEIMQDNGSPGKKNTKTTTVGDHGVVGGGVKPLPALKENVKRVMFYC

SEQ ID NO: 4542 - protein, 299 aa, Arabidopsis lyrata
MASSSDHTAKIIDGKAIAHTIRSEIAEEVRGLSEKHGKVPGLAVVIVGNRKDSQTYVNTKRKACAEVGIKSFDVGLPEEVSEADLISKVHELNSNPDVHGILVQLPLPKHINEENVLGAISIDKDVDGFHPLNIGKLAMKGREPLFLPCTPKGCLELLARSGVKIKGQRAVVVGRSNIVGLPVSLLLLKADATVTTVHSHTKDPEAFIREADIVIAACGQAHMIKGNWIKPGAAVIDVGTNAVSDPSKKSGYRLVGDVDFAEASKVAGFITPVPGGVGPMTVAMLLRNTVDGAKRVFGE

SEQ ID NO: 4543 - protein, 299 aa, Eutrema parvulum
MASQSDQTAKKIDGKAIADTIRSEIAEEVRDLSEKHGKVPGLAVVIVGVRKDSQTYVNMKRKACAEVGIKSFDVDLPEDVCEADLISKVHELNSDPDVHGILVQLPLPKHINEENVLGAISIDKDVDGFHPLNIGKLAMKGREPLFLPCTPKGCLELLVRSGIKIKGQRAVVVGRSNIVGLPVSLLLLKADATVTTVHSHTKDPEAIIREADIVIAAAGQACMIKGNWIKPGAAVIDVGTNAVSDQSRKSGYRLVGDVDFAEASKVAGFITPVPGGVGPMTVAMLLRNTLDGAKRVIGQ

SEQ ID NO: 4544 - protein, 299 aa, Eutrema halophilum
MASPSDQTAKIIDGKAIAHTIRSEIAEEVRDLSEKHGKVPGLAVVIVGVRKDSQTYVNMKRKACAEVGIKSFDVDLPEDVCEADLINKVHELNSDPEVHGILVQLPLPKHINEENVLGAISIDKDVDGFHPLNIGKLAMKGREPLFLPCTPKGCLELLVRSGIKIKGQRAVVVGRSNIVGLPVSLLLLKADATVTTVHSHTKDPESIIREADIVIAAAGQACMIKGDWIKPGAAVIDVGTNAVSDPSRKSGYRLVGDVDFAEASKVAGFITPVPGGVGPMTVAMLLRNTLDGAKRVIGQ

SEQ ID NO: 4545 - protein, 300 aa, Brassica oleracea
MASSPSDQTAKIIDGKAVAHTIRSEIAEEVRHLSEKHGKVPGLAVVIVGLRKDSQTYVNMKRKACAEVGIKSFDVDLPEDVPEADLITKVHELNSDPQVHGILVQLPLPKHINEENVLGAISIDKDVDGFHPLNIGKLAMKGREPLFLPCTPKGCLELLVRSGIKIKGQRAVVVGRSNIVGLPVSLLLLKADATVTTVHSHTKDPEAIIKEADIVIAAAGQACMIKGDWIKPGAAVIDVGTNAVSDPSRKSGYRLVGDVDFAEASKVAGFITPVPGGVGPMTVAMLLRNTLDGAKRVIGQ

SEQ ID NO: 4546 - protein, 300 aa, Brassica rapa
MASSPSDQTAKIIDGKAVAHTIRSEIAEEVRHLSEKHGKVPGLAVVIVGGRKDSQTYVNMKRKACAEVGIKSFDVDLPEDVPEADLITKVHELNSDPQVHGILVQLPLPKHINEENVLGAISIDKDVDGFHPLNIGKLAMKGREPLFLPCTPKGCLELLVRSGIKIKGQRAVVVGRSNIVGLPVSLLLLKADATVTTVHSHTKDPEAIIKEADIVIAAAGQACMIKGDWIKPGAAVIDVGTNAVSDPSRKSGYRLVGDVEFAEASKVAGFITPVPGGVGPMTVAMLLRNTLDGAKRVIGQ

SEQ ID NO: 4547 - protein, 300 aa, Brassica napus
MASSPSDQTAKIIDGKAVAHTIRSEIAEEVRHLSEKHGKVPGLAVVIVGVRKDSQTYVNMKRKACAEVGIKSFDVDLPEDVPEADLITKVHELNSDPQVHGILVQLPLPKHINEENVLGAISIDKDVDGFHPLNIGKLAMKGREPLFLPCTPKGCLELLVRSGIKIKGQRAVVVGRSNIVGLPVSLLLLKADATVTTVHSHTKDPEAIIKEADIVIAAAGQACMIKGDWIKPGAAVIDVGTNAVSDPSRKSGYRLVGDVEFAEASKVAGFITPVPGGVGPMTVAMLLRNTLDGAKRVIGQ

SEQ ID NO: 4548 - protein, 298 aa, Brassica oleracea
MASSDQTAKIIDGKAIAHTIRSEIAEEVRDLSEKHGKVPGLAVVIVGARKDSQTYVNMKRKACAEVGIKSVDVDLPEDVSEADLISKVHQLNSDPDVHGILVQLPLPKHINEENVLSAISIDKDVDGFHPLNIGKLAMKGREPLFLPCTPKGCLELLKRSGVKIKGQRAVVVGRSNIVGLPVSLLLLKADATVTTVHSHTKDPEAIIREADIVIAAAGQACMIKSDWIKPGAAVIDVGTNAVSDPSRKSGYRLVGDVDYAEACKVAGCITPVPGGVGPMTVAMLLRNTLDGAKRVIGQ

SEQ ID NO: 4549 - protein, 298 aa, Brassica napus
  Sequence also found in Organisms: Brassica oleracea
MASSDQTAKIIDGKAIAHTIRSEIAEEVRDLSEKHGKVPGLAVVIVGVRKDSQTYVNMKRKACAEVGIKSVDVDLPEDVSEADLISKVHQLNSDPDVHGILVQLPLPKHINEENVLSAISIDKDVDGFHPLNIGKLAMKGREPLFLPCTPKGCLELLKRSGVKIKGQRAVVVGRSNIVGLPVSLLLLKADATVTTVHSHTKDPEAIIREADIVIAAAGQACMIKSDWIKPGAAVIDVGTNAVSDPSRKSGYRLVGDVDYAEACKVAGCITPVPGGVGPMTVAMLLRNTLDGAKRVIGQ

SEQ ID NO: 4550 - protein, 299 aa, Brassica juncea
MASPSDQTAKIIDGKAIAHTIRSEIAEEVRDLSEKHGKVPGLAVVIVGARKDSQTYVTMKRKACAEVGIKSVDVDLPEDVSEADLISKVHELNSDPDVHGILVQLPLPKHINEENVLSAISIDKDVDGFHPLNIGKLAMKGREPLFLPCTPKGCLELLKRSGVKIKGQRAVVVGRSNIVGLPVSLLLLKADATVTTVHSHTKDPEAIIREADIVIAAAGQACMIKREWIKPGAAVIDVGTNAVSDTSRKSGYRLVGDVDYAEACKVAGCITPVPGGVGPMTVAMLLRNTLDGAKRVIGQ

SEQ ID NO: 4551 - protein, 298 aa, Brassica napus
  Sequence also found in Organisms: Brassica rapa
MASSDQTAKIIDGKAIAHTIRLEIAEEVRDLSEKHGKVPGLAVVIVGARKDSQTYVTMKRKACAEVGIKSVDVDLPEDVSEADLISKVHQLNSDPDVHGILVQLPLPKHINEENVLSAISIDKDVDGFHPLNIGKLAMKGREPLFLPCTPKGCLELLKRSGVKIKGQRAVVVGRSNIVGLPVSLLLLKADATVTTVHSHTKDPEAIIREADIVIAAAGQACMIKSDWIKPGAAVIDVGTNAVSDPSRKSGYRLVGDVDYAEACKVAGCITPVPGGVGPMTVAMLLRNTLDGAKRVIGQ

SEQ ID NO: 4552 - protein, 300 aa, Brassica oleracea
MASSPSDQTAEIIDGKAVAHTIRSEIAVEVRHLSEKHGKVPGLAVVIVGLRKDSQTYVNMKRKACAEVGIKSFDVDLPEDVPEADLITKVHELNSDPQVHGILVQLPLPKHINEENVLGAISIDKDVDGFHPLNIGKLAMKGREPLFLPCTPKGSLELLVRSGIKIKGQRAVVVGRSNIVGLPVSLLLLKADATVTTVHSHTKDPEAIIKEADIVIAAAGQACMIKGDWIKPGAAVIDVGTNAVSDPCRKSGYRLVGDVDFAEASKVAGFITPVPGGVGPMTVAMLLRNTLDGAKRVIGQ

SEQ ID NO: 4553 - protein, 299 aa, Raphanus sativus
MASTSDQTAKIIDGKAIAHTIRSEIAEEVRLLSEKHGKVPGLAVVIVGVRKDSQTYVNMKRKACAEVGIKSFDVDLPDDVPEADLITKVHQLNSDPQVHGILVQLPLPKHINEENVLGAISIDKDVDGFHPLNIGKLAMKGREPLFLPCTPKGCLELLVRSGIKIKGQRAVVVGRSNIVGLPVSLLLLKADATVTTVHSHTNDPEAIIPEADIVIAAAGQACMIKGDWIKPGAAVIDVGTNAVSDPSRKSGYRLVGDVDFAEASKVAGFITPVPGGVGPMTVAMLLKNTLEGAKRVIGQ

SEQ ID NO: 4554 - protein, 298 aa, Raphanus sativus
MASSDQTAKIIDGKAIAQTIRSEIAEEVRDLSEKHGKVPGLAVVIVGARKDSQTYVTMKRKACAEVGIKSFDVDLPEDVSEADLITKVHLLNSDPDVHGILVQLPLPKHINEENVLSAISIDKDVDGFHPLNIGKLAMKGREPLFLPCTPKGCLELLVRSGIKIKGQRAVVVGRSNIVGLPVSLLLLKADATVTTVHSHTRDPEAIIREADIVIAAAGQPCMIKGDWIKPGAAVIDVGTNAVSDPSRKSGYRLVGDVDYAEACKVAGFITPVPGGVGPMTVAMLLRNTLDGAKRVIGQ

SEQ ID NO: 4555 - protein, 296 aa, Brassica napus
PSDQTAEIIDGKAVAHTIRSEIAVEVRHLSEKHGKVPGLAVVIVGLRKDSQTYVNMKRKACAEVGIKSFDVDLPEDVPEADLITKVHELNSDPQVHGILVQLPLPKHINEENVLGAISIDKDVDGFHPLNIGKLAMKGREPLFLPCTPKGSLELLVRSGIKIKGQRAVVVGRSNIVGLPVSLLLLKADATVTTVHSHTKDPEAIIKEADIVIAAAGQACMIKGDWIKPGAAVIDVGTNAVSDPCRKSGYRLVGDVDFAEASKVAGFITPVPGGVGPMTVAMLLRNTLDGAKRVIGQ

SEQ ID NO: 4556 - protein, 185 aa, Brassica napus
SDQTAKIIDGKAVAHTIRSEIADEVRHLSEKHGKVPGLAVVIVGLRKDSQTYVNMKRKACAEVGIKSFDVDLPEDVPEADLITKVHELNSDPQVHGILVQLPLPKHINEENVLGAISIDKDVDGSILEYGKLAMKGREPLFLPCTPKGCLELLVRSGIKIKGQRAVVVGRSNIVGLSCFASTAQG

SEQ ID NO: 4557 - protein, 299 aa, Cleome gynandra
MASAMDQTAKIIDGKAIAEAIRLEIAGEVRCLSEKHGKVPGLAVVIVGSRKDSQSYVRMKRKACVEVGIKSIDVDLPEEVSEADLISKVHELNSNPDVHGILVQLPLPKHINEENVLGAIVIEKDVDGFHPLNIGKLAMKGREPLFLPCTPKGCLELLIRSGIKIKGQRAVVVGRSNIVGLPVSLLLLKADATVTVVHSHTQDSERIIREADIIIAAAGQAAMIKGSWIKPGAAVIDVGTNAVDDPSKKAGYRLVGDVDYKEACKVAGCITPVPGGVGPMTVAMLLKNTLDGAKRVVGE

SEQ ID NO: 4558 - protein, 299 aa, Citrus clementina
  Sequence also found in Organisms: Citrus sinensis
MAAPSDQKATIIDGKAVAQTIRSEIAEEVRLLSEKYGKVPGLAVVIVGGRKDSQSYVSMKRKACAEVGIKSFDIDLPEQVSEAELISKVHELNVMPDVHGILVQLPLPKHINEEKVLGEISLEKDVDGFHPLNIGKLAMKGRDPLFLPCTPKGCLELLKRSGVTIKGKRAVVVGRSNIVGLPVSLLLLKADATVTIVHSHTTDPESIVREADIVIAAAGQAMMIKGSWIKPGAAVIDVGTNAVDDSTKKSGYRLVGDVDFHEACKVAGCVTPVPGGVGPMTVAMLLRNTLDGAKRVIEL

SEQ ID NO: 4559 - protein, 299 aa, Tabernaemontana elegans
MASPPDHKATIIDGKAIAQTIRSEIASDVRLLSQKYGKVPGLAVVIVGNRKDSQSYVNMKRKACAEVGIKSFDVDLPEEVSEADLIHKVHELNTNPDVHGILVQLPLPKHINEEKVLGEISLDKDVDGFHPLNIGKLAMKGREPLFLPCTPKGCLELLSRNGVTIRGKKAAVVGRSNIVGLPVALLLLKEDATVTIVHSRTKEPESIIREADIVIAAAGQAMMIKGSWIKPGAAVIDVGTNAVDDPTKKSGYRLVGDVDFHEACKVAGCITPVPGGVGPMTVAMLLKNTLDGAKRVIEQ

SEQ ID NO: 4560 - protein, 301 aa, Eucalyptus grandis
MASSLPSDHKAQIIDGKAIAQTIRSEIASEVSHLSQKYGKVPGLAVVIVGTRKDSQSYVSMKRKACAEVGITSFDVDLPEQVSEADLIDKVHELNANPDVHGILVQLPLPKHINEEKVLGAISIEKDVDGFHPLNIGKLAMKGREPLFLPCTPKGCLELLSRSGISTKGKKAVVVGRSNIVGLPVSLLLLKADATVTVVHSHTPNPESIIREADIIIAAAGQAMMIKGSWIKPGAAVIDVGTNAVDDPSKKTGYRLVGDVHFGEASKVAGHITPVPGGVGPMTVAMLLKNTLEGAKREIEK

SEQ ID NO: 4561 - protein, 299 aa, Theobroma cacao
MASPSDHKATIIDGKAIAQTIRSEIADEVQHLFQKYGKVPGLAVVIVGGRKDSQSYVGMKRKACAEVGIKSFDVDLPEEVPESELISKVHELNANRDVHGILVQLPLPKHINEEKVLSEISLAKDVDGFHPLNIGKLAMKGREPLFQPCTPKGCLELLARSGISIKGKNAVVVGRSNIVGLPVSLLLLKADATVTIVHSRTPDPERLVREADIIIAAAGQAMMIKGSWIKPGAAVIDVGTNAVDDPSKKSGYRLVGDVDFHEACKVAGWITPVPGGVGPMTVAMLLRNTLDGAKRVIEQ

SEQ ID NO: 4562 - protein, 299 aa, Catharanthus roseus
MASPPDQKATIIDGKAIAQTIRSEIASEVRLLSEKYSKVPGLAVVIVGNRKDSQSYVSMKRKACAEVGIKSFDIDLPEEVSEADLIHKVHELNANPDVHGILVQLPLPKHINEENVLGEISLEKDVDGFHPLNIGKLAMKGREPLYLPCTPKGCLELLFRSGITIKGKKAVVVGRSNIVGLPVSLLLLKEDATVTVVHSRTKDPESIIREADIVIAAAGQAMMIKGSWIKPDAAVIDVGTNAVDDPTRKSGYRLVGDVDFKEACKVAGYITPVPGGVGPMTVAMLLKNTLDGARRVIEQ

SEQ ID NO: 4563 - protein, 299 aa, Heritiera littoralis
MASPSDHKATIIDGKAIAQTVRSEIADEVRQLSQKYGKVPGLAVVIVGNRKDSQSYVGMKRQACAEVGIKSFDVDLPEEVPEPELISKVHDLNANPDVHGILVQLPLPKHINEEKVLSAISLEKDVDGFHPLNIGKLAMKGREPLFHPCTPKGCLELLSRSGISIKGKKAVVVGRSNIVGLPVSLLLLKADATVSIVHSHTPDPETLIHEADIVIAAAGQPMMIKGSWIKPGAAVIDVGTNAVDDPTKKSGYRLVGDVDFQEACKVAGWITPVPGGVGPMTVAMLLRNTVDGAKRVIEK

SEQ ID NO: 4564 - protein, 299 aa, Euphorbia esula
MASPSDHKATIIDGKAIAQTIRSEIANEVRQLSQKYGKVPGLAVVIVGNRKDSQSYVNMKRKACAEVGIKSLDVDLPEQISEAELIGKVHELNANPDVHGILVQLPLPKHINEEKVLSAISIEKDVDGFHPLNIGKLAMKGREPLFLPCTPKGCLELLSRSGIEIKGKKAVVVGRSNIVGLPVSLLLLKADATVTIVHSRSEDQESIIREADIIIAAAGQAMMIKGSWIKPGAAVIDVGTNAIDDPSKKAGYRLVGDVDYKEACKVAGWITPVPGGVGPMTVAMLLNNTLDGAKREFEH

SEQ ID NO: 4565 - protein, 299 aa, Ricinus communis
MAAPSDHKATIIDGKAIAQTIRSEIADEVRQLSEKYGKVPGLAVVIVGNRKDSQSYVSMKRKACAEVGIKSFDINLPEQVSEAELISKVHELNANTDVHGILVQLPLPKHINEEKVLSEISIEKDVDGFHPLNIGKLAMKGREPLFLPCTPKGCLELLSRSGISIKGKKAVVVGRSNIVGLPVSLLLLKADATVSIVHSRTEDPERIICEADIIIAAAGQPMMIKGSWIKPGAAVIDVGTNAVDDPSKKSGYRLVGDVDYKEACNVAGWITPVPGGVGPMTVAMLLKNTLDGAKREFMQ

SEQ ID NO: 4566 - protein, 299 aa, Capsicum annuum
MASPSDHKAAIIDGKAIAQTIRSEIASEVKLLSEKYGKVPGLAVVIVGNRKDSQSYVNMKRKSCTELCIKSFDVDLPEEVAEAELISKVHELNANPDVHGILVQLPLPKHINEEKVLGEISLEKDVDGFHPLNIGKLAMKGRQPLFLPCTPKGCIELLVRSGITIKGKNAVVVGRSNIVGLPVSLLLLKEDATVTIVHSRTKEPEKIIREADIIIAAAGQAMMIKGSWIKPGAAVIDVGTNAVDDPSRKSGYRLVGDVDFQEACKVAGWITPVPGGVGPMTVAMLLKNTLDGAKRVIDK

SEQ ID NO: 4567 - protein, 299 aa, Gossypium hirsutum
MASPSDCKATIIDGKAIAQTIRSEIADEVRHLSQKYGKVPGLAVVIVGNRKDSQSYVGMKRKACAEVGIRSFDVNLPEEVPESDLISKVHELNANPDVHGILVQLPLPKHINEEKVLGEISLEKDVDGFHPLNIGKLAMKGREPLFQPCTPKGCLELLSRSGVSVKGKNAVVVGRSNIVGLPVSLLLLKADATVSIVHSRTPDPERLVREADIVIAAAGQAMMIKGSWIKPGAAVIDVGTNAVDDPTKKSGYRLVGDVDFEAACRVAGWITPVPGGVGPMTVAMLLRNTLDGAKRVIEQ

SEQ ID NO: 4568 - protein, 299 aa, Amsonia hubrichtii
MASPPDHKATIIDGKAIAKTIRSEIAAEVRLLSQKHNKVPGLAVVIVGNRKDSQSYVSMKRKACAEVGIKSFDIDLPEEVSEVDLIHKVHELNANPDVHGILVQLPLPKHINEEKVLGEISLEKDVDGFHPLNIGKLAMKGREPLFLPCTPKGCLELLSRSGVTIKGKKAAVVGRSNIVGLPVALLLLKEDATVTVVHSRTEEPENIIREADIIIAAAGQAMMIKGSWIKPGAAVIDVGTNAVDDPTKKSGYRLVGDVDFHEACKVAGCITPVPGGVGPMTVAMLLKNTLEGAKRIIEQ

SEQ ID NO: 4569 - protein, 299 aa, Fagus grandifolia
MAAPLDHKASIIDGKAIAQTIRNEIAAEVHNLSQKHGKVPGLAVVIVGTRKDSQSYVSMKRKACAEVGIKSFDVDLPEQVSEAELVAKVHELNANPDVHGILVQLPLPKHINEEKVLTEIIIEKDVDGFHPLNIGKLAMKGREPLFLPCTPKGCLELLSRSGITIKGKKAVVVGRSNIVGLPVSLLLLKADATVTVVHSHSQDPERIIREADIIIAAAGQAMMVKGSWIKPGAAVIDVGTNAIDDPSKKSGYRLVGDVDFKEASKVAGWITPVPGGVGPMTVAMLLKNTLEGAKRVIEH

SEQ ID NO: 4570 - protein, 299 aa, Centaurea maculosa
MSLPVDHKANIIDGKAIAQTIRSEIASEVSNLIEKYGKAPGLAVVIVGHRKDSQSYVNMKRKACAEVGIKSIDIDLPEQVPEDELIAKVHELNEDPDVHGILVQLPLPKHINEEKVLTAISIEKDVDGFHPLNIGKLAMKGREPLFLPCTPKGCIELLKRSGITIKGKRAVVVGRSNIVGLPVSLLLLKADATVTTVHSHTVDPETIIREADIVVAAAGQAMMIKGSWIKPGAAVIDVGTNAVDDPSRKSGYRLVGDVDFQEACEVAGCITPVPGGVGPMTVAMLLKNTLDGAKRVIGK

SEQ ID NO: 4571 - protein, 299 aa, Centaurea maculosa
MSLPVDHKANIIDGKAIAQTIRSEIALEVSTLIEKYGKAPGLAVVIVGHRKDSQSYVNMKRKACAEVGIKSIDIDLPEQVPEDELIAKVHELNEDPDVHGILVQLPLPKHINEEKVLTAISIEKDVDGFHPLNIGKLAMKGREPLFLPCTPKGCIELLKRSGITIKGKRAVVVGRSNIVGLPVSLLLLKADATVTTVHSHTVDPETIIREADIVVAAAGQAMMIKGSWIKPGAAVIDVGTNAVDDPSRKSGYRLVGDVDFQEACEVAGCITPVPGGVGPMTVAMLLKNTLDGAKRVIGK

SEQ ID NO: 4572 - protein, 299 aa, Cirsium arvense
MSLPVDHKANIIDGKAIAQTIRSEIASEVSTLIEKYGKAPGLAVVIVGHRKDSQSYVNMKRKACAEVGIKSIDIDLPEQVPEDELIAKVHELNEDPDVHGILVQLPLPKHINEEKVLTAISIEKDVDGFHPLNIGKLAMKGREPLFLPCTPKGCIELLKRSGITIKGKRAVVVGRSNIVGLPVSLLLLKADATVTTVHSHTVDPETIIREADIVVAAAGQAMMIKGSWIKPGAAVIDVGTNAVDDPSRKSGYRLVGDVDFQEACEVAGCITPVPGGVGPMTVAMLLKNTLDGAKRVIGK

SEQ ID NO: 4573 - protein, 296 aa, Sesamum indicum
MSDHKATLIDGKAIAQTIRSEIAAEVCRLSETYGKVPGLAVVIVGKRKDSQSYVNMKRKACAEVGIKSVDLDLPEEVSESELISKVHELNANPDVHGILVQLPLPKHINEEKILSEISLDKDVDGFHPLNIGKLAMKGRDPLFVPCTPKGCLELLSRSGVSVKGKNAVVVGRSNIVGLPVSLLLLKEDATVTIVHSRTKEPESIVRSADIVIAAAGQAMMIKGSWIKPGAAVIDVGTNAVDDPSKKSGYRLVGDVDFQEASKVAGWITPVPGGVGPMTVAMLLKNTLDGAKRVIEQ

SEQ ID NO: 4574 - protein, 300 aa, Amaranthus tuberculatus
MAATSDEKKATLIDGKAIAQTIRSEIADDVRLLSEKYGKVPGLAVVIVGNRKDSQSYVNMKRKACAEVGIKSIDVDLPEQVPEPELIAKVHELNDNPEVHGILVQLPLPKHINEEKVLSEISIEKDVDGFHPLNIGKLAMKGREPLFQPCTPKGCLELLSRSGISVKGKKAVVVGRSNIVGLPVSLLLLKADATVSIVHSRTTDPENIIREADIVIAAAGQAMMIKGEWLKPGAAVIDVGTNAVDDPSKKSGYRLVGDVDFHGASKVAGWITPVPGGVGPMTVAMLLRNTVDGAKRVIEQ

SEQ ID NO: 4575 - protein, 280 aa, Brassica napus
MGRRSLTHKRNDLSEKHGKVPGLAVVIVGARKDSQTYVNMKRKACAEVGIKSFDVDLPEDVPEADLITKVHELNSDPEAHGILVQLPLPKHINEENVLGAISIDKDVDGFHPLNIGKLAMKGREPLFLPCTPKGCLELLVRSGIKIKGQRAVVVGRSNIVGLPVSLLLLKADATVTTVHSHTKDPEAIIKEADIVIAAAGQACMIKGDWIKPGAAVIDVGTNAVSDPCRKSGYRLVGDVDFAEASKVAGFITPVPGGVGPMTVAMLLRNTLDGAKRVIGQ

SEQ ID NO: 4576 - protein, 299 aa, Manihot esculenta
MASPSDHKATIIDGKAIAQTVRSEIADEVRQLSEKYGKVPGLAVVIVGNRKDSQSYVNMKRKACAEVGIKSFDIDLPEQISEAELISKVHELNANPDIHGILVQLPLPKHINEEKVLSEIHLEKDVDGFHPLNIGKLAMKGREPLFVPCTPKGCLELLSRSGISIKGKNAVVVGRSNIVGLPVSLLLLKADATVTIVHSRSDDQERIIRGADIIIAAAGQAMMIKGSWIKPGAAVIDVGTNAIDDPSKKSGYRLVGDVDYKEACKVAGWITPVPGGVGPMTVAMLLKNTLDGAKRVFMQ

SEQ ID NO: 4577 - protein, 299 aa, Centaurea maculosa
MSLPVDHKANIIDGKAIAQTIRSEIASEVSNLIEKYGKAPGLAVVIVGHRKDSQSYVNMKRKACAEVGIKSIDIDLPEQVPEDELIAKVHELNEDPDVHGILVQLPLPKHINEEKVLTAISIEKDVDGFHPLNIGKLAMKGREPLFLPCTPKGCIELLKRSGITIKGKRAVVVGRSNIVGLPVSLLLLKADATVTVVHSHTVDPETIIREADIVVAAAGQAMMIKGSWIKPGAAVIDVGTNAVDDPSRKSGYRLVGDVDFQEACEVAGCITPVPGGVGPMTVAMLLKNTLDGAKRVIGK

SEQ ID NO: 4578 - protein, 299 aa, Cirsium arvense
MSLPVDHKANIIDGKAIAQTIRSEIASEVSNLIEKYGKAPGLAVVIVGHRKDSQSYVNMKRKACAEVGIKSIDIDLPEQVPEDELIAKVHELNEDPDVHGILVQLPLPKHINEEKVLTAISIEKDVDGFHPLNIGKLAMKGREPLFLPCTPKGCIELLKRSGITIKGKRAVVVGRSNIVGLPVSLLLLKADATVTTVHSHTVDPETIIREADIVVAAAGQAMMIKGSWIKPGAAVIDVGTNAVDDPSRKSGYRLVGDVDFQEACEVAGCVTPVPGGVGPMTVAMLLKNTLDGAKRVIGK

SEQ ID NO: 4579 - protein, 299 aa, Gossypium hirsutum
  Sequence also found in Organisms: Gossypium raimondii
MASPSDRKATIIDGKAIAQTIRSEIADEVRHLSQKYGKVPGLAVVIVGNRKDSLSYVGMKRKACAEVGIRSFDMNLPEEVLESELISKVHELNANPDVHGILVQLPLPKHINEEKVLGEISLEKDVDGFHPLNIGKLAMKGREPLFQPCTPKGCLELLSRSGVSVKGKNAVVVGRSNIVGLPVSLLLLKADATVTIVHSRTPDPERLVREADIVIAAAGQAMMIKGSWIKPGAAVIDVGTNAVDDPTKRSGYRLVGDVDFEAACRVAGWITPVPGGVGPMTVAMLLRNTLDGAKRVIEE

SEQ ID NO: 4580 - protein, 299 aa, Panax ginseng
MAATSDQKATIIDGKAIAQTIRSEIASEVRLLSEKYSKVPGLAVVIVGSRKDSQSYVSMKRKACAEVGIKSFDIDLPEDVAEAELIAKVHELNANPDVHGILVQLPLPKHINEEKILTEISLEKDVDGFHPLNIGKLAMKGRDPLYLPCTPKGCLELLSRSGISIKGKKAVVVGRSNIVGLPVSLLLLKADATVTVVHSRTQDPERIIREADIVIAAAGQAMMIKGSWIKPGAAVIDVGTNAVDDPSRKSGYKLVGDVDFHEACKVAGWITPVPGGVGPLTVAMLLKNTLEGAKRVIEQ

SEQ ID NO: 4581 - protein, 299 aa, Prunus mume
MASQSDHKAAIIDGKAIAQTIRNEIAEEVRHLSQKYGKVPGLAVVIVGNRKDSQSYVSMKRKACAEVGILSLDIDLPEDVSQVDLIAKVHELNANPDVHGILVQLPLPKHINEEKVLSEISIEKDVDGFHPLNIGKLAMKGREPLFLPCTPKGCLELLSRSGISIKGKKAVVVGRSNIVGLPVSLLLLKADATVTVVHSHSHDPESIIREADIIIAAAGQAMMIKGSWIKPGAAVIDVGTNAIDDSSRKSGYRLVGDVDFQEACKVAGWVTPVPGGVGPMTVAMLLKNTLDGAKRVIAQ

SEQ ID NO: 4582 - protein, 299 aa, Prunus mume
MASQSDHKAAIIDGKAIAQTIRNEIAEEVRHLSQKYGKVPGLAVVIVGNRKDSQSYVSMKRKACAEVGILSLDIDLPEDVSQVDLIAKVHELNANPDVHGILVQLPLPKHINEEKVLSEISIDKDVDGFHPLNIGKLAMKGREPLFLPCTPKGCLELLSRSGISIKGKKAVVVGRSNIVGLPVSLLLLKADATVTVVHSHSHDPENIIREADIIIAAAGQAMMIKGSWIKPGAAVIDVGTNAIDDSSRKSGYRLVGDVDFQEACKVAGWVTPVPGGVGPMTVAMLLKNTLDGAKCVIAQ

SEQ ID NO: 4583 - protein, 299 aa, Fragaria vesca
MASQSEGQAKIIDGKTIAQTIRSEIAEEVHHLSQKYGKVPGLAVVIVGSRKDSQSYVSMKRKACAEVGIKSVDIDLPENVSLDDLIAKVHELNVNPDVHGILVQLPLPRHINEEKVLSEISIEKDVDGFHPLNIGKLAMKGREPLFLPCTPKGCLELLSRSGISIAGKKAVVVGRSNIVGLPVSLLLLKANATVTIVHSNTSDPETIIREADIIIAAVGQAMMIKGSWIKPGAAIIDVGTNAVDDSSKKSGYRLVGDVDFQEACKVAGWITPVPGGVGPMTVAMLLKNTLDGAKRVIAE

SEQ ID NO: 4584 - protein, 298 aa, Valeriana officinalis
MASSEHKATIIHGKLIAQTIRSEIASEVRILSDQYGKVPGLAVVIVGNRKDSQSYVNMKRKACAEVGIKSIDIDLPEQVPESELISKVHELNADPEVHGILVQLPLPKHINEENILTEISIEKDVDGFHPLNIGKLAMKGREPLFVPCTPKGCIELLSRSGITIKGKKAVVVGRSNIVGLPVSLLLLKADATVTVVHSHTKDPETIIREADIVIAAAGQASMIKGSWIKPGAAVIDVGTNSVDDPSKKSGYRLVGDVDYAEACKVAGWITPVPGGVGPMTVAMLLKNTLESAKRVFQN

SEQ ID NO: 4585 - protein, 301 aa, Platanus occidentalis
MSSSSSSDHQASIIDGKAIAQTIRSEIAAEVHHLLNKYGKVPGLAVVIVGSRKDSQSYVNMKRKACAEVGIKSFDVDLPEQVSEEDVIKKVHELNAHPDVHGILVQLPLPKHINEEKVLSEISIDKDVDGFHPLNIGKLAMKGREPLFLPCTPKGCLELLSRSGISVKGKRAVVVGRSNIVGLPVALLLLKADATVTIVHSHTHDSENIIRGADIVIAAAGQAMMIKGDWIKPGAAVIDVGTNAVDDPRKKSGYRLVGDVDFHEACKVAGWVTPVPGGVGPMTVAMLLKNTLDGAKHKMEQ

SEQ ID NO: 4586 - protein, 299 aa, Daucus carota
MASPSDHQATVIDGKAIAQTIRSEIASEVSILSEKYSKVPGLAVVIVGCRKDSQSYVSMKRKACAEVGIKSFDIDLPEDVPEAELIAKVDELNANPQVHGILVQLPLPKHINEEKILSQISLEKDVDGFHPLNIGKLAMKGRDPLFLPCTPKGCLELLSRSGISIKGKKAVVVGRSNIVGLPVSLLLLKADATVTVVHSRTPDPESYIREADIVIAAAGQAMMIKGSWIKPGAAVIDVGTNAVNDPSRKSGYRLVGDVDFQEACKVAGWITPVPGGVGPLTVAMLLQNTLEGAKRVIGQ

SEQ ID NO: 4587 - protein, 299 aa, Chrysanthemum coronarium
MALPVDHRAQIIDGKAIAQTIRDEIASEVSILVEKYGKAPGLAVVIVGHRKDSQSYVNMKRKACAEVGIKSIDIDLPEQVPEAELIAKVHELNADPEVHGILVQLPLPKHINEEKVLTEISIDKDVDGFHPLNIGKLAMKGRDPLFLPCTPKGCIELLKRSGVTIKGKRAVVVGRSNIVGLPVSLLLLKADATVTVVHSHTPDPECIIREADIVIAAAGQAMMIKGSWLKPGAAVIDVGTNAVDDASKKSGYRLVGDVDYQEGCKVAGCITPVPGGVGPMTVAMLLKNTLDGAKRVIGQ

SEQ ID NO: 4588 - protein, 299 aa, Cirsium arvense
MALPVDHKANIIDGKTIAQTIRSEIASEVSNLIEKYGKAPGLAVVIVGHRKDSQSYVNMKRKACAEVGIKSIDIDLPEQVPEAELIAKVHELNVDPNIHGILVQLPLPKHINEENVLTAISIEKDVDGFHPLNIGKLAMKGREPLFLPCTPKGCIELLKRSGITIKGKRAVVVGRSNIVGLPVSLLLLKADATVTIVHSHTVDSETIIREADIVIAAAGQAMMIKGSWIKPGAAVIDVGTNAVDDPSRKSGYRLVGDVDFQEACKVAEWITPVPGGVGPMTVAMLLKNTLDGAKRVIGK

SEQ ID NO: 4589 - protein, 299 aa, Fagopyrum esculentum
MATSSEHTASIIDGKAIAQTIRSELADEVRIMSSKFGRVPGLAVVIVGNRKDSQSYVNMKRKACAEVGIKSIDIDLPEQVSEAELIGKVHELNANPDVHGILVQLPLPKHINEEKVLGEISIEKDVDGFHPLNIGKLAMKGRDPLFQPCTPKGCLELLSRSGISVKGKKAVVVGRSNIVGLPVSLLLLKADATVTTVHSRTDEPEKHIREADIVIAAAGQPMMVRGDWLKPGAAVIDVGTNAVDDPTKKSGYRLVGDVHFAEACKVAGWITPVPGGVGPMTVAMLLRNTVDGAKRVIEN

SEQ ID NO: 4590 - protein, 299 aa, Ipomoea nil
MSSGSDHQATVIDGKAIAQTIRSEIASEIKVMLEKYGQVPGLAVVIVGNRKDSQSYVNMKRKSCAEVGIKSFDINLPEDVPEAELISKVHELNANPDVHGILVQLPLPKHINEEKVLGEISLEKDVDGFHPLNIGKLAMKGRDPLFLPCTPKGCLELLFRSGVTIKGKKAVVVGRSNIVGLPVSLLLLKEDATVTIVHSRTKDPESFIREADIVIAAAGQPMMIKGSWIKPGAAVIDVGTNAVDDPTKKSGYRLVGDVDFQEASKVAGCITPVPGGVGPLTVAMLLKNTLDGAKRVIEK

SEQ ID NO: 4591 - protein, 299 aa, Quercus alba
MASPSDHKANIIDGKAIAQTIRNEIAAEVHQLSQKHGKVPGLAVVIVGNRKDSQSYVNMKRKACAEVGIKSFDIDLPEQVSEAELIAKVDELNANPDVHGILVQLPLPKHINEEKVLTEISIEKDVDGFHPLNIGKLAMKGRDPLFLPCTPKGCLELLSRSGITVKGKKAVVVGRSNIVGLPVSLLLLKADATVTIVHSHSQDPEKVIREADIIIAAAGQAMMVKGSWIKPGAAVIDVGTNAIDDPSKKSGYRLVGDVHYQEACKVAGWITPVPGGVGPMTVAMLLKNTLDGAKRVIEH

SEQ ID NO: 4592 - protein, 293 aa, Chenopodium quinoa
MSAKIIDGKAIAQTIRSEIADEVRLLSQIHAKVPGLAVVIVGNRKDSQSYVNMKRKACAEVGIKSFDIDLPEQVSEPELIAKVHELNANPEVHGILVQLPLPKHINEENVLSEISIEKDVDGFHPLNIGKLAMKGRDPLFQPCTPKGCLELLSRSGISIKGKKAVVVGRSNIVGLPVSLLLLKADATISIVHSRTTDPESIIREADIVIAAAGQAMMIKGDWIKPGAAVIDVGTNAVDDPSKKSGYRLVGDVDFHEVSKVAGWITPVPGGVGPMTVAMLLRNTLDGAKRVIGQ

SEQ ID NO: 4593 - protein, 298 aa, Silene vulgaris
MSTPEHQAKLIDGKAIAQTIRSEIAIEVRQLSDTYAKVPGLAVVLVGERKDSQTYVNMKKKACAEVGIKSFEVELPEQVSESELISKVHDLNTNPEVHGILVQLPLPKHINEENVLSAISIEKDVDGFHPLNIGKLAMKGRHPLFEPCTPKGCIELLSRSGVTIKGKKAVVVGRSNIVGLPVALLLLKADATVSIVHSRTSDPEQIIREADIVIAAAGQAMMIKGDWIKPGAAVIDVGTNAIDDPSKKSGYRLVGDVDFHEASKVAGCITPVPGGVGPMTVAMLLRNTVDGAKRVIQK

SEQ ID NO: 4594 - protein, 300 aa, Vinca minor
MASAPEDQKATIIDGKAIAQTIRSEIADQVRLLSEKYNKVPGLAVVIVGSRKDSQSYVSMKRKACAEVGIKSFDIDLPEDVSEAAVIDKVHELNANPDVHGILVQLPLPKHINEEKVLSEISLEKDVDGFHPLNIGKLAMKGREPLFSPCTPKGCIELLSRSGITIKGKRAVVVGRSNIVGLPVSLLLLKEDATVTVVHSRTKEPENIIREADIVIAAAGQAMMIKGSWIKPGAAVIDVGTNAVEDPKKKSGYRLVGDVDFEEACKVAGYITPVPGGVGPMTVAMLLKNTFDGAKHVIEH

SEQ ID NO: 4595 - protein, 299 aa, Citrullus lanatus
MASESDHKATIIDGKAIAQTVRSEIAEEVNKLSEKYGKVPGLAVVIVGNRKDSLTYVTMKRKACAEVGIKSFEIDLPEKVSEAELISKVHELNANPEVHGILVQLPLPNHITEEKVLSEISIEKDVDGFHPLNIGKLAMKGRDPLFLPCTPKGCLELLSRSGISIRGKKAVVMGRSNIVGLPVSLLLLKADATVTIVHSRSVDPESVIREADIVIAAAGQAQLIKGSWIKPGAAVIDVGTNAVDDPTKKSGYRLVGDVDFQEACKVAGWITPVPGGVGPMTVAMLLRNTLDGAKRVIEQ

SEQ ID NO: 4596 - protein, 299 aa, Daucus carota
MASPSDHQATVIDGKAIAQTIRSEIASEVSILSEKYSKVPGLAVVIVGCRKDSQSYVSMKRKACAEVGIKSFDIDLPEDVPEAELIAKVDELNANPQVHGILVQLPLPKHINEEKILSQISLEKDVDGFHPLNIGKLAMKGRDPLFLPCTPKGCLELLSRSGISIKGKKAVVVGQSNIVGLPVSLLLLKADATVTVVHSRTPDPESYIREADIVIAAAGQAMMIKGSWIKPGAAVIDVGTNAVNDPSRKSGYRLVGDVDFQEACKVAGWITPVPGGVGPLTVAMLLQNTLEGAKRVIGQ

SEQ ID NO: 4597 - protein, 299 aa, Castanea mollissima
MASPSDHKAKIIDGKAIAQTIRNEIAAEVHQLSQKHGKVPGLAVVIVGNRKDSQSYVNMKRKACAEVGIKSFDIDLPEQVSEAELIAKVDELNANPDVHGILVQLPLPKHINEEKVLTEISIEKDVDGFHPLNIGKLAMKGRDPLFLPCTPKGCLELLSRSGITVKGKKAVVVGRSNIVGLPVSLLLLKADATVTIVHSHSQDPEKVIREADIIIAAAGQAMMVKGSWIKPGAAVIDVGTNAIDDPSKKSGYRLVGDVHYQEACEVAGWVTPVPGGVGPMTVAMLLKNTLDGAKRVIEH

SEQ ID NO: 4598 - protein, 299 aa, Ambrosia trifida
MALPVDHKANIIDGKLIAQTIRSEIASEVSVLVEKYGKAPGLAVVIVGHRKDSQSYVNMKRKACAEVGIKSIDIDLPEEVPEAELIAKVHELNADPDVHGILVQLPLPKHINEEKVLTEISIEKDVDGFHPLNIGKLAMKGRDPLFLPCTPKGCIELLKRSGVTIKGKRAVVVGRSNIVGLPVSLLLLKEDATVTVVHSRTEDPQSIIREADIVIAAAGQAMMIKGSWIKPGAAVIDVGTNAVDDSTRKSGYRLVGDVDFQEACKVAGWITPVPGGVGPMTVAMLLKNTLDGAKRVIGH

SEQ ID NO: 4599 - protein, 299 aa, Artemisia annua
MALPVDHKAHIIDGKAIAQTIRDEIASEVKILVEKYGKAPGLAVVIVGHRKDSQSYVNMKRKACAEVGIKSIDIDLPEQVPEAELIAKVHELNADPEVHGILVQLPLPKHINEEKVLTEISIDKDVDGFHPLNIGKLAMKGRDPLFLPCTPKGCIELLKRSGVIIKGKRAVVVGRSNIVGLPVSLLLLKADATVTVVHSRTPDPENIIREADIVIAAAGQAMMIKGSWLKPGAAVIDVGTNAVDDPSRKSGYRLVGDVDYQEGCKVAGCITPVPGGVGPMTVAMLLKNTLDGAKRVIGQ

SEQ ID NO: 4600 - protein, 299 aa, Cucurbita pepo
MASESEHKATIIDGKQIAQTVRSEIAEEVKKLSEKYGKVPGLAVVIVGSRKDSQSYVNMKRKACAEVGIKSFDYDLPEQVSEAELISKIHELNANPEVHGILVQLPLPKHINEEKVLSEINIEKDVDGFHPLNIGKLAMKGRDPLFLPCTPKGCLELLSRSGISIRGKKAVVMGRSNIVGLPVSLLLLKADATVTIVHSRSVNPESVIREADIVIAAAGQAQMIKGSWIKPGAAVIDVGTNAVDDPTRKSGYRLVGDVDFQEACKVAGWVTPVPGGVGPMTVAMLLRNTLDGAKRVIEQ

SEQ ID NO: 4601 - protein, 299 aa, Solanum melongena
MASPSDHKATIIDGKAIAQTIRSEIASEVQRLSEKYGKVPGLAVVIVGNRKDSQSYVNMKRKSCAELCIKSFDVDLPEDVAEAEVISKVHELNANPDVHGILVQLPLPKHINEEKVLCEISLEKDVDGFHPLNIGKLAMKGRQPLFNPCTPKGCIELLVRSGISIKGKNAVVVGRSNIVGLPVSLLLLKEDATVTIVHSRTKEPEKIIREADIIIAAAGQAMMIKGSWIKPGAAVIDVGTNAVDDPTRKSGYRLVGDVDFQEACKVAGWITPVPGGVGPMTVAMLLKNTLDGAKRVIEK

SEQ ID NO: 4602 - protein, 299 aa, Euphorbia peplus
MASPSDHKATIIDGKTIAQTIRSEIADEVRLLSQKYSKVPGLAVVIVGNRKDSQSYVNMKRKACAEVGIKSLDVDLPEQISETELIAKVHQLNANSDVHGILVQLPLPKHINEEKVLSAISIEKDVDGFHPLNIGKLAMKGREPLFLPCTPKGCLELLSRSGIDIKGKKAVVVGRSNIVGLPVSLLLLKADATVTIVHSRSEDQESIIREADIIIAAAGQAMMIKGSWIKPGAAVIDVGTNAVDDPTKKAGYRLVGDVDYKEACKVAGWITPVPGGVGPMTVAMLLKNTLDGAKREFEQ

SEQ ID NO: 4603 - protein, 293 aa, Chenopodium quinoa
MSAKIIDGKAIAQTIRNEIADEVRLLSQNHSKVPGLAVVIVGNRKDSQSYVNMKRKACAEVGIKSFDIDLPEQVSEPELIAKVHELNANPEVHGILVQLPLPKHINEENVLSEISIEKDVDGFHPLNIGKLAMKGRDPLFQPCTPKGCLELLSRSGISIKGKKAVVVGRSNIVGLPVSLLLLKADATISIVHSRTTDPESIIREADIVIAAAGQAMMIKGDWIKPGAAVIDVGTNAVDDPSKKSGYRLVGDVDFHEVSKVAGWITPVPGGVGPMTVAMLLRNTLDGAKRVIGQ

SEQ ID NO: 4604 - protein, 301 aa, Tropaeolum majus
MATEMSSDRKATKIDGKAIAQTIRSEIADEVKNLSTKYGKVPGLAVVIVGSRKDSQSYVGMKRKACAEAGIKSFDIDLPEDVSEADVICKVHELNANPDVHGILVQLPLPKHINEENVLGEISLVKDVDGFHPLNIGKLAMKGREPLFVPCTPKGCLELLSRSGISVRGKKAVVVGRSNIVGLPVSLLLLKADATVSIVHSRTPDPERIIREADIIIAAAGQAMMIKGSWIKPGAAVIDVGTNAVDDPSRKSGYRLVGDVDFKEASEVAGWITPVPGGVGPMTVAMLLKNTLDGAKRVIEQ

SEQ ID NO: 4605 - protein, 300 aa, Vinca minor
MASAPEDQKATIIDGKAIAKTIRSEVAAQVRQLSEKYNMVPGLAVVIVGSRKDSQSYVSMKRKACAEVGIKSFDIDLPEDVSEAAVIDKVHELNANPDVHGILVQLPLPKHINEEKVLSEISLEKDVDGFHPLNIGKLAMKGREPLFSPCTPKGCIELLSRSGITIKGKRAVVVGRSNIVGLPVSLLLLKEDATVTVVHSRTKEPENIIREADIVIAAAGQAMMIKGSWIKPGAAVIDVGTNAVEDPKKKSGYRLVGDVDFEEACKVAGYITPVPGGVGPMTVAMLLKNTLDGAKHVIEH

SEQ ID NO: 4606 - protein, 299 aa, Chrysanthemum coronarium
MALPVDHRAQIIDGKAIAQTIRDEIASEVSILVEKYGKAPGLAVVIVGHRKDSQSYVNMKRKACAEVGINSIDIDLPEQVPEAELIAKVHELNADPQVHGILVQLPLPKHINEEKVLTEISIDKDVDGFHPLNIGKLAMKGRDPLFLPCTPKGCIELLKHSGVTIKGKRAVVVGRSNIVGLPVSLLLLKADATVTVVHSHTPDPECIIREADIVIAAAGQAMMIKGSWLKPGAAVIDVGTNAVDDPSRKSGYRLVGDVDYQEGCKVAGCITPVPGGVGPMTVAMLLKNTLDGAKRVIGQ

SEQ ID NO: 4607 - protein, 299 aa, Chrysanthemum coronarium
MALPVDHRAQIIDGKAIAQTIRDEIASEVSILVEKYGKAPGLAVVIVGHRKDSQSYVNMKRKACAEVGIKSIDIDLPEQVREVELIVKVHELNADPEVHGILVQLPLPKHINEEKVLTEISIDKDVDGFHPLNIGKLAMKGRDPLFLPCTPKGCIELLKRSSVTIKGKRAVVVGRSNIVGLPVSLLLLKADATVTVVHSHTPDPESIIREADIVIAAAGQAMMIKGSWLKPGAAVIDVGTNAVDDPSRKSGYRLVGDVDYQEGCKVAGCITPVPGGVGPMTVAMLLKNTLDGAKRVIGQ

SEQ ID NO: 4608 - protein, 299 aa, Petroselinum crispum
MASPSDHQATVIDGKAIAQTIRSEIASEVTTLSQKYSKVPGLAVVIVGCRKDSQSYVSMKRKACAEVGIKSFDIDLPEDVPEVELIAKVDELNANPEVHGILVQLPLPKHINEEKILSQISLEKDVDGFHPLNIGKLAMKGRDPLFLPCTPKGCLELLSRSGISIKGKKAVVVGRSNIVGLPVSLLLLKADATVTVVHSRTQDPESFIREADIVIAAAGQAMMIKGSWIKPGAAVIDVGTNAVNDPSRKSGYRLVGDVDFQEACKVAGWITPVPGGVGPLTVAMLLQNTLEGAKRVIGQ

SEQ ID NO: 4609 - protein, 299 aa, Castanea mollissima
MASPSDHKAKIIDGKAIAQTIRNEIAAEVHQLSQKHGKVPGLAVVIVGNRKDSQSYVNMKRKACAEVGIKSFDIDLPEQVSEAELIAKVDELNANPDVHGILVQLPLPKHINEEKVLTEISIEKDVDGFHPLNIGKLAMKGRDPLFLPCTPKGCLELLSRSGITVKGKKAVVVGRSNIVGLPVSLLLLKADATVTIVHSHSQDPEKVIREADIIIAAAGQAMMVKGSWIKPGAAVIDVGTNAIDDPSKKSGYRLVGDVHYQEACEVAGWVTPVPGGVGPMTVAMLLKNTLEGAKRVIEH

SEQ ID NO: 4610 - protein, 299 aa, Cucumis melo
MASESDHKATIIDGKKIAQTVRSEVAEEVNKLSEKYGKVPGLAVVIVGNRKDSLTYVNMKRKACLEVGIKSFEIDLPEQVSEAELISKVHELNANPEVHGILVQLPLPNHINEEKVLSEISIEKDVDGFHPLNIGKLAMKGRDPLFLPCTPKGCLELLSRSGISIRGKKAVVMGRSNIVGLPVSLLLLKADATVTIVHSRSVDPESVIREADIIIAAAGQAQMIKGSWIKPGAAVIDVGTNAVDDPTKKSGYRLVGDVDFQEACKVAGWITPVPGGVGPMTVAMLLRNTLDGAKRAIEQ

SEQ ID NO: 4611 - protein, 299 aa, Nicotiana benthamiana
MASPSDHKATVIDGKAIAQTIRSEIASEVRRLSEKYGKVPGLAVVIVGNRKDSQSYVNMKRKSCAELGIKSFDIDLLEDVAEAELISKVHELNADPDVHGILVQLPLPKHINEERVLGEISLEKDVDGFHPLNIGKLAMKGRQPLFLPCTPKGCIELLHRSGISIKGKNAVVVGRSNIVGLPVSLLLLKEDATVTIVHSRTKEPEKIVREADIIIAAAGQAMMIKGSWIKPGAAVIDVGTNAVDDPTRKSGYRLVGDVDFQEACEVAGCITPVPGGVGPMTVAMLLKNTLDGAKRVIEK

SEQ ID NO: 4612 - protein, 296 aa, Quercus alba
MSDHKANIIDGKAIAQTIRNEIASEVHYLSNKHGKVPGLAVVIVGNRKDSQSYVSMKRKACAEVGIKSFDIDLPEQVSEADLVAKVHELNANPDVHGILVQLPLPKHINEERVLTEISIEKDVDGFHPLNIGKLAMKGREPLFHPCTPKGCLELLSRSGITIKGKKVVVVGRSNIVGLPVSLLLLKADATVTIVHSHSQDPERIIRDADIIIAAAGQAMMVKGSWIKPGAAVIDVGTNAIDDPSKKSGYRLVGDVDFQEACKVAGWITPVPGGVGPMTVAMLLKNTLEGAKRVIEH

SEQ ID NO: 4613 - protein, 180 aa, Prunus persica
MASQSDHMAAIIDGKAIAQTIRNEIAEEVRHLSQKYGKVPGLAVVIVGNRKDSQSYVSMKRKACAEVAIKSLDIDLPEYVSQDDLIAKVHELNANPDVHGILVQLPLPKHINEEKVLSEISIEKDVDGFHPLNIGKLAMKGREPLFLPCTPKARHLRLPGTSVTEWHKHKGKEGSGGGQK

SEQ ID NO: 4614 - protein, 299 aa, Primula obconica
SQSDDQKTAHIIDGKAIAQTIRSEIASEVRHLSDNFGKVPGLAVVIVGTRKDSQSYVSMKRKACAEVGIKSFDVDLPEQVPEDELISKVHELNADPSVHGILVQLPLPKHINEEKVLSAISIEKDVDGFHPLNIGKLAMKGRDPLFLPCTPKGCLELLSRSGITIKGKNAVVVGRSNIVGLPVSLLLLKADATVTVVHSRTPNPEKIISEADIIIAAAGQAMMIKGSWIKPGAAVIDVGTNAVDDPSKKAGYRLVGDVDFKEACKVAGAITPVPGGVGPMTVAMLLQNTLEGAKRVITH

SEQ ID NO: 4615 - protein, 299 aa, Chrysanthemum coronarium
MALPVDHKAHIIDGKAIAQTIRDEIASEVKNLVEKYGKAPGLAVVIVGHRKDSQSYVNMKRKACAEVGINSIDIDLPEQVPEAELIAKVHELNADPQVHGILVQLPLPKHINEEKVLTEISIDKDVDGFHPLNIGKLAMKGRDPLFLPCTPKGCIELLKHSGVTIKGKRAVVVGRSNIVGLPVSLLLLKADATVTVVHSHTPDPECIIREADIVIAAAGQAMMIKGSWLKPGAAVIDVGTNAVDDASRKSGYRLVGDVDYQEGCKVAGCITPVPGGVGPMTVAMLLKNTLDGAKRVIGQ

SEQ ID NO: 4616 - protein, 299 aa, Cichorium intybus
MALPVDHKANIIDGKAIAQTIRSEIASEVSTLIEKYGKAPGLAVVIVGHRKDSQSYVSMKRKACCEVGIRSIDIDLPEQVPEAELIAKVHELNADPDVHGILVQLPLPKHINEEKVLTEISIDKDVDGFHPLNIGKLAMKGREPLFLPCTPKGCIELLKRSGITIKGKRAVVVGRSNIVGLPVSLLLLKEDATVTVVHSRTEDPETMIREADIVIAAAGQAMMIKGSWIKPGAAVIDVGTNAVDDASRKSGYRLVGDVDFQEACKVAGWVTPVPGGVGPMTVAMLLKNTLDGAKRVIGQ

SEQ ID NO: 4617 - protein, 292 aa, Allium cepa
MAKIIDGKAIAQDIRSEIAQEVQILSQNHHTVPGLAVVIVGTRKDSQSYVNMKRKACAEVGIKSFDFDLPEEISETDVIAEVHELNANPDVHGILVQLPLPKHINEEKVLSEISIEKDVDGFHPLNIGKLAMKGREPLFSPCTPKGCLELLSRSGVNVKGKRAVVVGRSNIVGLPVSLLLLKADATVTVVHSRTPDPENIIREADIVIAAAGQANMIKGDWIKPGAAVIDVGTNAVDDPSRKSGYRLVGDVDFQEASKVAGYLTPVPGGVGPMTVAMLLKNTLDGAKRKIEQ

SEQ ID NO: 4618 - protein, 290 aa, Allium cepa
MAKIIDGKAIAHDIRSEIAQEVQILSQNHHTVPGLAVVIVGTRKDSQSYVNMKRKACAEVGIKSFDFDLPEEISETDVIAKVHELNANPDVHGILVQLPLPKHINEEKVLSEISIEKDVDGFHPLNIGKLAMKGREPLFSPCTPKGCLELLSRSGVNVKGKRAVVVGRSNIVGLPVSLLLLKADATVTVVHSRTPDPENIIREADIVIAAAGQANMIKGDWIKPGAAVIDVGTNAVDDPSRKSGYRLVGDVDFQEASKVAGYLTPVPGGVGPMTVAMLLKNTLDGAKSKI

SEQ ID NO: 4619 - protein, 292 aa, Ananas comosus
MATIIDGKAIAQTIRNEIAQEVRSLSDAHHKVPGLAVVIVGTRKDSQSYVNMKRKACAEVGIRSFDLDLPEQISESELIAKVHELNANPDVHGILVQLPLPKHINDEKVLSEINIDKDVDGFHPLNIGKLAMKGREPLFLPCTPKGCLELLSRSGITIKGKRAVVVGRSNIVGLPVALLLLKADATVTIVHSHTPDSETIIREADIVIAAAGQAMMIKGDWIKPGAAVIDVGTNAVDDPSKKSGYRLVGDVDFQEASRVAGWITPVPGGVGPMTVAMLLKNTLDGAKRKIAQ

SEQ ID NO: 4620 - protein, 299 aa, Echinacea purpurea
MALPVDHKANIIDGKLIAQTIRSEIASEVRILVEKYGKSPGLAVVIVGNRKDSQSYVNMKRKACAEVGIKSIDIDLPEEVPEAELIAKVHELNADPNVHGILVQLPLPKHINEEKVLTEISIEKDVDGFHPLNIGKCAMKGRDPLFLPCTPKGCIELLKRSGVTIKGKRAVVVGRSNIVGLPVSLLLLKEDATVTVVHSRTEDPQSIISEADIVIAAAGQAMMIKGSWIKPGAAVIDVGTNAVDDSTRKSGYRLVGDVDFQEACKVAGWITPVPGGVGPMTVAMLLKNTLDGAKRVIGV

SEQ ID NO: 4621 - protein, 299 aa, Flaveria ramosissima
MALSVDHKANIIDGKLIAQTIRSEIASEVSNLVEKYGKAPGLAVVIVGTRKDSQSYVNMKRKACAEVGIKSIDIDLPEEVPEAELIAKIHELNADPNVHGILVQLPLPKHINEEKVLTEISIEKDVDGFHPLNIGKLAMKGRDPLFLPCTPKGCIELLKRSGVTIKGKRAVVVGRSNIVGLPVSLLLLKEDATVTVVHSRTADPQSIICEADIVIAAAGQAMMIKGSWIKPGAAVIDVGTNAVDDASRKSGYRLVGDVDFVEACKVAGCVTPVPGGVGPMTVAMLLKNTLDGAKRVIGQ

SEQ ID NO: 4622 - protein, 299 aa, Nicotiana benthamiana
MASPSDHKATIIDGKAIAQTIRSEIASEVRLLSQKYGKVPGLAVVIVGNRKDSQSYVNMKRKSCAELGIQSFDIDLPEDVAEDELISKVHELNANPDVHGILVQLPLPKHINEERVLGEISLEKDVDGFHPLNIGKLAMKDRQPLFLPCTPKGCIELLHRSGISIKGKNAVVVGRSNIVGLPVSLLLLKENATVTIVHSRTKEPEKIVREADIIIAAAGQAMMIKGCWIKPGAAVIDVGTNAVDDPSRKSGYRLVGDVDFQEACNVAGWITPVPGGVGPMTVAMLLKNTLDGAKRVIEK

SEQ ID NO: 4623 - protein, 299 aa, Nicotiana benthamiana
MASPSDHKANIIDGKAIAQTIRSEIASEVQLLSEKYGKVPGLAVVIVGNRKDSQSYVNMKRKSCAELHIKSFDIDLLEDVAEAELISKVHELNADPDVHGILVQLPLPKHINEERVLGEISLEKDVDGFHPLNIGKLAMKGRQPLFLPCTPKGCIELLHRSGISIKGKNAVVVGRSNIVGLPVSLLLLKEDATVTIVHSRTKEPEKIVREADIIIAAAGQAMMIKGSWIKPGAAVIDVGTNAVDDPTRKSGYRLVGDVNFQEACKVAGWITPVPGGVGPMTVAMLLKNTLDGAKRVIEK

SEQ ID NO: 4624 - protein, 291 aa, Allium cepa
AKIIDGKAIAQDIRSEIAQEVQILSQNHHTVPGLAVVIVGTRKDSQSYVNMKRKACAEVGIKSFDFDLPEEISETDVIAEVHELNANPDVHGILVQLPLPKHINEEKVLSEISIEKDVDGFHPLNIGKLAMKGREPLFSPCTPKGCLELLSRSGVNVKGKRAVVVGRSNIVGLPVSLLLLKADATVTVVHSRTPDPENIIREADIVIAAAGQANMIKGDWIKPGAAVIDVGTNAVDDPSRKSGYRLVGDVDFQEASKVAGYLTPVPGGVGPMTVAMLLKNTLDGAKRKIEQ

SEQ ID NO: 4625 - protein, 299 aa, Populus trichocarpa
MASQSEHKATVIDGKLIAQTIRSEIAEEVRQLSEKYGKVPGLAVVIVGNRKDSQSYVGMKRKACAEVGIQSFDMDLPEQISEAELVSKVHELNANPDVHGILVQLPLPKHINEEKVLSEISLAKDVDGFHPLNIGKLAMKDREPLFQPCTPKGCLELLHRSGVSIKGKRAVVVGRSNIVGLPVSLLLLKADATVTVVHSRSNDQESIIREADIIIAAAGQPMMIKGSWIKPGAAVIDVGTNAVDDPSRKTGYRLVGDVDFKEACKIAGCITPVPGGVGPMTVAMLLKNTLEGAKRVIVQ

SEQ ID NO: 4626 - protein, 299 aa, Populus trichocarpa
MASQSEHKATVIDGKLIAQTIRSEIAEEVRQLSEKYGKVPGLAVVIVGNRKDSQSYVGMKRKACAEVGIQSFDMDLPEQISEAELVSKVHELNANPDVHGILVQLPLPKHINEEKVLSEISLAKDVDGFHPLNIGKLAMKDREPLFQPCTPKGCLELLHRSGVSIKGKRAVVVGRSNIVGLPVSLLLLKADATVTVVHSRSNDQESIIREADIIIAAAGQPMMIKGSWIKPGAAVIDVGTNAVDDPSRKTGYRLVGDVDFNEACKIAGCITPVPGGVGPMTVAMLLKNTLEGAKRVIVQ

SEQ ID NO: 4627 - protein, 267 aa, Raphanus sativus
SEKHGKVPGLAVVIVGARKDSQTYVTMKRKACAEVGIKSFDVDLPEDVSEADLITKVHLLNSDPDVHGILVQLPLPKHINEENVLSAISIDKDVDGFHPLNIGKLAMKGREPLFLPCTPKGCLELLVRSGIKIKGQRAVVVGRSNIVGLPVSLLLLKADATVTTVHSHTRDPEAIIREADIVIAAAGQACMIKGDWIKPGAAVIDVGTNAVSDPSRKSGYRLVGDVDYAEACKVAGFVTPVPGGVGPMTVAMLLRNTLDGAKRVIGQ

SEQ ID NO: 4628 - protein, 299 aa, Solanum lycopersicum
MASPSDHKATIIDGKAIAQTIRSEIASEVQRLSEKYGKVPGLAVVIVGNRKDSQSYVNMKRKSCAELCIKSFDIDLPEDVAEAEVISKVHELNADPDVHGILVQLPLPKHINEERVLCEISLEKDVDGFHPLNIGKLAMKGRQPLFNPCTPKGCIELLVRSGISIKGKNAVVVGRSNIVGLPVSLLLLKEDATVTVVHSRTKEPEKIIREADIIIAAAGQAMMIKGSWIKPGAAVIDVGTNAVDDPTRKSGYRLVGDVDFQEACKVAGWITPVPGGVGPMTVAMLLKNTLDGAKRVIEK

SEQ ID NO: 4629 - protein, 296 aa, Triphysaria pusilla
MSDHKATLIDGKAIAKTIRSEIAADVRRLSETHGKVPGLAVVIVGQRKDSQSYVSMKRKACAEVGIKSIDLDLPENVSESELICKVHELNANPDVHGILVQLPLPKHINEEKILTEISLEKDVDGFHPLNIGKLAMKGRDPLFVPCTPKGCIELLNRSGVSIKGKNAVVVGRSNIVGLPVSLLLLKEDATVTVVHSRTKEPESIVRNADIIIAAAGQANMIKGSWIKPGAAVIDVGTNAVDDPSKKAGYRLVGDVDFHEASKVAGWITPVPGGVGPMTVAMLLKNTLDGAKRVMER

SEQ ID NO: 4630 - protein, 161 aa, Flaveria ramosissima
MKGRDPLFLPCTPKGCIELLKRSGVTIKGKRAVVVGRSNIVGLPVSLLLLKEDATVTVVHSRTADPQSIICEADIVIAAAGQAMMIKGSWIKPGAAVIDVGTNAVDDASRKSGYRLVGDVDFVEACKVAGCVTPVPGGVGPMTVAMLLKNTLDGAKRVIGQ

SEQ ID NO: 4631 - protein, 301 aa, Beta vulgaris
KMAATSSENKASLIDGKAIAQCIRSEIADEVRLLSQKYGKVPGLAVVIVGNRKDSQSYVNMKRKACAEVGINSLDIDLPEQVSEPELIAKVHELNANPEVHGILVQLPLPKHINEERVLTEISIEKDVDGFHPLNIGKLAMKGREPLFHPCTPKGCLELLSRSGISIKGKKAVVVGRSNIVGLPVSLLLLKADATVSIVHSHTTDPKSIIREADIVIAAAGQAMMIKGDWIKPGAAVIDVGTNAVDDPSKKAGYRLVGDVDFHEVSKVAGWITPVPGGVGPMTVAMLLRNTLDGAKHVIEQ

SEQ ID NO: 4632 - protein, 299 aa, Flaveria ramosissima
MALPVDHKANIIDGKLIAQTIRSEIASEVSNLVEKYGQAPGLAVVIVGTRKDSQSYVNMKRKACAEVGIKSIDIDLPEEVPEAELIAKVHELNADPNVHGILVQLPLPKHINEEKVLTEISIEKDVDGFHPLNIGKLAMKGRDPLFLPCTPKGCIELLKRSGVTIKGKRAVVVGRSNIVGLPVSLLLLKEDATVTVVHSRTADPQSIICEADIVIAAAGQAMMIKGSWIKPGAAVIDVGTNAVDDSTKKSGYRLVGDVDFVEACKVAGCVTPVPGGVGPMTVAMLLKNTLDGAKRVIGQ

SEQ ID NO: 4633 - protein, 299 aa, Flaveria ramosissima
MALPVDHKANIIDGKLIAQTIRSEIASEVSNLVEKYGKAPGLAVVIVGTRKDSQSYVNMKRKACVEVGIKSIDIDLPEEVPEAELIAKVHELNADPNVHGILVQLPLPKHINEEKVLTEISIEKDVDGFHPLNIGKLAMKGRDPLFLPCTPKGCIELLKRSGVTIKGKRAVVVGRSNIVGLPVSLLLLKEDATVTVVHSRTADPQSIICEADIVIAAAGQAMMIKGSWIKPGAAVIDVGTNAVDDATKKSGYRLVGDVDFVEACKVAGCVTPVPGGVGPMTVAMLLKNTLDGAKRVIGQ

SEQ ID NO: 4634 - protein, 299 aa, Flaveria ramosissima
MALPVDHKANIIDGKLIAQTIRSEIASEVSNLVEKYGKAPGLAVVIVGTRKDSQSYVNMKRKACAEVGIKSIDIDLPEEVPETELIAKVHELNADPNVHGILVQLPLPKHINEEKVLTEISIEKDVDGFHPLNIGKLAMKGRDPLFLPCTPKGCIELLKRSGVTIKGKRAVVVGRSNIVGLPVSLLLLKEDATVTVVHSRTADPQSIICEADIVIAAAGQAMMIKGSWIKPGAAVIDVGTNAVDDASRKSGYRLVGDVDFVEACKVAGCVTPVPGGVGPMTVAMLLKNTLDGAKRVIGQ

SEQ ID NO: 4635 - protein, 292 aa, Elaeis guineensis
MATIIDGKAIAQTIRNEIASEVRSLSQNYNKVPGLAVVIVGTRKDSQSYVSMKRKACAEVGIRSFDLDLPEDISEADLIEKVHQLNADADVHGILVQLPLPKHINEEKVLSEISIEKDVDGFHPLNIGKLAMKGREPLFLPCTPKGCLELLSRSGVSIKGKKAVVVGRSNIVGLPVSLLLLKADATVTIVHSHTQHPEHIIREADIVIAAAGQAMMIKGDWIKPGAAVIDVGTNAVDDPSKKSGYRLVGDVDFQEASKVAGWITPVPGGVGPMTVAMLLKNTLDGAKCKIAQ

SEQ ID NO: 4636 - protein, 299 aa, Solanum tuberosum
MASPSDHKATIIDGKAIAQTIRSEIASEVQRLSEKYGKVPGLAVVIVGNRKDSQSYVNMKRKSCAELCIKSFDIDLPEDVVEAEVISKVHELNANPDVHGILVQLPLPKHISEEKVLCEISLEKDVDGFHPLNIGKLAMKGRQPLFNPCTPRGCIELLVRSGISIKGKNAVVVGRSNIVGLPVSLLLLKEDATVTVVHSRTKEPEKIIREADIIIAAAGQAMMIKGSWIKPGAAVIDVGTNAVDDPTRKSGYRLVGDVDFQEACKVAGWITPVPGGVGPMTVAMLLKNTLDGAKRVIEK

SEQ ID NO: 4637 - protein, 299 aa, Solanum phureja
MASPSDHKATIIDGKAIAQTIRSEIASEVQRLSEKYGKVPGLAVVIVGNRKDSQSYVNMKRKSCAELCIKSFDIDLPEDVSEAEVISKVHELNANPDVHGILVQLPLPKHISEEKVLCEISLEKDVDGFHPLNIGKLAMKGRQPLFNPCTPRGCIELLVRSGISIKGKNAVVVGRSNIVGLPVSLLLLKEDATVTVVHSRTKEPEKIIREADIIIAAAGQAMMIKGSWIKPGAAVLDVGTNAVDDPTRKSGYRLVGDVDFQEACKVAGWITPVPGGVGPMTVAMLLKNTLDGAKRVIEK

SEQ ID NO: 4638 - protein, 296 aa, Triphysaria pusilla
MSDHKATLIDGKAIAKTIRSEIAADVRRLSETHGKVPGLAVVIVGEKKDSQSYVSMKRKACAEVGIKSIDLDLPENVSESELICKVHELNANPDVHGILVQLPLPKHINEEKILTEISLEKDVDGFHPLNIGKLAMKGRDPLFVPCTPKGCIELLNRSGVSIKGKNAVVVGRSNIVGLPVSLLLLKEDATVTVVHSRTKEPESIVRNADIIIAAAGQANMIKGSWIKPGAAVIDVGTNAVDDPSKKAGYRLVGDVDFHEASKVAGCITPVPGGVGPMTVAMLLKNTLDGAKRVMER

SEQ ID NO: 4639 - protein, 307 aa, Vitis vinifera
MASPDGHKASIIDGKAIAQAIRSEIAEEVRHLSEKYGKVPGLAVVIVGNRKDSQSYVSMKRKACAEVGIKSFDVDLPEQVLESELIGKVHELNALPDVHGILVQLPLPKHINEEKVLSEISLEKDVDGFHPLNIGKLAMKGREPLFLPCTPKGCLELLSRSGISVKGKKAVVVGRSNIVGLPVALLLLKADATVTVVHSHTQDPESIIRDADIVIAAAGQAMMIKGSWIKPGAAVIDVGTNAVNDPSKKSGYRLVGDVDFQEACKVAGWVTPVPGGVGPMTVAMLLKNTLDGAKRVIEQLLESPQHN

SEQ ID NO: 4640 - protein, 307 aa, Prunus persica
MASQSDHKAAIIDGKAIAQTIRNEIAEEVRHLSQKYGKVPGLAVVIVGNRKDSQSYVSMKRKACAEVGILSLDIDLPEDVSQVDLIAKVHELNANPDVHGILVQLPLPKHINEEKVLSEISIEKDVDGFHPLNIGKLAMKGREPLFLPCTPKARQRQLSYGCLELLSRSGISIKGKKAVVVGRSNIVGLPVSLLLLKADATVTVVHSHSHDPESIIREADIVIAAAGQAMMIKGSWIKPGAAVIDVGTNAIDDSSRKSGYRLVGDVDFQEACKVAGWVTPVPGGVGPMTVAMLLNNTLDGAKRVIAQ

SEQ ID NO: 4641 - protein, 301 aa, Cyclamen graecum
MATQSEEEKSARIIDGKAIAQTIRSEIAAEVRRISDKFHKVPGLAVVIVGTRKDSQSYVSMKRKACAEVGIKSFDIDLPEQVPEAELISKVHELNADPLVHGILVQLPLPKHINEEKVLSEIIIEKDVDGFHPLNIGKLAMKGRDPLFLPCTPKGCLELLSRSGISIKGKKAVVVGRSNIVGLPVSLLLLKADATVTVVHSHTPDPEKIISEADIIIAAAGQAMMIKGSWIKPGAAVIDVGTNAVDDPTKKSGYRLVGDVDFKEACKVAGAITPVPGGVGPMTVAMLLQNTLEGAKRVIMQ

SEQ ID NO: 4642 - protein, 292 aa, Cocos nucifera
MATIIDGKAIAQTIRNEIASEVRSLSQNYNKVPGLAVVIVGTRKDSQSYVSMKRKACAEVGIRSIDFDLPEDISEADLIEKVHQLNADADVHGILVQLPLPKHINEEKVLSEISIEKDVDGFHPLNIGKLAMKGREPLFLPCTPKGCLELLSRSGVSIKGKKAVVVGRSNIVGLPVSLLLLKADATVTIVHSHTQHPEHITREADIVIAAAGQAMMIKGDWIKPGAAVIDVGTNAVDDPSKKSGYRLVGDVDFQEASKVAGWITPVPGGVGPMTVAMLLKNTLDGAKRKIAQ

SEQ ID NO: 4643 - protein, 292 aa, Allium cepa
MAKIIDGKAIAQDIRNEIAQEVQILSQNHHTVPGLAVVIVGTRKDSQSYVNMKRKACAEVGIKSFDFDLPEEISETDVIAKVHELNANPDVHGILVQLPLPKHIDEEKVLSEISIEKDVDGFHPSNIGKLAMKGREPLFSPCTPKGCLELLSRSGVSVKGKKAVVVGRSNIVGLPVSLLLLKADATVTIVHSHTPDPESIIREADIVIAAAGQANMIKGDWIKPGAAVIDVGTNAVDDPSRKSGYRLVGDVDFQEGSKVAGYLTPVPGGVGPMTVAMLLRNTLDGAKRKIAR

SEQ ID NO: 4644 - protein, 296 aa, Ambrosia trifida
MADHKANIIDGKLIAQTIRSEIASEVSILVEKYGKAPGLAVVIVGHRKDSQSYVNMKRKACAELGIRSIDIDLPEEVPEAELIAKVHELNIDPDVHGILVQLPLPKHINEEKVLTEISIEKDVDGFHPLNIGKLAMKGRDPLFLPCTPKGCIELLKRSGVTIKGKRAVVVGRSNIVGLPVSLLLLKEDATVTVVHSRTEDPQSIIREADIVIAAAGQAVMIKGSWIKPGAAVIDVGTNAVDDSTRKSGYRLVGDVDFQEACKVAGWITPVPGGVGPMTVAMLLKNTLDGAKRVIGQ

SEQ ID NO: 4645 - protein, 298 aa, Ambrosia trifida
MALPVDHKANIIDGKLIAQAIRSEIASEVSVLVEKYGKAPGLAVVIVGHRKDSQSYVNMKRKACAELGIRSIDIDLPEEVPEAELIAKVHELNIDPDVHGILVQLPLPKHINEEKVLTEISIEKDVDGFHPLNIGKLAMKGRDPLFLPCTPKGCIELLKRSGVTIKGKRAVVVGRSNIVGLPVSLLLLKEDATVTVVHSRTEDPQSIIREADIVIAAAGQAMMVKGSWIKPGAAVIDVGTNAVDDSTRKSGYRLVGDVDFQEACKVAGWITPVPGGVGPMTVAMLLKNTLDGAKRVIG

SEQ ID NO: 4646 - protein, 299 aa, Arnica chamissonis
MALPVDHKANIIDGKIIAQTIRSEIASEVSNLVEKYGKAPGLAVVIVGNRKDSQSYVNMKRKACAEVGIKSIDIDLPEEVPEAELIAKVHELNADPSVHGILVQLPLPKHINEEKVLTEISIEKDVDGFHPLNIGKLAMKDRNPLFLPCTPKGCIELLKRSGITIKGKRAVVVGRSNIVGLPVSLLLLKEDATVTVVHSRTADPQSIICEADIVIAAAGQAMMIKGSWIKPGAAVIDVGTNAVDDSTRKSGYRLVGDVDFAEACKVAGWVTPVPGGVGPMTVAMLLKNTLDGAKRVIGQ

SEQ ID NO: 4647 - protein, 279 aa, Tragopogon dubius
MALPVDHKASIIDGKAIAQTIRSEIASEVSTLIEKYGKAPGLAVVIVGHRKDSQSYVSMKRKACAEVGIKSIDIDLPEQVPEAELIAKVHELNADPSVHGILVQLPLPKHINEEKVLTEISIDKDVDGFHPLNIGKLAMKGRDPLFLPCTPKGCIELLKRSGIPIKGKRAVVVGRSNIVGLPVSLLLLKEDATVTVVHSRTVDPESIIREADIVIAAAGQAMMIKGSWIKAGAAVIDVGTNAVDDSSRKSGYRLVGDVDFQEACEVAGWVTPVPGVWGP

SEQ ID NO: 4648 - protein, 241 aa, Vinca minor
MKRKACAEVGIKSFDIDLPEEVSEAALIDKVHELNANPDVHGILVQLPLPKHIKEEKVLSEISLEKDVDGFHPLNIGKLAMKGREPLFSPCTPKGCIELLSRSGITIKGKRAVVVGRSNIVGLPVSLLLLKEDATVTVVHSGTKEPESIIREADIVIAAAGQAMMIKGSWIKPGAAVIDVGTNAVDDPKKKSGYRLVGDVDFQEACKVAGYITPVPGGVGPMTVAMLLKNTLDGAKHVIEH

SEQ ID NO: 4649 - protein, 302 aa, Amorphophallus konjac
MALEEQQQRPTAKIIDGKAIAQAIRDEIAAEVRSLSEAHGTVPGLAVVIVGCRKDSQSYVAMKRKACAEVGIRSFDLDLPEDIPEADVIRKVHELNSNPEVHGILVQLPLPRHINEERVLSEINIDKDVDGFHPLNIGKLAMKGREPLFLPCTPKGCLELLSRSGITIKGKRAVVVGRSNIVGLPVALLLLKADATVTIVHSHTHDPESIIREADIVIAAAGQAMMIKGDWLKPGAAVIDVGTNAIDDPSRKSGYRLVGDVDFQEAIKVAGWLTPVPGGVGPMTVAMLLQNTLDGAKRKVNQ

SEQ ID NO: 4650 - protein, 302 aa, Chelidonium majus
MASSEEHHQKKACIIDGKAIAQTIRSEITTEVQHLSEKYGKVPGLAVVIVGHRKDSQSYVNMKRKACAEVGIRSFDVDLPEQVSEAEVIQKVHELNVHPDVHGILVQLPLPGHINEENVLSEISIEKDVDGFHPLNIGKLAMKGREPLFQPCTPKGCLELLTRSGISIKGKRAVVVGRSNIVGLPVALLLLKADATITVVHSRTTDSESIIREADIVIAAAGQAKMIKGDWIKPGAAVIDVGTNAVDDPSRKAGYRLVGDVDFNQVSKVAGWVTPVPGGVGPMTVAMLLKNTLDGAKRKIEQ

SEQ ID NO: 4651 - protein, 299 aa, Fagopyrum esculentum
MATSSEHSATIIDGKDIAQTIRSEISDEVRVMSENFGRVPGLAVVIVGSRKDSQTYVNMKRKACAEVGIKSFNIDLPEQVSEAELVDKVHELNANSEVHGILVQLPLPKHINEEKVLSEISIEKDVDGFHPLNIGKLAMKGRDPLFQPCTPKGCLELLKRSGITVKGKKAVVVGRSNIVGLPVSLLLLKADATVTVVHSRTSEPEKIIREADIIIAAAGQATMIKGDWIKPGAAVIDVGTNAVDDPTKKSGYRLVGDVNFQEACEVAGWITPVPGGVGPMTVAMLLQNTLDGAKRLIKN

SEQ ID NO: 4652 - protein, 299 aa, Flaveria ramosissima
MALPVDHKANIIDGKLIAQTIRAEIASEVSNLVEKYGKAPGLAVVIVGTRKDSQSYVNMKRKACAEVGIKSIDIDLPEDVPEAELIAKVHELNADPNVHGILVQLPLPKHINEEKVLTEISIEKDVDGFHPLNIGKLAMKGRDPLFLPCTPKGCIELLKRSGVTIKGKRAVVVGRSNIVGLPVSLLLLKEDATVTVVHSRTADPQSIICEADIVIAAAGQAMMIKGSWIKPGAAVIDVGTNAVDDSTKKSGYRLVGDVDFVEACKVAGCVTPVPGGVGPMTVAMLLKNTLDGAKRLIGQ

SEQ ID NO: 4653 - protein, 296 aa, Lippia dulcis
MSDHEVTIIDGKAVAQTIRSEIAAEVCRLSETYGKVPGLAVVIVGQRKDSQSYVNMKRKACAEVGIKSLDLDLPEDVSESDLICKVHELNANPDVHGILVQLPLPKHINEEKILTEISLGKDVDGFHPLNIGKLAMKGRDPLFVPCTPKGCIELLTRHGITIKGKNAVVVGRSNIVGLPVSLLLLKEDATVTIVHSRTKEPETIIRNADIIIAAAGQAAMIKGSWIKPCAAVIDVGTNAVDDPSKKSGYRLVGDVDFQEACKAAGCITPVPGGVGPMTVAMLLKNTLDGAKRVIEG

SEQ ID NO: 4654 - protein, 296 aa, Plantago ovata
MADHKATLIDGKAIAQTIRSEIAADVRRLSETHGKVPGLAVVIVGNRKDSQSYVSMKRKACAEVGIKSFDSDLPEDVSQSELISKIHELNENPDVHGILVQLPLPKHINEEKILQEISLEKDVDGFHPLNIGKLAMKGRDPLFVPCTPKGCIELLTRSGISIKGKNAVVVGRSNIVGLPVSLLLLKEDATVTVVHSRTKEPESIIRQADIIIAAAGQPMMIKGSWVKPGAAVIDVGTNAVDDPTRKTGYRLVGDVDFNEASKVAGWITPVPGGVGPMTVAMLLRNTVDGAKRVIEH

SEQ ID NO: 4655 - protein, 299 aa, Helianthus annuus
MALPVDHKANIIDGKLIAQTIRSEIAAEVSVLVEKYGKAPGLAVVIVGHRKDSQSYVNMKRKACAELGIRSIDIDLPEQVHEAELIAKVHELNEDPNVHGILVQLPLPKHINEEKVLTEISLEKDVDGFHPLNIGKLAMKGRDPLFLPCTPKGCIELLKRSGVTIKGKRAVVVGRSNIVGLPVSLLLLKEDATVTVVHSRTPDPQSIICEADIVIAAAGQAMMIKGSWIKPGAAVIDVGTNAVDDASRKSGYRLVGDVDFHEACKVAGWITPVPGGVGPMTVAMLLKNTLDGAKRVIGQ

SEQ ID NO: 4656 - protein, 299 aa, Helianthus annuus
MALPVDHKANIIDGKLIAQTIRSEIAAEVSVLVEKYGKAPGLAVVIVGHRKDSQSYVNMKRKACAELGIRSIDIDLPEQVSEAELIAKVHELNEDPNVHGILVQLPLPKHIDEEKVLTEISLEKDVDGFHPLNIGKLAMKGRDPLFLPCTPKGCIELLKRSGVTIKGKRAVVVGRSNIVGLPVSLLLLKEDATVTVVHSRTPDPQSIICEADIVIAAAGQAMMIKGSWIKPGAAVIDVGTNAVDDASRKSGYRLVGDVDFHEACKVAGWITPVPGGVGPMTVAMLLKNTLDGAKRVIGQ

SEQ ID NO: 4657 - protein, 295 aa, Mimulus guttatus
MSSATIIDGKAIAQTIRSEIAVEVQRLSQTYNKVPGLAVVIVGKRKDSQSYVGMKRKACAELGIKSFDIDLPEDVSQSDLITKLHQLNANPDVHGILVQLPLPKHINEEKILTEISLEKDVDGFHPLNIGKLAMKGRDPLFVPCTPKGCLELLSRSGISVKGKNAVVVGRSNIVGLPVSLLLLKADATVTVVHSHTKEPETIIRNADIIIAAAGQAKMIKGSWIKAGAAVIDVGTNAVDDPSKKSGYRLVGDVDFEEASKVAGWITPVPGGVGPMTVAMLLKNTLDGAKRVIEHS

SEQ ID NO: 4658 - protein, 301 aa, Humulus lupulus
MASSLPSVHSAKVIDGKAIAQTVRSEIADEVRQLSEQHGKVPGLAVVIVGNRKDSQSYVGMKRKACAEVGIKSFDLDLPEDVSQTELIAKVHELNANPDVHGILVQLPLPKHINEEKVLSEISIEKDVDGFHPLNIGKLAMKGRDPLFLPCTPKGCLELLSRSGISIKGKKAVVVGRSNIVGLPVSLLLLKEDATVTIVHSRTSEPEKIVSEADIVIAAAGQPMMIKGSWIKPGAAVIDVGTNAVDDQSRKSGYRLVGDVDFHEACTVAGWITPVPGGVGPMTVAMLLKNTLEGAKSAMAK

SEQ ID NO: 4659 - protein, 302 aa, Cannabis sativa
MASSSPSVHSATVIDGKSIAQTVRSEIAVEVRQLSEQYGKVPGLAVVIVGNRKDSQSYVGMKRKACAEVGIKSLDLDLPEDVSQTELIAKVHELNANPDVHGILVQLPLPKHINEEKVLSEISIEKDVDGFHPLNIGKLAMKGRDPLFLPCTPKGCIELLSRSGITIKGKRAVVVGRSNIVGLPVSLLLLKEDATVTVVHSRTPEPEKIICEADIVIAAAGQAMMIKGSWIKPGAAVIDVGTNAVDDQSRKSGYRLVGDVDFKEACKVAGCITPVPGGVGPMTVAMLLKNTLEGAKRAIPPQ

SEQ ID NO: 4660 - protein, 459 aa, Eutrema parvulum
MAVATHCFTSPCHDRIRLFSGITSDDGRLLRKRINGTFLVKILPSSQNVDLRTTARSSRPLSGFRSGLSKGVFDIVALTSRNALKELSTPLLLKLVGVLACAFLIVPSADAVDALKTCACLLKGCRIELAKCIANPSCAANVACLQTCNNRPDETECQIKCGDLFENSVVDEFNECAVSRKKCVPRKSDLGEFPAPDPSVLVKNFNIGDFDGKWYITSGLNTTFDTFDCQRHEFHSEDGKLVGNISWRIKTPDSGFFTRSAVQKFVQDPNQPAVFYNHDNEYLHYQDDWYILSSKIEKKPDDYIFVYYRGRNDAWDGYGGAVVYTRSAVLPNSIVPELENAAKSIGRDFSTFVRTDNTCGPEPPLVERLEKTVEEGEKIIVKDFEEIEEEVEKEVEKVGKTEMTLFQRLAEGFNELKQDEENFLRGLSEEEMELLNELKMEANEVEKLFGKALPIRKFR

SEQ ID NO: 4661 - protein, 459 aa, Eutrema halophilum
MAVATYCFTSPCHDRIRFFSGVTSFDGRLLRKRINGTFLVKILPPSQNADLRTTSRSSRPLSGFRSGTSKGVFDIVALTSRNALKELSTPMVLKLVGVLACAFLIVPSADAVDALKTCACLLKGCRIELAKCIANPSCAANVACLQTCNNRPDETECQIKCGDLFENKVVDEFNECAVSRKKCVPQKSDLGEFPVPDPSVLVKNFNISDFNGKWYITSGLNPTFDTFDCQRHEFHADGDKLVGNISWRIKTLDSGFFTRSAVQKFVQDPNQPAILYNHDNEYLHYQDDWYILSSKVENKPDDYIFVYYRGRNDAWDGYGGAVVYTRSAVLPNSIVPELEKAAKSIGRDFSTFVRTDNTCGPEPPLVERFEKTVEEGEKIIVKEVEEIEEEVEKEVEKVGKTEMTLFQRLAEGFNELKQDEENFLRGLSEEEMELLNELKMEASEVEKLFGKSLPIRKVR

SEQ ID NO: 4662 - protein, 462 aa, Arabidopsis thaliana
MAVATHCFTSPCHDRIRFFSSDDGIGRLGITRKRINGTFLLKILPPIQSADLRTTGGRSSRPLSAFRSGFSKGIFDIVPLPSKNELKELTAPLLLKLVGVLACAFLIVPSADAVDALKTCACLLKGCRIELAKCIANPACAANVACLQTCNNRPDETECQIKCGDLFENSVVDEFNECAVSRKKCVPRKSDLGEFPAPDPSVLVQNFNISDFNGKWYITSGLNPTFDAFDCQLHEFHTEGDNKLVGNISWRIKTLDSGFFTRSAVQKFVQDPNQPGVLYNHDNEYLHYQDDWYILSSKIENKPEDYIFVYYRGRNDAWDGYGGAVVYTRSSVLPNSIIPELEKAAKSIGRDFSTFIRTDNTCGPEPALVERIEKTVEEGERIIVKEVEEIEEEVEKEVEKVGRTEMTLFQRLAEGFNELKQDEENFVRELSKEEMEFLDEIKMEASEVEKLFGKALPIRKVR

SEQ ID NO: 4663 - protein, 455 aa, Arabidopsis lyrata
MAVATHCFTSPCHGRIRFFSSDDGRLGITRKRINGTFLLKILPPIQNAGGRSSRPISAFRSGFSKGIFDIVALPSKNELKELTTPLLLKLVGVLACAFLIVPSADAVDALKTCACLLKGCRIELAKCIANPACAANVACLQTCNNRPDETECQIKCGDLFENSVVDEFNECAVSRKKCVPRKSDLGEFPAPDPSVLVQNFNISDFNGKWYITSGLNPTFDAFDCQVHEFHTEGDNKLVGNISWRIKTLDSGFFTRSAVQKFVQDPNQPGVLYNHDNEYLHYQDDWYILSSKIENKPDDYIFVYYRGRNDAWDGYGGAVVYTRSSVLPNSIIPELEKAAKSIGRDFSTFIRTDNTCGPEPPLVERIEKTVEEGERIIVKEVEEIEEEVEKEVEKVGKTEMTLFQRLAEGFNELKQDEENFVREFSKEEMEFLDEIKMEASEIEKLFGKALPIRKVR

SEQ ID NO: 4664 - protein, 299 aa, Cajanus cajan
MHAKTDSEVTSLAASSPTRSPPRRPLYYVQSPSRDSHDGEKTATTSFHSTPVLSPVGSPPHSRHSSSTRFSSKKDHTHNTLKPWKRIDVIEEEGLLQGDDRRHSLPRRCYFLAFLLGFLLLFSLFSLILWGASRPMKPKISIKSIKFDHVRVQAGSDSTGVATDMITMNSTLKFTYRNTGTFFGVHVTATPVELSYSEIVIASGNMKKFYQSRRSQRLVSVAVMGNKIPLYGSGASLSSTTGVPTVPVPLNLNFVLRSRAYVLGKLVKPKYYKTIQCSITLDPKKLNAPISLKKSCTYD

SEQ ID NO: 4665 - protein, 297 aa, Glycine max
MHAKTDSEVTSLAASSPTRSPPRRPLYYVQSPSRDSHDGEKTATTSFHSTPVLSPSASPPHSRHSSSTRFSKKDHSHSLKPWKQIDVIEEEGLLQGDDHHNGLPRRCYFLAFVVGFLVLFSFFSLILWGASRPMKPKINIKSIKFDHVRVQAGSDATGVATDMITLNSTLKFAYRNTGTFFGVHVTSTPVELSYSDIVIASGNMKKFYQSRRSQRLVSVAVMGNKIPLYGSGASLSSTTGVPTVPVLLNLNFVLRSRAYVLGKLVKPKYYKTIQCSITLDPKKLNAAISLKKSCTYD

SEQ ID NO: 4666 - protein, 297 aa, Glycine max
MHAKTDSEVTSLAASSPTRSPPRRPLYYVQSPSRDSHDGEKTATTSFHSTPVLSPSASPPHSRHSSSTRFSKKDHSHSLKPWKQIDVIEEEGLLQGDDRRNGLPRRCYFLAFVVGFLVLFSFFSLILWGASRPMKPKITIRSITFDHVRVQAGSDATGVATDMITLNSTLKFTYRNTGTFFGVHVTSTPVELSYSDIVIAAGNLKKFYQSRRSQRLLSVSVMGNKIPLYGSGASLSSTTGVPTLPVPLNLNFVLRSRAYVLGKLVKPKYYKTIKCSITLDPKKLNAAISLKKSCTYD

SEQ ID NO: 4667 - protein, 302 aa, Lotus japonicus
MHAKTDSEVTSISASSPARSPPRRPLYFVQSPSRDSHDGEKTVTTSFHSTPVLSPNASPPHSSSSTRFSAPHRKKDNHHHHHSLKPWKQIDVIEEEGLLQGEDRDRTLSRRCYFLIFLLGFLLLFTLFSLILWGASRPMKPKIFIKSIKFDHVQVQAGSDSTGVATDMISMNSTLKFTYRNTGTFFGVHVASTPLELSYSEIVIAAGNMKEFYQHRRSHRLVSVAVMGNKIPLYGSGASLSSTTGMPTVPVPLNLNFVLRSRAYVLGKLVKPKYYKRIQCSITLDPKKLSAPIPLKHSCTYK

SEQ ID NO: 4668 - protein, 303 aa, Cicer arietinum
MHRKTDSEGTSLATSSPTRSPPRRPIYYVQSPSRDSHDEKTVTNSFHSTPVLSPVASPPHSSSSTNFSSQTRKKHHHQHHHNHSHKPWKQIDVIEEEGLLEREDRSGSFPRRCYFPAFVVGFLLLFSLFSVILWGASRHMKPKIVVKSIKFDHVRVQAGSDSTGVATDMITMNSTLKFTYRNTGTFFGVHVSATPLELSYSDITIASGNMKEFHQSRKSQRLVSVTVTGNKIPLYGSGASLSSTTGTPTLPVPLNLNFVLRSRANVLGKLVKPKYYKRIQCSITLDPKKLGAPISLKKSCKYY

SEQ ID NO: 4669 - protein, 300 aa, Trigonella foenum-graecum
MHAKTDSEVTTTSQATSSPTRSPPRRPLYYVQSPSHDGEKTVTTSFHSTPVLTPVASPHHSSSSTHFSASKKEQQHNHNHGVKPWKQIDVIEEEGLLDGEERNGGYSRSCYFLAFVVGFFVLFSLFSIILWGASRPMKPKIVIKSIKFDHVTVQAGSDSTGVATDMITMNSTLKFTYRNTGTFFGVHVSATPLELSYSDIVIASGNMKEFHQSRKSHRLVTVAVMGSKVPLYGSGASLSSTTGMPTLPVPLNLNFVMRSRANVLGKLVKPKYYKKIQCSITLDPKKLGSVASLKNSCTYD

SEQ ID NO: 4670 - protein, 163 aa, Cajanus cajan
MAKDRCIGVALDFSKSSKHALKWALENLADKGDTIYVIHVNPNSLDESRNQLWAKSGSPLIPLQEFREPEIMKKYGVEIDIEVLDLLDTASRQKEVHIVTKIYWGDAREKLLDAIEDLKLDSLVMGSRGLSTIQRILLGSVSNFVMTHAPCPVTIVKEPSSSK

SEQ ID NO: 4671 - protein, 163 aa, Vigna unguiculata
MAKDRTIGVALDFSNSSKNALKWALENLADKGDTIYVIHISSNSIDESRNKLWEKSGSPLIPLQEFREPEIMKKYGVHPDIEVLDILDTASRQKEVHIVAKIYWGDAREKLLDAIEDLKLDSLVLGSRGLSTIQRIILGSVSNFVMTHASCPVTIVKEPSSSK

SEQ ID NO: 4672 - protein, 164 aa, Glycine max
MAKDRTIGVALDFSKSSKNALKWAFENLADKGDTIYVIHINPNSLDESRNKLWAKSGSPLIPLVEFREPEIMKKYDVEIDIEVLDMLDTASRQKEIHIVTKIYWGDAREKLLDAIEDLKLDSLVMGSRGLSTIQRIILGSVSNFVMTNAPCPVTIVKEPPSSSK

SEQ ID NO: 4673 - protein, 167 aa, Glycine max
MAKDRTIGVALDFSKSSKNALKWALENLADKGDTIYVIHINSNSLDESRNKLWAESGSPLIPLVEFREPEIMKKYDVQIDIEVLDLLDTASRQKEIHIVTKIYWGDAREKLLDAIEDLKLDSLVMGSRGLSTIQRIILGSVSNFVMTHASCPVTIVKETSKETSSSK

SEQ ID NO: 4674 - protein, 164 aa, Lotus japonicus
MAKDRTIGVALDFSKSSKNALKWALENLADKGDNIYIIHINPNSLDESRNKLWGKSGSPLIPLKEFREPEVMTKYDVQIDIEVLDLLDTASRQKEVNIVTKIYWGDAREQLLDAVEDLKLDSLVMGSRGLSTIQRIILGSVSNFVMTHAPCPVTIVKDSSSSNK

SEQ ID NO: 4675 - protein, 164 aa, Cyamopsis tetragonoloba
MGKDRSIGVALDFSKSSKNALKWALENLADKGDTIYIIHINHNSLDESRNQLWEKSGSPLIPLTEFREPEVMKKYCVQTDIEVLDLLDTFSRQKEVNIVTKIYWGDAREKLLDAIEDLKLDSLVMGSRGLSTIQRIILGSVSNFVMTHAPCPVTIVKDSSFTTK

SEQ ID NO: 4676 - protein, 156 aa, Acacia harpophylla
MVKDRKIGVALDFSKSSKNALKWALDNLADKGDIIYIIHINPNTLDESRNQLWAQSGSPLIPLAEFREPEIMKKYDVQTDIEVLDLLDTGARQKEVNIVTKIYWGDAREKLLDAIEDLKLDSLVMGSRGLSTIRRIILGSVSNFVMTHAPCPVTIV

SEQ ID NO: 4677 - protein, 164 aa, Arachis hypogaea
MVKDRKIGVAMDFSNSSKNALSWALENLADKGDTFYIIHINPNDLDESRTKLWAKSGSPLIPLKEFREPEVMKKYGVQIDIEVLDLLDTASRQKEVNIVTKLYYGDAREKLLDAVEDLKLDSIVMGSRGLSTIKRIILGSVSNFVATHAPCPVTIVKESNSTSK

SEQ ID NO: 4678 - protein, 164 aa, Trigonella foenum-graecum
MPKDRTIGVALDFSKSSKNALKWALENLADKGDNIYIIHISHDSLEEGRNQLWAKDGSPLIPLKEFREPEIMKKYGVQIDIEVLDLLDTFSRQKEVNIVTKVYWGDAREKLIDAVEDLKLDSLVMGSRGLSTIQRILLGSVSNFVMTNASCPVTIVKDNSSSSK

SEQ ID NO: 4679 - protein, 164 aa, Pisum sativum
MPKDRTIGVALDFSKSSKNALKWALENLADNGDNITSSTSAKIPLMISQSAMVQIWFSFDSFERVQRPEIMNKYGVQIDIEVLDLLDTFSRQKEVNVVTKVYWGDAREKLLDAVEDLKLDSLVMGSRGLSTIQRILLGSVSNFVMANAPCPVTIVKDNISTSSK

SEQ ID NO: 4680 - protein, 165 aa, Trifolium pratense
MVKDRTIGVALDFSKSSKNALKWALDNLADKGDNIYIIHISHDSPDESRNQLWAQSGSPLIPLKEFREPEIMKKYGVQIDIEVLDLLDTVSRQKEVNIVTKVYWGDAREKLLDAVEDLKLDSLVMGSRGLSTIQRILLGSVSNFVMTNAPCPVTIVKDNSSSSSK

SEQ ID NO: 4681 - protein, 165 aa, Medicago truncatula
MAKDRTIGVALDFSKSSKNALKWALENLADKGDNIYIIHISHDSLDEARNQLWAKDGSPLIPLKEFREPEIMKKYGVQIDIEVLDLLDTFSRQKEVNVVTKVYWGDAREKLMDAVEDLKLDSLVMGSRGLSTIQRILLGSVSNFVMTNAPCPVTIVKDNCSSSSK

SEQ ID NO: 4682 - protein, 165 aa, Vicia sativa
MPKDRTIGIALDFSKSSKNALKWALENLADKGDNIYIIHISQENLDESRNQLWANSGSPLIPLKEFREPEIMKKYGVQIDIEVLDLLDTFSRQKEVNIVSKVYWGDAREKLLDAVEDLKLDSLVMGSRGLSTIQRIIMGSVSNFVMTNAPCPVTIVKDNIRTSSK

SEQ ID NO: 4683 - protein, 165 aa, Cicer arietinum
MGKDRIIGVALDFSNSSKNALKWALENLAEKGDNIYIIHISHDSLDESRNQIWAKSGSPLIPLKEFREPEIMKKYGVQIDIEVLDLLDTVSRQKEVNIVAKVYWGDAREKLLDAIDDLKLDSLVMGSRGLSTIQRILLGSVSNFVMTHAPCPVTIVKDLSSTSSK

SEQ ID NO: 4684 - protein, 164 aa, Castanea mollissima
MGKDRKIGVAMDFSKSSKNALKWAIDNLADKGDTLFIIHNNPNSLDESRGQLWAQSGSPLIPLSEFREPEVMKKYNVQTDIEVLDTLDTASRQKEVNIVTKLYWGDAREKLLQAVEDLKLDSLVMGSRGLGTIQRIILGSVSNYVITHASCPVTVVKDSSVGQH

SEQ ID NO: 4685 - protein, 164 aa, Prunus persica
MGKDRKIGVAMDFSKSSKNALEWAVDNLLDKGDTLYIIHINPNSLDESRTQLWAQSGSPLIPLTEFREPEIMKKYDVRTDIEVLDTLDTASRQKEVNIVTKLYWGDAREKLLQAIEDLKLDSLVMGSRGLGTIKRILLGSVSNYVLTNAPIPVTIVKDPSLQHH

SEQ ID NO: 4686 - protein, 163 aa, Arachis hypogaea
MGKDRKVGVAMDFSKSSKNALKWALDNLADKGDTFYIIHINPNSPDESRNQLWLKDGSPLIPLTEFREQEIMNKYAVQTDIEVLDLLDTAARQKEVNIVAKIYWGDAREKLLDSIEDLKLDSIVLGSRGLSTIQRIILGSVSNFVMTHAPCPVTIVKDSSTTK

SEQ ID NO: 4687 - protein, 164 aa, Quercus alba
MGKDRKIGVAMDFSKSSKNALKWAIDNLADKGDTLFIIHNNPNRLDESRGELWAQSGSPLIPLSEFREPEVMKKYDVQTDIEVLDTLDTASRQKEVNIVTKLYWGDAREKLLQAVEDLKLDSLVMGSRGLGTIQRIILGSVSNYVITHASCPVTVVKDSSVGQH

SEQ ID NO: 4688 - protein, 164 aa, Prunus mume
MGNDRKIGVAMDFSKSSKNALEWAVDNLLDKGDTLYIIHINPNSLDESRTQLWAQSGSPLIPLTEFREPEIMKKYDVQTDIEVLDTLDTASRQKEANIVTKLYWGDAREKLLQAIEDLKLDSLVMGSRGLGTIKRILLGSVSNYVLTNAPIPVTIVKDPSLQHH

SEQ ID NO: 4689 - protein, 148 aa, Arachis hypogaea
MDFSNSSKNALSWALENLADKGDTFYIIHINPNDLDESRTKLWAKSGSPLIPLKEFREPEVMKKYGVQIDIEVLDLLDTASRQKEVNIVTKLYYGDAREKLLDAVEDLKLDSIVMGSRGLSTIKRIILGSVSNFVATHAPCPVTIVRI

SEQ ID NO: 4690 - protein, 165 aa, Theobroma cacao
MAKDRKIGVAMDFSPSSKNALQWAVDNLADKGDTLYIIHINANSLDESHNALWAKSGSPLIPLTEFREPEIMKKYDVKPDIEVLDMLDTASRQKEIHIVTKLYWGGDAREKILDAVEGLKLDSLVMGSRGLGTVQRIILGSVSNYVMTHASCPVTIVKESSSMKH

SEQ ID NO: 4691 - protein, 192 aa, Cajanus cajan
MEQTVWCHLPVLLRANSKESIECILQTLWRTRKTGLTTSDRCIIHEMLHLQNESDLDPLLVCLRMLIRRCVYENTSKEDIPKLFPTEVLPELQKLLTLLLHKFQPEWQQDVLKDQNIVPRLKAMTWNMANVDKESADPAAVINLKLQNDAQFHSGEQDVKFQLATDSLDNMLKAMHCIRDQFSTMDEALNGH

SEQ ID NO: 4692 - protein, 147 aa, Vigna unguiculata
MDGLVQQLQKQLVDYTASLFHEGFLDEQFNQLQQLQDESNPDFVVEVVTLFFEDAERLLNELTKTLAQPTIDFKKLDAHVHQLKGSSSSIGAQRVHRVCISFRNSCEEQNVEGCLKNLQQVTHEYSLVKNKLETLFRMEQQILAAGG

SEQ ID NO: 4693 - protein, 146 aa, Glycine max
MDGIVQLQRQLVDYTASLFHEGFLDDQFNQLQQLQDESNPDFVVEVVTLFFEDAERLLNELTKTLGQPSIDFKRLDAHVHQLKGSSSSIGAQRIHRVCISFRNSCEEQNVEGCLKNLQQVKQEYSLVKSKLETLFRMEQQILAAGG

SEQ ID NO: 4694 - protein, 150 aa, Glycine max
MDGIVQLERQLVDYTASLFHEGFLDDQFNQLQQLQDESNPDFVVEVVTLFFEDADRLLNELTKALGQPSIDFKRLDAHVHQLKGSSSSIGAQRIHRVCISFRNTCEEQNVEGCLKNLQQVKHEYSLVKSKLETLFRMEQQILAAGGSVSR

SEQ ID NO: 4695 - protein, 150 aa, Cajanus cajan
MDGIVELQRQLIDYTASLFHEGFLDEQFNQLQQLEDENNPGFVVEVVTLFFEDADRLLNELTKALGQPSVDFKSLDAHVHQLKGSSSSIGAHRIHRVCISFRNSCEEQNVEGCLKNLQQVKHEYSLVKDRLETLFRMEQQILNAGGSVRR

SEQ ID NO: 4696 - protein, 149 aa, Lupinus angustifolius
MDIMVQLQRQLFDYTNSLFHEGFLDEQFNQLQQLQDESNPDFVVEVVTLFFEDAERLLNELTNTLSQENIDFKRLDAHVHQLKGSSSSIGAQRIHTVCISFRNSCEEQNVEGCLKSLQQVKQEYSTVKSKLETLFKMEKQILAAGGSVF

SEQ ID NO: 4697 - protein, 150 aa, Glycyrrhiza uralensis
MDGMVLLQRQLVDYTASLFQEGFLDDQFNQLEQLQDESNPDFVVEVVTLFFDDAERLLNELTRALGQESIDFKRLDAHVHQLKGSSSSIGAQRVQRACISFRNSCEEQNVEGCLKSLQQVKHEYSLVKSKLETLFKMEQQLLAARGSVCR

SEQ ID NO: 4698 - protein, 149 aa, Lupinus angustifolius
MDVMVQLQRQLVDYTASLFNEGFLDEQFNQLQQLQDESNPDFVVEVVTLFFEDAERLRNEMTIALSQESIDFKRLDAHVHHLKGSSSSIGAQRIHRVCISFRNSCVEQNVEGCLKSLQQVKQEYSLVKSKLETLFKMEQQILVARESVF

SEQ ID NO: 4699 - protein, 152 aa, Manihot esculenta
MDGLVQFQRQLVDYTASLFHEGFLDEQFNQLQQLQDESNPDFVVEVVSLFFEDSERLLNELAKSLDQQSVDFKRIDAHVHQLKGSSSSIGAQRVQKVCIAFRNYCDEQNTEGCLKCLQQVKHEYSLVKTKLETLFKLEQQVLAAGGSIPLPI

SEQ ID NO: 4700 - protein, 407 aa, Brassica oleracea
MESRVLLRATATVTGVPQLRRPIRAINRQFSTASSSFTAFAKPIGSIGEGGNLISGRQLRPVLLLDSSPEKREILKPVRAAAAEGGDSAGETKVGFLGKYPWLVTGFFFFMWYFLNVIFNILNKKIYNYFPYPYFVSVIHLFVGVVYCLVSWSVGLPKRAPINSDILKVLIPVAVCHAIGHVTSNVSFAAVAVSFTHTIKALEPFFNASASQFLLGQPIPITLWLSLAPVVLGVAMASLTELSFNWLGFISAMISNISFTYRSIFSKKAMTDMDSTNVYAYISIIALFVCLPPAIIVEGPQLLKHGFNDAIAKVGMTKFISDLFWVGMFYHLYNQLATNTLERVAPLTHAVGNVLKRVFVIGFSIVIFGNKISTQTGIGTGIAIAGVALYSVIKAKIEEEKRQGKTA

SEQ ID NO: 4701 - protein, 407 aa, Brassica juncea
  Sequence also found in Organisms: Brassica rapa
MESRVLLRATATVTGVPQLRRPIRAINRQFSTASSSFTAFAKPIGSIGEGGNLISGRQLRPVLLLESSPEKREILKPVRAAAAEGGDSAGETKVGFLGKYPWLVTGFFFFMWYFLNVIFNILNKKIYNYFPYPYFVSVIHLFVGVVYCLVSWSVGLPKRAPINSDILKVLIPVAVCHAIGHVTSNVSFAAVAVSFTHTIKALEPFFNASASQFLLGQPIPITLWLSLAPVVLGVAMASLTELSFNWLGFISAMISNISFTYRSIFSKKAMTDMDSTNVYAYISIIALFVCLPPAIIVEGPQLLKHGFNDAIAKVGMTKFISDLFWVGMFYHLYNQLATNTLERVAPLTHAVGNVLKRVFVIGFSIVIFGNKISTQTGIGTGIAIAGVALYSVIKAKIEEEKRQGKTA

SEQ ID NO: 4702 - protein, 407 aa, Brassica napus
MESRVLLRATATVTGVPQLRRPIRAINRQFSTASSSFTAFAKPIGSIGEGGNLISGRQLRPLLLLDSLPEKREILKPVRAAAAEGGDSAGETKVGFLGKYPWLVTGFFFFMWYFLNVIFNILNKKIYNYFPYPYFVSVIHLFVGVVYCLVSWSVGLPKRAPINSDILKVLIPVAVCHAIGHVTSNVSFAAVAVSFTHTIKALEPFFNASASQFLLGQPIPITLWLSLAPVVLGVAMASLTELSFNWLGFISAMISNISFTYRSIFSKKAMTDMDSTNVYAYISIIALFVCLPPAIIVEGPQLLKHGFNDAIAKVGMTKFISDLFWVGMFYHLYNQLATNTLERVAPLTHAVGNVLKRVFVIGFSIVIFGNKISTQTGIGTGIAIAGVALYSVIKAKIEEEKRQGKTA

SEQ ID NO: 4703 - protein, 407 aa, Brassica oleracea
MESRVLLRATETVTGVPQLRRPIRAINRQFSTASSSFTAFAKPIGSIGEGGNLISGRQLRPLLLLDSLPEKREILKPVRAASAEGGDSAGETKVGFLGKYPWLVTGFFFFMWYFLNVIFNILNKKIYNYFPYPYFVSVIHLFVGVVYCLVSWSVGLPKRAPVNSDILKVLIPVAVCHAIGHVTSNVSFAAVAVSFTHTIKALEPFFNASASQFLLGQPIPITLWLSLAPVVLGVAMASLTELSFNWLGFISAMISNISFTYRSIFSKKAMTDMDSTNVYAYISIIALFVCLPPAIIVEGPQLLKHGFNDAIAKVGMTKFISDLFWVGMFYHLYNQLATNTLERVAPLTHAVGNVLKRVFVIGFSIVIFGNKISTQTGIGTGIAIAGVALYSVIKAKIEEEKRQGKTA

SEQ ID NO: 4704 - protein, 407 aa, Brassica juncea
MESRVLLRATATVTGVPQLRRPIRAINRQFSTASSSFTAFAKPIGSVGEGGNLISGRQLRPILLLDSSPEKREILKPVRAAAAAGGDSAGETKAGFLGKYPWLVTGFFFFMWYFLNVIFNILNKKIYNYFPYPYFVSAVHLFVGVVYCLLSWSVGLPKRAPIDSNLLKVLIPVAVCHAIGHITSNVSFAAVAVSFTHTIKALEPFFNASASQFLLGQPIPITLWLSLAPVVLGVAMASLTELSFNWLGFISAMISNISFTYRSIFSKKAMTDMDSTNVYAYISIIALFVCLPPAIIVEGPQLLKHGFSDAIAKVGMTKFISDLFWVGMFYHLYNQLATNTLERVAPLTHAVGNVLKRVFVIGFSIVIFGNKISTQTGIGTGIAIAGVALYSVIKAKIEEEKRQGKTA

SEQ ID NO: 4705 - protein, 405 aa, Brassica juncea
MESRVLLRATVAGLPQLRRPIGAIHRQFSTASPSFTASAKPIGSIGEGGNLISGRQLRPILLLDSSTEKRETLKPVRAAAAAGGDSAGETKAGFLGKYPWLVTGFFFFMWYFLNVIFNILNKKIYNYFPYPYFVSVIHLFVGVVYCLLSWSVGLPKRAPINSNILKVLIPVAVCHAIGHVTSNVSFAAVAVSFTHTIKVLEPFFNASASQFLLGQPIPITLWLSLAPVVLGVAMASLTELSFNWLGFISAMISNISFTYRSIFSKKAMTDMDSTNVYAYISIIALFVCLPPAIIVEGPQLLKYGFNDAIAKVGMTKFISDLFWVGMFYHLYNQLATNTLERVAPLTHAVGNVLKRVFVIGFSIVIFGNKISTQTGIGTGIAIAGVALYSVIKAKIEEEKRQGKTA

SEQ ID NO: 4706 - protein, 407 aa, Eutrema parvulum
MESRVLLRATATVAGNPQLRRPIGAIHRQFSTATSSFTAFAKPIGAIGEGGNLISGRQLRPILLLDSSPEKREILKPVRAAAAEGGDSAGETKVGFLGKYPWLITGFFFFMWYFLNVIFNILNKKIYNYFPYPYFVSVIHLFVGVVYCLASWSVGLPKRAPIDSKLLKVLIPVAVCHALGHVTSNVSFAAVAVSFTHTIKALEPFFNASASQFLLGQPIPVTLWLSLAPVVLGVAMASLTELSFNWLGFISAMISNISFTYRSIFSKKAMTDMDSTNVYAYISIIALFVCIPPAIIVEGPQLLKHGFSDAIAKVGMTKFISDLFWVGMFYHLYNQLATNTLERVAPLTHAVGNVLKRVFVIGFSIVIFGNKISTQTGIGTGIAIAGVAMYSIIKAKIEEEKRKGKTA

SEQ ID NO: 4707 - protein, 407 aa, Eutrema halophilum
MESRVLLRATATVAGNPQLRRPIGAIHRQFSTATSSFTAFAKPIGAIGEGGNLISGRQLRPILLLDSSPEKREILKPVRAAAAEGGDSAGETKVGFLGKYPWLITGFFFFMWYFLNVIFNILNKKIYNYFPYPYFVSVIHLFVGVVYCLASWSVGLPKRAPIDSKLLKVLIPVAVCHALGHVTSNVSFAAVAVSFTHTIKALEPFFNAAASQFILGQSIPGTLWLSLAPVVLGVAMASLTELSFNWLGFISAMISNISFTYRSIFSKKAMTDMDSTNVYAYISIIALFVCIPPAIIVEGPQLLKHGFSDAIAKVGMTKFISDLFWVGMFYHLYNQLATNTLERVAPLTHAVGNVLKRVFVIGFSIVIFGNKISTQTGIGTGIAIAGVAMYSIIKAKIEEEKRKGKTA

SEQ ID NO: 4708 - protein, 169 aa, Triticum aestivum
MESRVLLRATATVTGVPQLRRPIRAINRQFSTASSSFTAFAKPIGSIGEGGNLISGRQLRPLLLLDSLPEKREILKPVRAAAAEGGDSAGETKVGFLGKYPWLVTGFFFFMWYFLNVIFNILNKKIYNYFPYPYFVSVIHLFVGVVYCLVSWSWVFLNGLQLTRTSSRY

SEQ ID NO: 4709 - protein, 401 aa, Brassica juncea
MESHVLLRAAVTGVPQLRRPIGAIHRQVSTASSFTAFAKPIGSAGEGGNLISGRQLRPILLLDSSPEKREILKPVRAAAGDSAGEAKVGFLGKYPWLVTGFFFFMWYFLNVIFNILNKKIYNYFPYPYFVSAVHLFVGVVYCLLSWSVGLPKRAPINSNLLKVLIPVAVCHAIGHITSNISFAAVAVSFTHTIKALEPFFNASASQFLLGQSIPITLWLSLAPVVFGVAMASLTELSFNWLGFISAMISNISFTYRSIFSKKAMTDMDSTNVYAYISIIALFVCLPPAIIVEGPQLLKHGFSDAIAKVGMTKFISDLFWVGMFYHLYNQLATNTLERVAPLTHAVGNVLKRVFVIGFSIVIFGNKISTQTGIGTGIAIAGVALYSVIKAKIEEEKRQGKTA

SEQ ID NO: 4710 - protein, 401 aa, Brassica oleracea
MESRVLLRATVTGVPQLRRPIGAIHRQVSTASSFTAFAKLIGSVGEGGNLISGRQLRPILLLDSSPEKREILKPVRAAAGDSAGEAKVGFLGKYPWLVTGFFFFMWYFLNVIFNILNKKIYNYFPYPYFVSAVHLFVGVVYCLLSWSVGLPKRAPINSNLLKVLIPVAVCHAIGHITSNVSFAAVAVSFTHTIKALEPFFNASASQFLLGQSIPITLWLSLAPVVFGVAMASLTELSFNWLGFISAMISNISFTYRSIFSKKAMTDMDSTNVYAYISIIALIVCIPPAIIVEGPQLLKHGFSDAIAKVGMTKFISDLFWVGMFYHLYNQLATNTLERVAPLTHAVGNVLKRVFVIGFSIVIFGNKISTQTGIGTGIAIAGVAMYSIIKAKIEEDKKKGKTA

SEQ ID NO: 4711 - protein, 401 aa, Brassica rapa
MESRVLLRAAVTGVPQLRRPIGAIHRQVSTASSFTAFAKPIGSAGEGGNLISGRQLRPILLLDSSPEKREILKPVRAAAGDSAGEAKVGFLGKYPWLVTGFFFFMWYFLNVIFNILNKKIYNYFPYPYFVSAVHLFVGVVYCLLSWSVGLPKRAPINSNLLKVLIPVAVCHAIGHITSNISFAAVAVSFTHTIKALEPFFNASASQFLLGQSIPITLWLSLAPVVFGVAMASLTELSFNWLGFISAMISNISFTYRSIFSKKAMTDMDSTNVYAYISIIALIVCIPPAIIVEGPQLLKHGFSDAIAKVGMTKFISDLFWVGMFYHLYNQLATNTLERVAPLTHAVGNVLKRVFVIGFSIVIFGNKISTQTGIGTGIAIAGVALYSIIKAKIEEDKKKGKTA

SEQ ID NO: 4712 - protein, 401 aa, Brassica napus
MESRLLLRATVTGVPQLRRPIGAIHRQVSTASSFTAFAKLIGSVGEGGNLISGRQLRPILLLDSSPEKREILKPVRAAAGDSAGEAKVGFLGKYPWLVTGFFFFMWYFLNVIFNILNKKIYNYFPYPYFVSAVHLFVGVVYCLLSWSVGLPKRAPIDSNLLKVLIPVAVCHAIGHITSNVSFAAVAVSFTHTIKALEPFFNASASQFLLGQSIPITLWLSLAPVVLGVAMASLTELSFNWLGFISAMISNISFTYRSIFSKKAMTDMDSTNVYAYISIIALIVCIPPAIIVEGPQLLKHGFSDAIAKVGMTKFISDLFWVGMFYHLYNQLATNTLERVAPLTHAVGNVLKRVFVIGFSIVIFGNKISTQTGIGTGIAIAGVALYSIIKAKIEEDKKKGKTA

SEQ ID NO: 4713 - protein, 401 aa, Brassica napus
MESRVLLRAAVTGVPQLRRPIGAIHRQVSTASSFTAFAKPIGSVGEGGNLISGRQLRPILLLDSSPEKREILKPVRAAAGDSAGEAKVGFLGKYPWLVTGFFFFMWYFLNVIFNILNKKIYNYFPYPYFVSAVHLFVGVVYCLLSWSVGLPKRAPINSNLLKVLIPVAVCHAIGHITSNISFAAVAVSFTHTIKALEPFFNASASQFLLGQSIPITLWLSLAPVVFGVAMASLTELSFNWLGFISAMISNISFTYRSIFSKKAMTDMDSTNVYAYISIIALIVCIPPAIIVEGPQLLKHGFSDAIAKVGMTKFISDLFWVGMFYHLYNQLATNTLERVAPLTHAVGNVLKRVFVIGFSIVIFGNKISTQTGIGTGIAIAGVAMYSIIKAKIEEDKKKGKTA

SEQ ID NO: 4714 - protein, 402 aa, Raphanus sativus
MESRVLLRATVAGLPQLRRPIGAIHRQLSTAPSSFTAFAKPIGSVGEGGNLISGRQLRPILLLDSSPEKREILKPVRAAAGDSAGETKDGFLGKYPWLVTGFFFFMWYFLNVIFNILNKKIYNYFPYPYFVSAVHLFVGVVYCLISWSVGLPKRAPIDSNLLKVLIPVAVCHAIGHITSNVSFAAVAVSFTHTIKALEPFFNASASQFLLGQSIPITLWLSLAPVVLGVAMASLTELSFNWLGFISAMISNISFTYRSIFSKKAMTDMDSTNVYAYISIIALIVCIPPAIIVEGPQLLKHGFSDAIAKVGMTKFLSDLFWVGMFYHLYNQLATNTLERVAPLTHAVGNVLKRVFVIGFSIVIFGNKISTQTGIGTGIAIAGVALYSIIKAKIEEDKKKGKTA

SEQ ID NO: 4715 - protein, 304 aa, Brassica napus
MESRVLLRAAVTGVPQLRRPIGAIHRQVSTASSFTAFAKPIGSVGEGGNLISGRQLRPILLLDSSPEKREILKPVRAAAGDSAGEAKVGFLGKYPWLVTGFFFFMWYFLNVIFNILNKKIYNYFPYPYFVSAVHLFVGVVYCLLSWSVGLPKRAPINSNLLKVLIPVAVCHAIGHITSNISFAAVAVSFTHTIKALEPFFNASASQFLLGQSIPITLWLSLAPVVLGVAMASLTELSFNWLGFISAMISNISFTYRSIFSKKAMTDMDSTNVYAYISIIALIVCIPPAIIVEGPQLLNTVSATR

SEQ ID NO: 4716 - protein, 438 aa, Brassica napus
TLCSTLRNVLNFSLSSHPSSLSQLIVPKTHCINLDDGVTRAATRHSHRSTAIETTDRCDPPSGQHCVVVLGFRFSAPIGSVGEGGNLISGRQLRPILLLDSSPEKREILKPVRAAAGDSAGEAKVGFLGKYPWLVTGFFFFMWYFLNVIFNILNKKIYNYFPYPYFVSAVHLFVGVVYCLLSWSVGLPKRAPIDSNLLKVLIPVAVCHAIGHITSNVSFAAVAVSFTHTIKALEPFFNASASQFLLGQSIPITLWLSLAPVVLGVAMASLTELSFNWLGFISAMISNISFTYRSIFSKKAMTDMDSTNVYAYISIIALIVCIPPAIIVEGPQLLKHGFSDAIAKVGMTKFISDLFWVGMFYHLYNQLATNTLERVAPLTHAVGNVLKRVFVIGFSIVIFGNKISTQTGIGTGIAIAGVALYSIIKAKIEEDKKKGKTA

SEQ ID NO: 4717 - protein, 412 aa, Arabidopsis lyrata
MESRVLLRATANVVGIPKLRRPIGAIHRQFSTASSSSSSFSVKPIGGIGEGANLISGRQLRPILLLDSSAINGGEKREILKPVKAAAAEGGDTAGEAKVGFLAKYPWLVTGFFFFMWYFLNVIFNILNKKIYNYFPYPYFVSVIHLFVGVVYCLISWSVGLPKRAPIDSNLLKVLIPVAVCHAIGHVTSNVSFAAVAVSFTHTIKALEPFFNAAASQFIMGQSIPITLWLSLAPVVLGVAMASLTELSFNWLGFISAMISNISFTYRSIFSKKAMTDMDSTNVYAYISIIALFVCIPPAIIVEGPKLLNHGFADAIAKVGMTKFISDLFWVGMFYHLYNQLATNTLERVAPLTHAVGNVLKRVFVIGFSIVIFGNKISTQTGIGTGIAIAGVAMYSIIKAKIEEEKRQGKKA

SEQ ID NO: 4718 - protein, 410 aa, Arabidopsis thaliana
MESRVLLRATANVVGIPKLRRPIGAIHRQFSTASSSSFSVKPIGGIGEGANLISGRQLRPILLLDSSAINGGEKREILKPVKAAAAEGGDTAGDAKVGFLAKYPWLVTGFFFFMWYFLNVIFNILNKKIYNYFPYPYFVSVIHLFVGVVYCLISWSVGLPKRAPIDSNLLKVLIPVAVCHALGHVTSNVSFAAVAVSFTHTIKALEPFFNAAASQFIMGQSIPITLWLSLAPVVLGVAMASLTELSFNWLGFISAMISNISFTYRSIFSKKAMTDMDSTNVYAYISIIALFVCIPPAIIVEGPKLLNHGFADAIAKVGMTKFISDLFWVGMFYHLYNQLATNTLERVAPLTHAVGNVLKRVFVIGFSIVIFGNKISTQTGIGTGIAIAGVAMYSIIKAKIEEEKRQGKKA

SEQ ID NO: 4719 - protein, 415 aa, Cleome spinosa
MESRVLSRATATIAGSPFFRRVHRHHNHHASAATVTFPAAVADGGNVISGRQLRPSLLLDNSSSAVIAEAVTGRRKREILRPTRAAASSSAEGGDSAGAAKVGFFDKYPALVTGFFFFMWYFLNVIFNILNKKIYNYFPYPYFVSVIHLFVGVVYCLVSWAVGLPKRAPIDSNLLKLLIPVAVCHGIGHVTSNVSFAAVAVSFTHTIKALEPFFNASASQFILGQSIPITLWLSLLPVVLGVSMASLTELSFNWTGFISAMISNISFTYRSIYSKKAMTDMDSTNVYAYISIIALFVCIPPAIIVEGPQLLKHGFNDAIAKVGMTKFISDLFWVGMFYHLYNQLATNTLERVAPLTHAVGNVLKRVFVIGFSIIIFGNKISTQTGIGTGIAIAGVAIYSLIKAKMEEEKRKGKAA

SEQ ID NO: 4720 - protein, 408 aa, Gossypium hirsutum
  Sequence also found in Organisms: Gossypium raimondii
MESRLLSRASVITGLPQLRPKLSPGIVNVSFASAKPIGAVGEGGNLIWGRQLRPSLLLECSSVSKREVLKPVSAAASSPAEGGSDSAGDGKIAPVGFFEKYPALVTGFFFFMWYFLNVIFNILNKKIYNYFPYPYFVSVIHLFVGVVYCLVSWAVGLPKRAPIDSNLLKLLIPVAVCHGLGHVTSNVSFAAVAVSFTHTIKALEPFFNAAASQFILGQSIPITLWLSLAPVVIGVSMASLTELSFNWTGFISAMISNISFTYRSIYSKKAMTDMDSTNVYAYISIIALFVCIPPALIFEGPQLLKHGFNDAIAKVGMTKFISDLFWVGMFYHLYNQLATNTLERVAPLTHAVGNVLKRVFVIGFSIIVFGNKISTQTGIGTVIAIAGVAAYSFIKAKMEEEKRQMKAA

SEQ ID NO: 4721 - protein, 408 aa, Theobroma cacao
MESRLLSRASTITGFPQLRPKLSRDSVNVSFASSKPIGAVGGGGNLIWGRQLRPALLLESSSVSKREILKPVSAAASSPAEGGSDSAGDAKIAPVGFFEKYPALVTGFFFFMWYFLNVIFNILNKKIYNYFPYPYFVSVIHLFVGVVYCLVSWAVGLPKRAPMDSNLLKLLIPVAVCHALGHVTSNVSFAAVAVSFTHTIKALEPFFNAAASQFILGQSIPFTLWLSLAPVVIGVSMASLTELSFNWTGFISAMISNISFTYRSIYSKKAMTDMDSTNVYAYISIIALFVCIPPAIILEGPQLIKHGFGDAIAKVGMTKFISDLFWVGMFYHLYNQLATNTLERVVPLTHAVGNVLKRVFVIGFSILIFGNKISTQTGIGTVIAIAGVAIYSFIKARMEEEKRQMKAA

SEQ ID NO: 4722 - protein, 408 aa, Manihot esculenta
MESRVLSRATTTTVHSLPHLRRPMRESSTSSFVSMKPIGAVGEGGNIIWGRQLRPSLLLESSPAGKREILRQNMAAASSPAEGSDSSGDAKIAPVGFFNKYPALVTGFFFFMWYFLNVIFNILNKKIYNYFPYPYFVSVIHLFVGVVYCLVSWAVGLPKRAPIDSKLLKVLIPVALCHAIGHVTSNVSFAAVAVSFTHTIKALEPFFNAAASQFILGQSIPITLWLSLAPVVIGVSMASLTELSFNWLGFISAMISNISFTYRSIYSKKAMTDMDSTNVYAYISIIALIFCIPPAIIVEGPQLLNVGFKDAIAKVGMTKLISDLFWVGMFYHLYNQLATNTLERVAPLTHAVGNVLKRVFVIGFSIVVFGNKISTQTGIGTCIAIAGVAIYSFLKAKIEEEKRQKKAA

SEQ ID NO: 4723 - protein, 406 aa, Ricinus communis
MESRVLSRATTTLSSLPHLRRPMRESNTTSFVSMKPIGTVGEGGNLIWGRQLRPSLLLESSPATKRENLRPTMAAASSPAEGSDSSGDKVAPVGFFEKYPALVTGFFFFMWYFLNVIFNILNKKIYNYFPYPYFVSVIHLLVGVVYCLVSWAVGLPKRAPIDSNLLKLLIPVAVCHALGHVTSNVSFAAVAVSFTHTIKALEPFFNAAASQFILGQSIPITLWLSLAPVVIGVSMASLTELSFNWIGFISAMISNISFTYRSIYSKKAMTDMDSTNIYAYISIIALFVCIPPAIIFEGPQLMKYGFNDAIAKVGTTKFITDLFWVGMFYHLYNQLATNTLERVAPLTHAVGNVLKRVFVIGFSIVVFGNKISTQTGIGTCIAIAGVAMYSFLKAKIEEEKRQGKTA

SEQ ID NO: 4724 - protein, 408 aa, Gossypium hirsutum
MESRLLSRASVITGLPQLRPKLSPGIVNVSYASAKPIGAVGEGGNAIWRRQLRPSLLLECSSVSKREVLKPVSAAASSPAEGGSDSAGEGKIAPVGFFEKYPALVTGFFFFMWYFLNVIFNILNKKIYNYFPYPYFVSVIHLFVGVVYCLVSWAVGLPKRAPIDSNLLKLLIPVAVCHGLGHVTSNVSFAAVAVSFTHTIKALEPFFNAAASQFILGQSIPITLWLSLAPVVIGVSMASLTELSFNWTGFISAMISNISFTYRSIYSKKAMTDMDSTNVYAYISIIALFVCIPPALIFEGPQLLKHGFNDAIAKVGMTKFISDLFWVGMFYHLYNQLATNTLERVAPLTHAVGNVLKRVFVIGFSIIVFGNKISTQTGIGTAVAIAGVAAYSFIKAKMEEEKRQMKAA

SEQ ID NO: 4725 - protein, 410 aa, Cleome spinosa
MESRVLSRAAATVAGSPFLRRIHRPHNHHVPTTVTFPAAVCDGGNVISGRQLRPILLLESSSAAAVSDGGRREILRPPRAAASSSAGSGNSAGEAKVGFFDKYPALVTGFFFFMWYFLNVIFNILNKKIYNYFPYPYFVSLIHLFVGVVYCLVSWAVGLPKRAPIDANLLKVLIPVAVCHAIGHVTSNVSFAAVAVSFTHTIKALEPFFNASASQFILGQPIPITLWLSLAPVVLGVSMASLTELSFNWTGFISAMISNISFTYRSIYSKKAMTDMDSTNVYAYISIIALFVCIPPAVIVEGPQLLKHGFSEAIAKVGMTKFISDLFWVGMFYHLYNQLATNTLERVAPLTHAVGNVLKRVFVIGFSIIVFGNKISTQTGIGTCIAIAGVAMYSLIKARLEEEKRKGKAA

SEQ ID NO: 4726 - protein, 401 aa, Euphorbia peplus
LSRATTTSVVSLPHLRRASRDGSNGSSLVSMKPIGAVGEAGNLIWGRQLRPSLLLESSSPKRENLRPVMAGAASTPAAGGDSSGEAPVGFLDKYPALVTGFFFFMWYFLNVIFNILNKKIYNYFPYPYFVSVIHLFVGVVYCLGSWAVGLPKRAPIDSKLLGVLVPVAVCHALGHVTSNISFAAVAVSFTHTIKALEPFFNASASQFILGQPIPLSLWLSLAPVVLGVSMASLTELSFNWLGFISAMISNISFTYRSIYSKKAMTDMDSTNVYAYISIIALFVCIPPAIIFEGPQLLKHGFSDAIAKVGMTKFITDLFWVGMFYHLYNQLATNTLERVAPLTHAVGNVLKRVFVIGFSIVIFGNKISTQTGIGTCIAIAGVAIYSFLKAKIEEEKRQAKAA

SEQ ID NO: 4727 - protein, 408 aa, Gossypium raimondii
MESRLLSRASTIAGLPQIRPKLSRDCLSVSFASAKPIGAVGEGGNVIWGRQLRPSLLLESSLANKREILKPVLASASSAAGGGSDSAGDAEIAPVGFFQKYPALVTGFFFFMWYFLNVIFNILNKKIYNYFPYPYFVSVIHLFVGVVYCLISWAVGLPKRAPIDSNLLKLLIPVAVCHALGHVTSNVSFAAVAVSFTHTIKALEPFFNAAASQFILGQSIPLTLWLSLAPVVIGVSMASLTELSFNWTGFISAMISNISFTYRSIYSKKAMTDMDSTNVYAYISIIALFVCIPPAIIFEGPQLMKHGFTDAIAKVGMTKFISDLFWVGMFYHLYNQLATNTLERVAPLTHAVGNVLKRVFVIGFSILAFGNKISTQTGIGTAIAIAGVAMYSFIKARMEEEKRQMKAA

SEQ ID NO: 4728 - protein, 407 aa, Manihot esculenta
MESRVLSRATTAIGSLPPLRRSMRECNASSFVSMKPIGAVGEGGNLIWGRQLRPYLLLDSSPTGKREILRPNMAAASSPAEGSDSSGDAKVAPVGFFEKYPALVTGFFFFMWYFLNVIFNILNKKIYNYFPYPYFVSVIHLFVGVVYCLVSWAVGLPKRAPIDSNLLKLLIPVALCHAIGHVTSNVSFAAVAVSFTHTIKALEPFFNAAASQFILGQSIPLSLWLSLAPVVIGVSMASLTELSFNWIGFISAMISNISFTYRSIYSKKAMTDMDSTNLYAYISIIALIACIPPAIILEGPQLLKYGFNDAIAKVGMVKFVSDLFWVGMFYHLYNQLATNTLERVAPLTHAVGNVLKRVFVIGFSIVVFGNKISTQTGIGTSIAIAGVAIYSFLKAKIEEEKRQKKAA

SEQ ID NO: 4729 - protein, 414 aa, Chelidonium majus
MESRVLSGATSTSAGLIRLRKPARDSNSTTTASFLSTKSIGDVSGGGNLIWGRQLRPSLLLEKSPMIKLSSGKREILKPILAAASSPSGGSDSAGEAKAKVGFLEKYPALVTGFFFFMWYFLNVIFNILNKKIYNYFPYPYFVSVVHLFVGVVYCTISWGVGLPKRAPMDSNQLKLLIPVAVCHALGHVTSNVSFAAVAVSFTHTIKALEPFFNASASQFILGQPIPITLWLSLAPVVLGVSMASLTELSFNWLGFISAMISNISFTYRSIYSKKAMTDMDSTNLYAYISIIALFVCIPPAILIEGPQLLKHGFSDAIAKVGLVKFISDLFWVGMFYHLYNQLATNTLERVAPLTHAVGNVLKRVFVIGFSIVIFGNKISTQTAIGTSIAIAGVALYSYIKAKIEEEKRQAKAA

SEQ ID NO: 4730 - protein, 408 aa, Fragaria vesca
MESRVLSRATAFASSVPSLRKSSPRHPAAVSFAASPRRPIGAVSEGGNLIWGRQLRPALLLEASPSPSRRDALKPCRAAAAGGSDSAGEAKPAPVGFLGKYPWLVTGFFFFMWYFLNVIFNILNKKIYNYFPYPYFVSVIHLAVGVVYCLISWAVGLPKRAPMDSNQLKLLIPVAACHALGHVTSNVSFAAVAVSFTHTIKALEPFFNASASQFILGQSIPLSLWLSLAPVVLGVSMASLTELSFNWLGFISAMISNISFTYRSIYSKKAMTDMDSTNLYAYISIIALFFCLPPALILEGPQLLKHGFADAIAKVGLVKFITDLVWVGLFYHLYNQLATNTLERVAPLTHAVGNVLKRVFVIGFSIVIFGNKISTQTGIGTAIAIAGVAIYSYLKAKIEEEKRQAKAA

SEQ ID NO: 4731 - protein, 297 aa, Raphanus sativus
MWYFLNVIFNILNKKIYNYFPYPYFVSVIHLFVGVVYCLLSWSVGLPKRAPINSNILKVLIPVAVCHAIGHVTSNVSFAAVAVSFTHTIKALEPFFNASASQFLLGQPIPITLWLSLAPVVLGVAMASLTELSFNWLGFISAMISNISFTYRSIFSKKAMTDMDSTNVYAYISIIALFVCLPPAIIVEGPQLLKHGFNDAIAKVGMTKFISDLFWVGMFYHLYNQLATNTLERVAPLTHAVGNVLKRVFVIGFSIVIFGNKISTQTGIGTGIAIAGVALYSVIKAKIEEEKRQGKTA

SEQ ID NO: 4732 - protein, 404 aa, Fagus grandifolia
MESRVLSRATTFASFSQLRKPPRENNNSSNSVSFVSARPIGAVGEGGNLIWGRQLRPILLLESSGKPRLAAASSSPAEGSDSAGEAKIAPVGFLNKYPFLITGFFFFMWYFLNVIFNILNKKIYNYFPYPYFVSVVHLFVGVVYCLVSWAVGLPKRAPIDSNLLKLLIPVAVCHALGHVTSNVSFAAVAVSFTHTIKALEPFFNAAASQFILGQSIPITLWLSLAPVVLGVSMASLTELSFNWVGFISAMISNISFTYRSIYSKKAMTDMDSTNLYAYISIIALFVCIPPAIILEGPQLMKYGFSDAITKVGQTKFISDLFWVGMFYHLYNQLATNTLERVAPLTHAVGNVLKRVFVIGFSIIIFGNKISTQTGIGTAIAIAGVAIYSYIKAKMEEEKRASKAA

SEQ ID NO: 4733 - protein, 408 aa, Populus trichocarpa
MESRVLSRATTVAHVRRPLRESNGNTSCSLLSIKPIGAVSEGGNLIWGRQLRPSLLLEASYPVTARKEILRPVMAAASSPAEGSDSSGDGKVAPVGFFDKYPALVTGFFFFMWYFLNVIFNILNKKIYNYFPYPYFVSVIHLFVGVVYCLVSWAVGLPKRAPIDSNLLKLLIPVAVCHALGHVTSNVSFAAVAVSFTHTIKALEPFFNAAASQFILGQQIPITLWLSLAPVVLGVSMASLTELSFNWTGFISAMISNISFTYRSIYSKKAMTDMDSTNIYAYISIIALIVCIPPAIIFEGPQLIKHGFSDGIAKVGLTKFISDLFWVGMFYHLYNQLATNTLERVAPLTHAVGNVLKRVFVIGFSIVIFGNKISTQTGIGTAVAIAGVATYSYIKAKMEEEKRQGKAA

SEQ ID NO: 4734 - protein, 408 aa, Populus trichocarpa
MESRVFSHATTIAHVRRPLRESHSNTSCSFISIKPIGAVGEGGNLIWGRQLRPSLLLEASSPMNARKDILRPVMAAASSPAEGSDSSGDGKVAPIGFFDKYPALVTGFFFFMWYFLNVIFNILNKKIYNYFPYPYFVSVIHLFVGVVYCLVSWTVGLPKRAPIDSNLLKLLIPVAVCHALGHVTSNVSFAAVAVSFTHTIKALEPFFNAAASQFVLGQSIPITLWLSLLPVVLGVSMASLTELSFNWTGFISAMISNISFTYRSLYSKKAMTDMDSTNIYAYISIIALLVCIPPAILVEGPQLIKHGFNDAIAKVGLTKFISDLFWVGMFYHLYNQLATNTLERVAPLTHAVGNVLKRVFVIGFSILIFGNKISTQTGIGTGIAIAGVATYSYIKAKMEEEKRRGKAA

SEQ ID NO: 4735 - protein, 408 aa, Gossypium hirsutum
MESRLLSRASTIAGLPQIRPKLSRDCLSVSFASAKPIGAVGEGGNVIWGRQLRPSLLLESSLANKREILKPVLASASSAAGGGSDSAGDAEIAPVGFFQKYPALVTGFFFFMWYFLNVIFNILNKKIYNYFPYPYFVSVIHLFVGVIYCLISWAVGLPKRAPIDSNLLKLLIPVAVCHALGHVTSNVSFAAVAVSFTHTIKALEPFFNAAASQFILGQSIPLTLWLSLAPVVIGVSMASLTELSFNWTGFISAMISNISFTYRSIYSKKAMTDMDSTNVYAYISIIALFVCIPPAIIFEGPQLMKHGFTDAIAKVGMTKFISDLFWVGMFYHLYNQLATNTLERVAPLTHAVGNVLKRVFVIGFSILAFGNKISTQTGIGTAIAIAGVAMYSFIKARMEEEKRQMKAA

SEQ ID NO: 4736 - protein, 406 aa, Panax ginseng
MESRVLSGATTIYGIPRLSKPVAKLNTVTFSTSRSIRAVSDGGNLIWGRQLRPAILLETSPASKREILKPTFAAASSPAEGSDSGGDAKVGPVGFLQKYPALVTGFFFFMWYFLNVIFNILNKKIYNYFPYPYFVSVIHLAVGVVYCLGSWTVGLPKRAPIDSNLLKLLIPVAVCHALGHVTSNVSFAAVAVSFTHTVKALEPFFNAAASQFILGQSIPITLWLSLAPVVLGVSMASLTELSFNWLGFISAMISNISFTYRSIYSKKAMTDMDSTNLYAYISIIALFVCIPPAIILEGPQLLKHGFSDAIAKVGLTKFISDLFWVGMFYHLYNQLATNTLERVAPLTHAVGNVLKRVFVIGFSIVIFGNKISTQTAIGTSIAIAGVAMYSFIKAKIEEEKRQAKAA

SEQ ID NO: 4737 - protein, 409 aa, Euonymus alatus
MESRVLSRAAAFSAVPRLPRESGNSGSVVAVRPIGAIGEGGNLIWGRQLRPALLLESSPASCVLSGKRENLRPCFAAASSPAEGSDSAGEQKVVPVGFFNKYPALVTGFFFFMWYFLNVIFNILNKKIYNYFPYPYFVSVIHLLVGVVYCLVSWAVGLPKRAPIDSKLLKLLIPVAVCHALGHVTSNISFAAVAVSFTHTIKALEPFFNASASQFLLGQPIPVTLWLSLAPVVLGVSMASLTELSFNWTGFISAMISNISFTYRSLYSKKAMTDMDSTNVYAYISIIALFVCIPPAIIFEGPQLMKHGFNDAITKVGTTKFISDLFWVGMFYHLYNQLATNTLERVAPLTHAVGNVLKRVFVIGFSILVFGNKISTQTGIGTCIAIAGVAIYSYIKAQIEEEKRRTKAA

SEQ ID NO: 4738 - protein, 400 aa, Euphorbia esula
MESRVLSRATTSAVVSLPHLRRASRDGSNASSLVSMKPIGAVGEAGNLIWGRQLRPSLLLESSSPAAKREILRPIMAAASSPAAGGDSSGDGKVAPVGFLEKYPALVTGFFFFMWYFLNVIFNILNKKIYNYFPYPYFVSVIHLFVGVVYCLGSWAVGLPKRAPIDSKLLGVLIPVAVCHALGHVTSNISFAAVAVSFTHTIKALEPFFNAAASQFILGQSIPLSLWLSLAPVVLGVSMASLTELSFNWLGFISAMISNISFTYRSIYSKKAMTDMDSTNVYAYISIIALFVCLPPAIIIEGPQLLKHGFSDAIAKVGMTKFITDLFWVGMFYHLYNQLATNTLERVAPLTHAVGNVLKRVFVIGFSIVIFGNKISTQTGIGTCIAIAGVAIYSYLKAKI

SEQ ID NO: 4739 - protein, 408 aa, Quercus alba
MESRVLSRASTFASLSQLRKPPRENNNNNNSVSFVSARPIGAVGEGGNLIWGRQLRPALLLESSSAGKQRESVKPCLAAASSSPGSDSAGEAKPVGFIEKYPALVTGFFFFMWYFLNVIFNILNKKIYNYFPYPYFVSVVHLFVGVVYCLVSWAVGLPKRAPMDSNLLKLLFPVAVCHALGHVTSNVSFAAVAVSFTHTIKALEPFFNAAASQFILGQSIPITLWLSLAPVVLGVSMASLTELSFNWVGFISAMISNISFTYRSIYSKKAMTDMDSTNLYAYISIIALFVCIPPAIILEGPKLMKHGFGDAITKVGLTKFITDLFWVGMFYHLYNQLATNTLERVAPLTHAVGNVLKRVFVIGFSIIVFGNKISTQTGIGTAIAIAGVAIYSYIKAKMEEEKRQAKAA

SEQ ID NO: 4740 - protein, 400 aa, Euphorbia peplus
MESRVLSRATTSAVVSLLHLRRASRDGSNASSLVSMKPIGAVGEAGNLIWGRQLRPSLLLESSSPAAKREILRPIMAAASSPAAGGDSSGDGKVAPVGFLEKYPALVTGFFFFMWYFLNVIFNILNKKIYNYFPYPYFVSVIHLFVGVVYCLGSWAVGLPKRAPIDSKLLGVLIPVAVCHALGHVTSNISFAAVAVSFTHTIKALEPFFNAAASQFILGQSIPLSLWLSLAPVVLGVSMASLTELSFNWLGFISAMISNISFTYRSIYSKKAMTDMDSTNVYAYISIIALFVCLPPAIIIEGPQLLKHGFSDAIAKVGMTKFITDLFWVGMFYHLYNQLATNTLERVAPLTHAVGNVLKRVFVIGFSIVIFGNKISTQTGIGTCIAIAGVAIYSYLKAKI

SEQ ID NO: 4741 - protein, 406 aa, Panax ginseng
MESRVLSGATTIYGIPRLSKPVAKLNTVPFSTSRPSRTVSDGGNLIWGRQLRPAILLETSPASKLEILKPTLAAASSPAEGSDSAGDAKVGPVGFLQKYPALVTGFFFFMWYFLNVIFNILNKKIYNYFPYPYFVSVIHLAVGVVYCLGSWTVGLPKRAPIDSNLLKLLIPVAVCHALGHVTSNVSFAAVAVSFTHTVKALEPFFNAAASQFILGQSIPTTLWLSLAPVVLGVSMASLTELSFNWLGFISAMISNISFTYRSIYSKKAMTDMDSTNLYAYISIIALFVCIPPAIILEGPQLLKHGFSDAIAKVGLTKFISDLFWVGMFYHLYNQLATNTLERVAPLTHAVGNVLKRVFVIGFSIVVFGNKISTQTAIGTSIAIAGVAMYSFIKAKIEEEKRQAKAA

SEQ ID NO: 4742 - protein, 404 aa, Mesembryanthemum crystallinum
MESRVLSRATAIAALPRLSRPRREAASLGIAAVKPVGAVKDGGNLIWGRQLRPVLLLEPVQTGPVSRKESTAVQPCRAAAEGSDSAGEAKVGFLQKYPALVTGFFFFMWYFLNVIFNILNKKIYNYFPYPYFVSVIHLLVGVIYCLVSWAVGLPKRAPIDGNLLKLLIPVALCHALGHVTSNVSFAAVAVSFTHTIKALEPFFNASASQFILGQPIPITLWLSLAPVVLGVAMASLTELSFNWTGFISAMISNISFTYRSIYSKKAMTDMDSTNVYAYITIIALFVCIPPALIIEGPQLIKYGFNDAIAKVGLTKFITDLFWVGMFYHLYNQLATNTLERVAPLTHAVGNVLKRVFVIGFSIIIFGNKISTQTAIGTSIAIAGVAIYSFIKGKMEEEKRQKKAA

SEQ ID NO: 4743 - protein, 409 aa, Amsonia hubrichtii
MESRVLSGATTIHGLPRLGKPAAAISRFSNTTASFPTTKPVGAVGDGGNLIWGRQLRPAILLEASPVPKREVLIRPCQTAASSPAEGSDSSGDAKVGFLEKYPALVTGFFFFMWYFLNVIFNILNKKIYNYFPYPYFVSVIHLFVGVVYCLLSWSVGLPKRAPMDSNLLKLLIPVAFCHALGHVTSNVSFAAVAVSFTHTIKALEPFFNAAASQFILGQPIPLTLWLSLAPVVIGVSMASLTELSFNWTGFISAMISNISFTYRSIYSKKAMTDMDSTNLYAYISIIALIVCIPPALILEGPVLMKGGFTDAIAKVGLTKFISDLFWVGMFYHLYNQVATNTLERVAPLTHAVGNVLKRVFVIGFSIIAFGNKISTQTGIGTAIAIAGVAIYSFIKAKMEEEKRQKKAA

SEQ ID NO: 4744 - protein, 406 aa, Vitis vinifera
MESRVLSGATTISGLVRLRKPVRDTVCFAPARPIGAVGDGGNLIWGRQLRPALILESAPVVGMTTGKREILRPTMASTSSPAEGSDSAGDAKIGFLDKYPALVTGFFFFMWYFLNVIFNILNKKIYNYFPYPYFVSVIHLFVGVVYCLVSWGVGLPKRAPIDSNLLKLLIPVAVCHALGHVTSNVSFAAVAVSFTHTIKALEPFFNAAASQFILGQSIPLTLWLSLAPVVLGVSMASLTELSFNWIGFISAMISNISFTYRSIYSKKAMTDMDSTNIYAYISIIALIVCIPPALIVEGPQLMKHGFNDAIAKVGLTKFLSDLFWVGMFYHLYNQLATNTLERVAPLTHAVGNVLKRVFVIGFSILVFGNKISTQTGIGTCVAIAGVAMYSFIKAKMEEEKRQLKSA

SEQ ID NO: 4745 - protein, 474 aa, Medicago truncatula
MYRVAKASEYLVITGAGIEDIKLAKKSWVFPGQSCTVFDLSPVNYTFEVQAMSAEKLPFVLPAVFTIGPRVDDQESLLKYAKLISPHDKLSNHVKELVQGIIEGETRVLAASMTMEEVFRGTKEFKQEVFEKVQLELNQFGLLIYNANVKQLVDVPGHEYFSYLGQKTQMEAANQARVDVSEAKMKGEVGSKSREGQTLQNAAKINAETKIIAMQRAGESDKEGFRVRTEVKVFENQREAEVAEANSELAKKKAAWTKAAQVAEVEAAKAVALREAELQGEVERMNALTTTEKLKADLLSKASVQYETKVQEANWELYKKQKEAEAILYEKKAEAEAQKALADATFYARKQAAEAELYAKKKEAEGIVTLGNAQGVYVSTLLNALGNDYTALRDYLMINGGMFQEMAKINAEAVHGLEPKISIWTNGGGITEGSMGMKEVAGVYKMLPPLFKTVHEQTGMLPPAWMGTLSDKSS

SEQ ID NO: 4746 - protein, 472 aa, Medicago truncatula
MKIYRVAKASEYLVITGILIKDIKLAKKAWILPGQSCSVLDLSPVNYTFEVQAMSAEKLPFVLPAVFTIGPRVDDKESLLKYAKLISPHARHSNHVNELVQGIIEGETRVLAASMTMEEVFRGTKQFKQEVFDKVQLELNQFGLLIYNANVKQLVDVRGHEYFSYLGQKTQMEAKNQARVDVAEAKMKGEIGSKLREGQTLQNAAKIDAETKVIAMQRAGEGEKEGIKVRTEVKVFENQREAEVAQANSELAKKKAAWTKAAQVAEVEAKKAVKLREAELQGEVERMNALTTTEKLKAEFLSKASVQYETKVQEANWELYKKQKEAEAILYEKKAEAEAQKASADATFYASKQAAEAELYAKKKEAEGIVTVGQAQGVYVSKLLNALGNDYTAVRDYLMINGGMFQEIAKINAEAIRGLEPKISIWTNGGEAGGMKEVAGVYKMLPPLFKTVHEQTGMLPPAWMGVLPDKNS

SEQ ID NO: 4747 - protein, 478 aa, Medicago truncatula
MYRVAKASEYLVITGAGIDDVKLEKKAWIFPGQSCTVFDLSPVNYTFEVQAMSAEKLPFVLPAVFTIGPRVDDYESLLKYAKLISPHDKLSNHVNELVQGIIEGETRVLVASMTMEEVFRGTKEFKQEVFDKVQLELNQFGLWIYNANVKQLVDVPGHEYFSYLGQKTQMEAANQARVDVAEAKMKGEIGSKLREGQTIQNAAKIDAETKVIAMQRAGEGEKQGIKVRTEVKVFENQREAEVAEANSELAKKKAAWTMAAQVAELEAAKAVALREAELQGEVERMNALTTTEKLKADFLSKASVEYDTKVQEANWELYKKQKEAEAILYEKKAEAEAQKALADSTFYARKQEAEAELYAKKKEAEGIMTLGNAQGAYVSTLLNALGNNYTAVRDYLMINGGMFQEIAKINAEAVRGLEPKISIWTNGGDNNGGITEGAMGMKEVAGVYKMLPPLFKTVHEQTGMFPPAWMGSLPDKNS

SEQ ID NO: 4748 - protein, 480 aa, Medicago truncatula
MKIYRVAKASEYLVITGIFIKDIKLKKKAWIFPGQSCTVLDLSPVNYTFEVQAMSAEKLPFVLPAVFTIGPRVDDQESLLKYAKLISPHDRHSNHVNELVQGIIEGETRVLAASMTMEEVFRGTKQFKQEVFDKVQLELNQFGLLIYNANVKQLVDVPGHEYFSYLGQKTQMEAKNQARVDVSEAKMKGEIGSKLREGQTLQNAAKIDAETKVIAMQRAGEGEKEGIKVRTEVKVFENQREAEVAQANSELAKKKAAWTKAAQVAEVEAKKAVALREAELQGEVERMNALTTTEKLKAEFLSKASVQYETKVQEANWELYKKQKETEAILYEKKAEAEAQKASADATFYASKQAAEAELYAKKKEAEGIVTLGQAQGAYVSTLLNALGNDYTAVRDYLMINGDMFQEIAKINAEAIRGLEPKISIWTNGGDNSGGITDGAMGMKEVAGVYKMLPPLFKTVHEQTGMLPPAWMGALSEKSS

SEQ ID NO: 4749 - protein, 476 aa, Medicago truncatula
MYRVAKASEYLVLTGAGIEDIKLAKKSWIFPGQSSTVFDLSPVNYTFEVQAMSAEKLPFVLPAVFTIGPRVDDHESLLKYAKLISPHDKLSNHVKELVQGIIEGETRVLAASMTMEEVFKGTKEFKQEVFEKVQLELNQFGLLIYNANVKQLVDVPGHEYFSYLGQKTQMEAANQARVDVAEAEMKGEVGSKSREGQTLQNAAKIDAETKVIAMQRAGESNKEGFRVRTEVKVFENQREAEANSELAMKKAAWTKAAQVAQVEAAKSVVLREAELQGEVEKMNALKNCTEKLKADLLSKASVQYETKVSLANWELYKKQKEAEAILYEKKAEAEAQKALADATFYACKQAAEADLYAKKKEAEGIVTLGNAQGAYVSTLLNALGNDYTALRDYLMINGGMFQEMAKINAEAVRGLEPKISIWTNGGDNGGGITEGSMGMKEVAGVYKMLPPLFKTVHEQTGMLPPAWMGTLSDKSS

SEQ ID NO: 4750 - protein, 449 aa, Medicago truncatula
MYRVAKASEYLVITGAGIEDIKLAKKSWIFPGQSCTVFDLSPVNYTFEVQAMSAEKLPFVLPAVFTIGPRVDDQESLLKYAKLISPHDKLSNHVKELVQGIIEGETRVLAASMTMEEVFRGTKEFKQEIFKKVQLELNQFGLLIYNANVKQLVDVPGHEYFSYLGQKTQMEAANQARVDVSEAKMKGEVGSKSREGQTLQNAAKIDAETKIIAMQRAGESDKEGFRVRTEVKVFENQREAEVAEANSKRAELQGEVERMNALTTTEKLKADLLSKASVEYETKVQEANWELYKKQKEAEAILYEKKAEAEAQKALSDATFYARKQAAEAELYAKKKEAEGIVTLGNAQGVYVSTLLNALGNDYTALRDYLMINGGMFQEMAKINAEAVRGLEPKISIWTNGGDNGGEGSMGMKEVAGVYKMLPPLFKTVHEQTGMLPPAWIGTLSDKSS

SEQ ID NO: 4751 - protein, 455 aa, Trifolium pratense
AWVLPGQSCTVFDLSPVNYTFEVQAMSAEKLPFVLPAVFTIGPRVDDHESLLKYAKLITPHDKLSHHVKELVQGIIEGETRVLAASMTMEEVFRGTKEFKQEVFGKVQLELNQFGLLIYNANVKQLVDVPGHEYFSYLGQKTQMEAANQARVDVAEARMKGEIGSKLREGQTLQNAAKIDAETKVIAMQRAGEGDKEGIKVRTEVKVFENKREAEVAEANSELAKKKAAWTKAAQVAEVEAAKAVALREAELQGEVERMNALTTTEKLKAEFLSKASVQYETKVQEANWELYKKQKEAEAVLFEKKAEAEAQIALADATFYARKQTAEAELYAKKKEAEGIMTLGQAQGVYVNTLFNALGGNYYALRDYLMINGGMYQEIAKINAEAIRGLEPKISIWSNGGDSGGGITEGGMKEVAGVYKMLPPLFKTVHEQTGMLPPAWMGTFSDKKTYDKKT

SEQ ID NO: 4752 - protein, 457 aa, Trifolium pratense
AWVLPGQSCTVFDLSPVNYTFEVQAMSAEKLPFVLPAVFTIGPRVDDHESLLKYAKLITPHDKLSHHVKELVQGIIEGETRVLAASMTMEEVFRGTKEFKQEVFGKVQLELNQFGLLIYNANVKQLVDVPGHEYFSYLGQKTQMEAANQARVDVAEARMKGEIGSKLREGQTLQNAAKIDAETKVIAMQRAGEGDKEGIKVRTAVKVFENQREAEVAEANSELAKKKAAWTKAAQVAEVEAAKAVALREAELQGEVERMNALTTTEKLKAEFLSKASVEYETKVQEANWDLYKKQKDSEAILYEKKAEAEAQIALADATFYARKQAAEAELYAKTKEAEGIVTLGNAQGVYVSTILNALGGNYYALRDYLMINGGMYQEIAKINAEAIRGLEPKISIWSNGGDSGGKISEDAIGMKEVAGVYKMLPPLFKTVHEQTGMLPPAWMGTFSDKKTYDKKT

SEQ ID NO: 4753 - protein, 476 aa, Glycine max
MYKVANASEYLVITGVGITDIKLAKKAWVLPGQSCTVFDLSPVNYTFEVQAMSAEKLPFILPAVFTIGPRVEDEDSLLKYARLLSSHDKLSHHVKELVQGIIEGETRVLAASMTMEEIFRGTKSFKQEVFEKVQLELNQFGLLIYNANVKQLVDVPGHEYFSYLGQKTQMEAANQAKVDVAEAKMKGEVGSKQRQGQTLQNAAKIDAETKIISTQRQGDGKKEEIKVRTEVKVFENEREAVVAEANSELAKKKAVWAQTAQVAEVEAAKAVALREAELQREVERMNALTRTEKLKAEFLSKASVEYETKVQEANWELYKKQKAAEAILFEKEKEAEAQKALAEAAFFSRQQEAEAELFAKKKEAEGLVALGQAQGAYLKTLLGALGGNYGNLRDYLMINSGMFQEIAKTNADAIRGLEPKISIWTNGGDTNDGYGSGAMKDVAGVYKMLPPLFKTVHEQTGMLPPAWMGTLPDNGS

SEQ ID NO: 4754 - protein, 511 aa, Ricinus communis
MYIYIYIFQSASSHKQSSSFSATYLHRLTNMYRVASPSEFLVITGVGISDIKLAKKAWVLPGQSCSVFDVSPVNYTFEVQAMSAEKLPFVLPAVFTIGPRVDDDQSLLKYAKLISPHDKLSHHVKELVQGIIEGETRVLAASMTMEEIFKGTKEFKQEVFEKVQLELNQFGLLIYNANVKQLVDVPGHEYFSYLGQKTQMEAANQARVDVAEAKMKGEIGSKEREGQTLQNAAKIDAETKIIATQRQGEGKKEEIKVKTEVKIYENQREAEVAEVNAELAKKKAGWAKEAQVAEVEASKAVTLRDAELQREVERMNALTRIEKLKAEFLSKASVEYETKVQEANWELYKKQKEAEAILYEKEKEAEAQKAIADATYYARQQVADGELYAKQKEAEGLVALAQAQGTYLRTLLDALGGNYAALRDFLMINGGMFQEIAKVNAEAVRGLQPKISIWSNGADNSNSNNNISDGGLKEVAGVYKMLPPLLKTVQEQTGMLPPAWMATLTDSSAHS

SEQ ID NO: 4755 - protein, 481 aa, Ricinus communis
MYRVASPSEFLVITGVGISDIKLAKKAWVLPGQSCSVFDVSPVNYTFEVQAMSAEKLPFVLPAVFTIGPRVDDDQSLLKYAKLISPHDKLSHHVKELVQGIIEGETRVLAASMTMEEIFKGTKEFKQEVFEKVQLELNQFGLLIYNANVKQLVDVPGHEYFSYLGQKTQMEAANQARVDVAEAKMKGEIGSKEREGQTLQNAAKIDAETKIIATQRQGEGKKEEIKVKTEVKIYENQREAEVAEVNAELAKKKAGWAKEAQVAEVEASKAVTLRDAELQREVERMNALTRIEKLKAEFLSKASVEYETKVQEANWELYKKQKEAEAILYEKEKEAEAQKAIADATYYARQQVADGELYAKQKEAEGLVALAQAQGTYLRTLLDALGGNYAALRDFLMINGGMFQEIAKVNAEAVRGLQPKISIWSNGADNSNSNNNISDGGLKEVAGVYKMLPPLLKTVQEQTGMLPPAWMATLTDSSAHS

SEQ ID NO: 4756 - protein, 471 aa, Cajanus cajan
MYRVANASEYLVITGVGIADIKLAKKAWVLPGQSCTVFDLSPVNYTFEVQAMSAEKLPFILPAVFTIGPRVDDNSSLLKYAKLLSSHDKLSHHVKELVQGIIEGETRVLAASMTMEEIFRGTKSFKQEVFEKVQLELNQFGLLIYNANVKQLVDVPGHEYFSYLGQKTQMEAANQAKVDVAEAKMKGEVGAKMREGQTLQNAAKIDAETNIISTQRHGAGKKEEIKVRTEVKVFENEREAEVAEANSELAKKKAVWAQAAQVAEVEAAKAVALREAELQREVERMNALTTTEKLKAEFLSKASVDYETKVQEANWELYKKQKGAEAILFEKEKEAEAQKALAEAAFFSRQQAAEAELFAKKKEAEGLVALGHAQGAYLSTLLAALGGNYANLRDYLMINNGMFQQIAKTNADAIRGLQPKISIWTNDGNANGMKDVAAVYKMLPPLFQTVHDQTGMLPPTWMGTLPDNSSN

SEQ ID NO: 4757 - protein, 482 aa, Gossypium hirsutum
MYYKVANASEYLVITGVGIQDIKLAKKAWILPGQSYTVFDLSPVNYTFEVQAMSAEKLPFVLPAVFTIGPRVDDEPSLLKYAKLISPHDKLSNHVKELVQGIIEGETRVLAASMTMEEIFKGTKEFKLEVFEKVQLELNQFGLLIYNANVKQLVDVPGHEYFSYLGQKTQMEAANQAKVDVAEARMKGEIGSKLREGQTLQNAARIDAETKIISTQRQGEGKKEEIKVKTEVKVYENQREAEIAEANADLAKKKASWAKEAQVAEVESAKAVALREAELQREVERMNALTRTEKLKAEFLSQASVEYDTKVQEANWELYQKQKQAEAILYEKEKEAAGQKAIADAAFYGRQRVADVELYAKQKEAEGLMALAQAQGVYLRTLLEALGGNYAALRDYLMINGGMFQEIAKINAEAVRGLQPKISIWTNGGGEAIDGNGSNAMKEVAGVYRMLPPLFKTVHEQTGMLPPPWMGTLPDPKKATTD

SEQ ID NO: 4758 - protein, 482 aa, Gossypium raimondii
MYYKVANASEYLVITGVGIQDIKLAKKAWILPGQSYTVFDLSPVNYTFEVQAMSAEKLPFVLPAVFTIGPRVDDTPSLLKYAKLISPHDKLSNHVKELVQGIIEGETRVLAASMTMEEIFKGTKEFKLEVFEKVQLELNQFGLLIYNANVKQLVDVPGHEYFSYLGQKTQMEAANQAKVDVAEARMKGEIGSKLREGQTLQNAARIDAETKIISTQRQGEGKKQEIKVKTEVKVYENQREAEIAEANADLAKKKASWAKEAQVAEVESAKAVALREAELQQEVERMNALTRTEKLKAEFLSQASVEYDTKVQEANWELYQKQKQAEAILYEKEKEAAGQKAIADAAFYGRQRVADVELYAKQKEAEGLMALAQAQGVYLRTLLEALGGNYAALRDYLMINGGMFQEIAKINAEAVRGLQPKISIWTNGGGEAIDGNGSNAMKEVAGVYRMLPPLFKTVHEQTGMLPPPWMGTLPDPKKATTD

SEQ ID NO: 4759 - protein, 470 aa, Lactuca sativa
MYRVASASEYLVITGFGIEDIKIAKKAWVLPGQSYSVFDISPVNYTFEVQAMSAEKLPFILPAVFTIGPRSDDDDSLHKYAKLISPHDKLSHHVNELVKGIIEGETRVLAASMTMEEIFKGTKDFKQEVFEKVQLELNQFGLWIYNANVKQLVDVPGHEYFSYLGQKTQMEAANQARVDVAEAKMKGEIGSKLREGQTLQNAAKIDAETKIIATQRQGQGKKEEIKVRTEVKVFENEREAEVAEANAELAMKKAKWAKDSQVAEVEANKAVALRAAELQKEVEIMNALTQTEKLKAEFLSKASVEYETKVQEANWELYRKQKAAEAILYEKEKEAEAQKAIAEATFYTRQQVADGELYAKQKEAEGLVALAQAQGTYIRTLLGAMGGNYGALRDYLMINGGMYQEIAKINAEAVKGLQPKISIWTGANGGGEGGDGGAMKEVAGVYKMLPPLFNTVHEQTGMLPPAWMGK

SEQ ID NO: 4760 - protein, 482 aa, Theobroma cacao
MYKVANASEFLVITGIGIPDIKLAKKAWILPGQSCTVFDVSPVNYTFEVQAMSAEKLPFVLPAVFTIGPRVDDEHSLLKYAKLISPHDKLSNHVKELVQGIIEGETRVLAASMTMEEIFKGTKEFKLEVFEKVQLELNQFGLLIYNANVKQLVDVPGHEYFSYLGQKTQMEAANQAKVDVAEAKMKGEIGSKLREGQTLQNAARIDAETKIISTQRQGEGKKEEIRVKTEVKVFENQREAELAEANADLAKKKAGWAKEAQVAEVEASKAVALREAELQKEVERMNALTRTEKLKAEFLSQASVEYDTKVQKANWELYQKQKQAEAILYEKEKEAAAQKAIADATFYGRQRVADVELYAKQKEAEGLMALAQAQGVYLRTLLEALGGNYAALRDYLMINGGMFQEIAKINAEAVRGLQPRISIWTNGGSEAMDGNGSNALKEVAGVYRMLPPLFKTVHEQTGMLPPPWMGTLSADSQQATTD

SEQ ID NO: 4761 - protein, 476 aa, Prunus persica
MYRVASPSEYLVITGIGIDDIKLAKKAWILPGQSYIIFDMSPVNYTFEVQAMSSEKLPFMLPAVFTIGPRIDDTPSLHKYAKLISRHDKLSSHVKELVQGIIEGETRVLAASMTMEEVFKGTKEFKQEVFEKVQLELNQFGLLIYNANVKQLVDVPGHEYFSYLGQKTQMEAANQAKVDVAEARKKGEIGSKEREGLTLQNAAKIDAETKIYATKREGEGKMAEIKVKAEVKVYENVREAEVAEANAELAKKKAGWAKEAQVAEVEAAKAVALRDAELQTQVERMNALTRTEKLKAEFLSKASVEYETKVQEANWDLYNKQKAAEAILYQREKEAEAQKAIAEAEFYARQQVADGEFYAKKKEAEGLIALGQAQGAYLRNLLDAVGGNYAAMRDFMMINSGMFQEIAKINAEAVRGLQPKISIWTNGEVDGGSNGAMKEVAGVYKMLPPLFKTVHEQTGMLPPAWMGTLPNSGSNN

SEQ ID NO: 4762 - protein, 471 aa, Petroselinum crispum
MYRVARASEYLVITGIGITDIKIAKKSWILPGQSYAVFDVSPVNYTFEVQAMSAEKLPFVLPAVFTIGPRLDNDSLLKYAKLISPHDKLSNHVKELVQGIIEGETRVLAASMTMEEVFKGAKEFKQEVFEKVQLELNQFGLLIYNANVKQLVDVPGHEYFSYLGQKTQMEAANQAKVDVAEARMKGEVGSKLREGQTLQNAAKIDAETKIISTQRQGQGRKEEIKVKAEVKVFENEREAEVAEANAELAKRKAGWAKEAHVAEVEAEKAVALREAELQKEVEIMNALTQTEKLKAEFLSKASVEYETKVQEANWELYKKQKEAEAILYQKEKEAEAQKAIADAAFYARQQVADGELYAKQKEAQGLVALAQAQGTYVSTLLKAVGGNYSELRDYLMINGGMYQEIAKINSEAVRGLQPKISIWSNGENSGDGNSMKGIGEVYKMLPPLFKTVHEQTGMMPPAWLGTLSHDA

SEQ ID NO: 4763 - protein, 453 aa, Medicago truncatula
MNIQVIQLNFYSYSQHRKTQVFQIQISSTVGLHRVAKASEYLVITGILIKDIKLAKKAWIIPGQSCSVLDLSPVNYTFEVQAMSAEKLPFVLPAVFTIGPRVDDQESLLKYAKLISPHDRLSNHVNELVQGIIEGETRVLAASMTMEELNQFGLLIYNANVKQLVDVPGHEYFSYLGQKTQMEAANQARVDVAEGDKEGIKVRTEVKVFENQREAEVAEANSELAKKKAAWTKAAQVAEVEAKKAVALRDAELQGEVERMNALTTTEKLKAEFLSKASVQYETKVQEANWELYKKQKEAEAILYEKKAEAEAQKASADATFYACKQEAEAELYAKKKEAEGIVTLGNAQGAYVSTLLNALGNNYTAVRDYLMINGGMFQEIAKINAEAVRGLEPKISIWTNGSDSGGEKTEGAMGMKEVAGVYKMLPPLFKTVHEQTGMLPPAWMGALSEKSP

SEQ ID NO: 4764 - protein, 478 aa, Manihot esculenta
MYRVASPSEFLVITGVGISDLKLAKKAWVLPGQSCTVFDVSPVNYTFEVQAMSAEKLPFVLPAVFTIGPRVDDELSLLRYAKLISPHDKLSHHVKELVQGIIEGETRVLAASMTMEEIFRGTKEFKQEVFEKVQLELNQFGLLIYNANVKQLVDVPGHEYFSYLGQKTQMEAANQAKVDVAEAKMKGEIGSKESEGQTLQNAAKIDAETKIISTQRQGEGKKEEIKVKTQVKIYENQREAEVAEANAELAKKRAVWTMEAKVAEVEATKAVSLREAELQREVEQMNALTITEKLKAEFLSKASVEYETKVQEANWELYKKQKAAEAILYEKEKEADAQKAIADAAFYARQQVADGELYAKQKEAEGMMALAKAQGVYLRTLLDALGGNYAALRDFLMINGGMFQEIAKLNAEAIRGLQPKISVWSNGSGVEINEGAMKEVAGVYRMLPPLFKTVQEQTGMLPPPWMGTLTDSSHPTVD

SEQ ID NO: 4765 - protein, 483 aa, Populus trichocarpa
MYRVASPSEFLVITGVGISDIKLAKKGWILPGQSCTVFDVSPVNYTFEVQAMSAEKLPFVLPAVFTIGPRVDDEQSLFKYAKLISRHDKLSNHVKELVQGIIEGETRVLAASMTMEEVFKGTKEFKQEVFEKVQLELNQFGLLIYNANVKQLVDVPGHEYFSYLGQKTQMEAANQARVDVAEAKMKGEVGSKQREGQTLQNAARIDAETKIIATQRQGDGKKEEIKVKTEVKIYENHREAEVAEANADLAKKKAGWSKEAQVAEVEATKAVSLREAELQREVERMNALTRTEKLKAEFLSQASVEYETKVQEANWELYTKQKAAEAILYEKQKEADAQKATADATFYARQQVADGELYSKQKEAEGLVALAQAQGVYIRTLLDALGGNYAALRDYLMINSGMFQEIARINADAVHGLQPKISIWTNGNSGEANDGTGGGNAMKEVAGVYKMLPPLFKTVQDQTGMLPPAWMGTLTDSSHSNVN

SEQ ID NO: 4766 - protein, 484 aa, Populus trichocarpa
MLYKVASPSEYLVITGVGISDIKLAKKGWILPGQSCSVFDVSPVNYTFEVQAMSAEKLPFVLPAVFTIGPRVDDEQSLFRYAKLISPHDKLSNHVKELVQGIIEGETRVLAASMTMEEIFKGTKDFKQEVFEKVQLELNQFGLLIYNANVKQLVDVPGHEYFSYLGQKTQMEAANQARIDVAEAKMKGEIGSKQREGRTQQNAAKIDAETKIIATQRQGDGKKEEIKVKTEVKIYENHREAEVAEANADLAKKKAGWSMEAQVAEVEATKAVSLRDAELQMEVERMNALTRTEKLKAEFLSKASVEYETKVQEANWELYRKQKAAEAILYEKEKEADAQKAIADATFYSRQQVADGELYAKQKEAEGLVALAQAQGVYLRTLLDALGGNYAALRDYLMINSGMYREIAKINSDAVQGLQPKISIWTNGNSGETNDGAGAGNAMKEVAGVYKMLPPLFQTVQEQTGMLPPAWMGSLTDSSNSNVK

SEQ ID NO: 4767 - protein, 479 aa, Prunus mume
MYRVASPSEYLVITGIGIDDIKLAKKAWILPGQSYIIFDMSPVNYTFEVQAMSSEKLPFMLPAVFTIGPRIDDTPSLHKYAKLISRHDKLSSHVKELVQGIIEGETRVLAASMTMEEVFKGTKEFKQEVFEKVQLELNQFGLLIYNANVKQLVDVPGHEYFSYLGQKTQMEAANQAKVDVAEARKKGEIGSKEREGLTLQNAAKIDAETKIYATKREGEGKMAEIKVKAEVKVYENVREAEVAEANAELAKKKAGWAKEAQVAEVEAAKAVALRDAELQTQVERMNALTRTEKLKAEFLSQASVEYETKVQEANWDLYNKQKAAEAILYQREREAEAQKAIAEAEFYARQQVADGEFYAKKKEAEGLIALGQAQGAYLRNLLDAVGGNYAAMRDFMMINSGMFQEIAKINAEAVRGLQPKISIWTNGAVEGGDGGSNGAMKEVAGVYKMLPPLFKTVHEQTGMLPPAWMGTLPNSGSNN

SEQ ID NO: 4768 - protein, 481 aa, Aquilegia formosa
MYRVASPSEYLVITGVGIKDIKIVKKGWILPGQSCTVFDVSPVNYTFGVQAMSAEKLPFVLPAVFTIGPRVDDDESLLKYAKLISPHDKLSNHVKELVQGIIEGETRVLAASMTMEEIFKGTKEFKHEVFGKVQLELNQFGLLIYNANVKQLVDVPGHEYFSYLGQKTQMEAANQARVDVAEAKMKGEVGSKLREGQTLQNAAKIDAETKIISTQRQGEGKKEEIKVKTEVKIFENKREAEVAEANAELAMKKAGWTQQAQLADVEAAKAVALRAAELQRQVEMMNAMTQTEKLKAEFLSKASVEYETKVQEANWEFYKTQKAAEAELYEKEKEAEAQRALASAKFYAQQQFADGELYAKKKEAEGLVALAQAQGIYIRTLLEALGGNYSAVRDYLMINGGVFQELAKINAGAVQGLQPKISIWTNGNGGEMTGGVGNGSSAMTEVGGVYKMLPPLFKTVHEQTGMLPPAWMGTITDSSNI

SEQ ID NO: 4769 - protein, 176 aa, Trigonella foenum-graecum
MKPRYKRLAGNCTKNKKKAEAILYEKKAEAEAQKALADATFYARKQEAEAELYAKKKEAEGIVTLGNAQGAYVSTLLNALGNNYTALRDYLMIDGGMFQEIAKINADAILGLEPKISIWTNGGENGGGITEGAMGMKEVAGVYKMLPPLFKTVHEQTGMLPPAWMGTLSDDKKALN

SEQ ID NO: 4770 - protein, 482 aa, Cucumis sativus
MYKVASASEYLAITGVGISDIKLAKKAWVLPGQSCTIFDISPVNYTFEVQAMSAEKLPFILPAVFTIGPRSDDMDSLLKYAKLISPHDKLSNHVKELVQGVIEGETRVLAASMTMEEIFRGTKEFKQEVFGKVQLELDQFGLLIYNANVKQLVDVRGHEYFSYLGQKTQQEAANQAKIDVAEARMKGEIGAKSREGQTLQNAAKIDAETKIIATQRQGQGKKEEIKVKAEVKVFENEREAEVAEANAELAKKKAAWTRAAQVAEVEAAKAVALREAQLQKEVEMMNAMTMTEKLKAEFLSKASVEYETKVQEANWELYDKQKKAEAVLFEKEREAEAQKALADAGFYARQQVADGELYAKKKEAEGLVALAEAQALYLRSLLEALGGNYSALRDYLMINGGLFQEVAKINADAIKGLQPKISVWTNGSGGQGLEGGSGAGSIAMKEVAGVYKMLPPLFQTVHEQTGMLPPPWMGSLGDSSQN

SEQ ID NO: 4771 - protein, 479 aa, Malus domestica
MYRVASPSEYLVITGVGIDDIKLAKKAWILPGQSFIIFDMSPVNYTFEVQAMSSEKLPFMLPAVFTIGPRIDDMESLHKYAKLISRHDKLSSHVKELVQGIIEGETRVLAASMTMEEVFKGTKEFKQEVFGKVQLELNQFGLLIYNANVKQLVDVPGHEYFSYLGQKTQMEAANQARVDVAEAKKKGEIGSKLREGETLQNAAKIDAETKIYGTKREGEGRMAEIKVKAEVKVYENVREAEVAEANAELAKKKAGWAKEAQVAEVEAAKAVALRDAELQTEVERMNALTMTEKLKAEFLSKASVEYETKVQEANWELYNKQKASEAILYQREKEADAKKALAEAEFCARQQAADGEFYAKKKEAEGLMALGQTQGAYLRHLLDAVGGNYAAMRDFMMINSGMFQEIAKINAEAVRGLQPKISIWTNGGGEGGDGGANGAMKEISGVYKMLPPLFKTVHEQTGMSPPAWMGTLDNSHPSN

SEQ ID NO: 4772 - protein, 474 aa, Phaseolus vulgaris
MYRVAKASEYLVITGVGITDLKLAKKAWVLPGQACRIFDLSPVNYTFEVQAMSAEKLPFNLPAVFTIGPRADDDASLLKYAKLLSSHDKLSHHVEELVQGIIEGETRVLAASMTMEDIFRGTKSFKQEVFEKVQLELNQFGLLIYNANVKQLVDVAGHEYFSYLGQKTQMEAANQAKIDVAEAKMKGEVGAKMREGKTLQNAAKIDAETKIISTQRHGEGVKEEIKVRAEMKVFENEREAVVAEANSELAKKKAAWAQTAQVAEVEASKAVALRAAELQREVEKMNALTTTEKLKAEFLTKASVEYETKVQEANWELYRKQKAAEAILFEKEKEAEAQKAMAEAAFFSRQQAAEAELYAKKKEAEGLLAIGEAQGAYIRTLLDALGGNYTNLRDYLMINNGMFQQIAKTNAEAIRGLQPKISIWSNGGEGSDVSGEMKDVAGVYKMLPPLFKTVHEQTGMLPPAWMGTLSDKTA

SEQ ID NO: 4773 - protein, 482 aa, Citrullus lanatus
MYRVASASEYLAITGVGIDDIKLAKKAWVLPGQSCTIFDISPVNYTFEVQAMSAEKLPFILPAVFTIGPRSDDIESLLKYAKLISPHDKLSNHVKELVQGVIEGETRVLAASMTMEEIFKGTKEFKQEVFGKVQLELDQFGLLIYNANVKQLVDVRGHEYFSYLGQKTQQEAANQAKVDVAEARMKGEIGAKSREGQTLQNAAKIDAETKIISTQRQGQGKKEEIKVRAEVKVFENEREAEVAEANAELTKKKAAWTRAAQVAEVEAAKAVALREAELQKEVEMMNAMTMTEKLKAEFLSKASVEYETKVQEANWELYNKQKQAEAVLFEKEREAEAQKALADAGFYARQQVADGELYARKKEAEGLVALAEAQALYLRSLLDALGGNYAALRDYLMINGGLFQEVAKINADAIKGLQPKISVWTNGSGGQGLEGGAGAGNMAMKEVAGVYKMLPPLFQTVHEQTGMLPPPWMGSLGDSSQN

SEQ ID NO: 4774 - protein, 480 aa, Chrysanthemum coronarium
MYRVAKASEYLVITGFGIDDIKIAKKAWVLPGQSYSVFDISPVNYTFEVQAMSAEKLPFILPAVFTIGPRSDHDESLNKYARLISPHDKLSHHVNELVKGIIEGETRVLAASMTMEEIFRGTKEFKQEVFEKVQLELNQFGLWIYNANVKQLVDVPGHEYFSYLGQKTQMEAANQARVDVSEAKMKGEIGSKLREGKTLQNAAQIDAETKIIATQRQGQGKKEEIRVKTEVKVFENEREAEVAKANAELAMKKAKWAKDSQVAEVEANKAVALRAAELQKEVEVMNALTQTEKLKAEFLSKASVEYETKVQEANWDLYKKQKAAEALLYQKEKEAEAQKATSEATFYARQQVADGELYAKQKEAEGLVALAEAQGTYIRTLLGALGGNYGALRDYLMINGGMYQQIAKINGEAVKGLQPKISIWTGASGSGEGGDGGAMKEVAGVYKMLPPLFNTVHEQTGMLPPAWMGKITESPSRQFT

SEQ ID NO: 4775 - protein, 480 aa, Chrysanthemum coronarium
MYRVAKASEYLVITGFGIDDIKIAKKAWVLPGQSYSVFDISPVNYTFEVQAMSAEKLPFILPAVFTIGPRSDHDESLNKYARLISPHDKLSHHVNELVKGIIEGETRVLAASMTMEEIFRGTKEFKQEVFEKVQLELNQFGLWIYNANVKQLVDVPGHEYFSYLGQKTQMEAANQARVDVSEAKMKGEIGSKLREGKTLQNAAQIDAETKIIATQRQGQGKKEEIRVKTEVKVFENEREAEVAKANAELAMKKAKWAKDSQVAEVEANKAVALRAAELQKEVEVMNALTQTEKLKAEFLSKASVEYETKVQEANWDLYKKQKAAEALLYQKEKEAEAQKATSEATFYARQQVADGELYAKQKEAEGLVALAEAQGTYIRTLLGALGGNYGALRDYLMINGGMYQQIAKINGEAVKGLQPKISIWTGANGSGEGGDGGAMKEVAGVYKMLPPLFNTVHEQTGMLPPAWMGKITESPSRQFT

SEQ ID NO: 4776 - protein, 474 aa, Helianthus annuus
ASASEYLVITGFGIDDIKIAKKAWVLPGQSYSVFDISPVNYTFEVMAMSAEKLPFILPAVFTIGPRSDDDDSLNKYAKLISPHDKLSQHVNELVKGIIEGETRVLAASMTMEEIFKGTKEFKQEVFEKVQLELNQFGLWIYNANVKQLVDVPGHEYFSYLGQKTQMEAANQAKIDVSEAKMKGEIGAKLREGQTLQNAAKIDAETRIISTQRQGQGKKEEIKVRTEVKVFENEREAEVAEANAELAMKKAKWAKDSQVAEVEATKAVALREAELQKEVEIMNALTQTEKLKAEFLSKASVEYETKVQEANWELYKKQKAAEAILYEKEKEAEAQKATAEATFYARQQVADGELYAKQKEAEGLVALAQAQGTYIRTLLGALGGNYGALRDYLMINGGMYQEIAKINGEAIKGLQPKITIWTGAGGVGDGGDGQGGAMKEVAGVYKMLPPLFNTVHEQTGMLPPTWMGKIKDHDC

SEQ ID NO: 4777 - protein, 482 aa, Prunus mume
MYKVASPSEYLVITGVGIEDIRLAKKGWILPGQSYIIFDMSPVNYTFEVQAMSSEKLPFMLPAVFTIGPRIDDMPSLHKYAKLISRHDKLSTHVKELVQGIIEGETRVLAASMTMEEVFKGTKEFKQEVFGKVQLELNQFGLLIYNANVKQLVDVPGHEYFSYLGQKTQMEAANQAKVDVAEARKKGEIGSKEREGLTLQNASKIDAETKIYATRRGGEGRMAEIKVNAEVKVYENVREAEVAEANAELAKKKAGWAKEAQVAEVEAVKAVALRDAELQKEVERMNALTITEKLKAEFLSKASVEYETKVQEANWELYIKQKAAEAILYQREKEAEAQKAIAEAELYARQQVADGEFYAKKKEAEGLMALGQAQGAYLRTLLDAVGGNYAAMRDFMMIKSGMFQEIANINAEAVRGLQPKISIWTNGGGEGGDGGHGAMKEVAEVYKMLPPLFKTVHEQTGMLPPAWMGTLSDSHSTSSALN

SEQ ID NO: 4778 - protein, 479 aa, Mimulus guttatus
MYQVASASEYLVVTGAGIPDIKISKKAWIFPGQTYTKFDVSPVNYTFEVQAMSAEKLPFILPAVFTIGPRIDDEASLLKYAKLISPHDKLSHHVKELVQGIIEGETRVLAASMTMEEIFKGTKEFKQEVFGKVQLELDQFGLLIYNANVKQLVDVPGHEYFSYLGQKTQMEAANQAKVDVAEAKMKGDLGSKLREGETLRNAAAIDAETKIASTQRQGEGKKEEIKVRTEVKVFENQREAEVAEANAELAKKKAGWAKEAQVAEVEASKAVALRDAELQREVETMNALTQTEKLKAQFLSKAGVEYETKVQEANWELYKKQKAAEAYLYEKEKEAQAQKAVADASFYQRKQVVDGDLYAKMKEAEGLKALAEAQGTYIRTLLDAMGGNYAALRDYLMISGGMYQDIAKINSEAVRGLQPKISIWTNGSGSGDGGDNSAMKEVAGVYKMLPPLFKTVNEQTGMLPPSWMGTLTDDSTSNN

SEQ ID NO: 4779 - protein, 479 aa, Nicotiana benthamiana
MYRVASASEYLVITGLGITDINIAKKAWVLPGQSSRKFDVSPVNYTFEVQAMSAEKLPFVLPAVFTIGPRVDDEGSLLKYAKLISPHDKLSNHVKDLVQGIIEGETRVLAASMTMEEIFKGTKEFKQEVFGKVQLELNQFGLLIYNANVKQLVDVPGHEYFSYLGQKTQMEAANQAKIDVAEARMKGEIGAKLRSGQTLQNAAKIDAETRIISTQREGEGKKEEMKVKTEVKVYENHREAEVAEANAELAKKKAGWAKDAQVAEVEAEKAVALRDAELQREVERMNALAMTEKLKAEFLSKASVEYETKVQEANWELYKKQKEAEAYLYEKEKEAAAQKAIAEADFYRRKQIIDGDLYAKMKEAEGLKALAVAQGTYLHTLLEALGGNYAALRDYLMISGGMFQELAKINAEAIHGLQPKISIWTNGGSHEAAAEGGGSALKEVAGIYKTLPPLFKTVQEQTGMLPPSWMGTLTNDTSQ

SEQ ID NO: 4780 - protein, 476 aa, Prunus persica
MYRVASPSEYLVITGAGIDDIKLAKKGWILPGQSYIIFDMSPVNYTFEVQAMSIEKLPFMLPAVFTIGPRIDDMPSLHKYAKLISLHDKLSTHVKELVQGIIEGETRVLSASMTMEEVFRGTKEFKQEVFEKVQLELNQFGLLIYNANVKQLVDVPGHEYFSYLGQKTQMEAANQAKVDVAEARKKGEIGSKEREGLMLQNAAKIDAETKIYATKREGEGKMAEIKVKAEVKVYENVREAEVAEANAELAKKKAGWGKEAHVAEVEAVKAVALRDAELQTEVERMNALTRTEKLKAEFLSKASVEYETKVQEANWELYNKQKAAEAILYLREKEAEAQKAIAEAELYACQQVADGEFYAKKKEAEGLMALGQAQGAYLCNLWDAVGGNYAAMRDFMMINGSIFPEIAKINADAVCGLQPKISIWTNGGGEGGRNGAMKEVAGVYKMLPPLFKTVHEQTGMLPPAWMGTLPNSGSNN

SEQ ID NO: 4781 - protein, 447 aa, Trifolium pratense
MACTSANSLLQLKGSSHQRPLLNLRTNIAAHYSPPGLFNLKGDGLIHKGFRHQSQKHIVPRNKVTVIRAVAIPVEPAPVESVEYRKQLAERYGFEQIGEPLPDNVTLKDVITSLPKKVFEIDDVKAWKTVLISATSYALGLLMISKAPWYLLPLAWAWTGTAVTGFFVIGHDCAHKSFSTNKLVEDIVGTLAFLPLIYPYEPWRFKHDKHHAKTNMLKEDTAWQPVWKDEFESKPLLRKAIIFGYGPFRCWMSIAHWLVCHFNLKTFRPNEIKRVKISLACVFAFMAIGWPLIIYKTGIMGWIKFWLMPWLGYHFWMSTFTMVHHTAPHIPFKYSEEWNAAQAQLNGTVHCAYPQWIEVLCHDINVHIPHHISPKIPSYNLRAAHKSLQENWGKYLNEASWNWRLMKTILTVCHVYDKEQNYVSFEEVAPEESNSIKFLKEVMPDYA

SEQ ID NO: 4782 - protein, 447 aa, Trifolium pratense
MACTSANSLLQLKGSSHQRPLLNLRTNIAAHYSPPGLFNLKGDGLIHKGFRHQSQKHFVPRNKVTVIRAVAIPVEPAPVESVEYRKQLAERYGFEQIGEPLPDNVTLKDVITSLPKKVFEIDDVKAWKTVLISATSYALGLLMISKAPWYLLPLAWAWTGTAVTGFFVIGHDCAHKSFSTNKLIEDIVGTLAFLPLIYPYEPWRFKHDKHHAKTNMLKEDTAWQPVWKDEFESKPLLRKAIIFGYGPFRCWMSIAHWLVCHFDLKKFRPNEIKRVKISLACVFAFMAIGWPLIIYKTGIMGWIKFWLMPWLGYHFWMSTFTMVHHTAPHIPFKYSEEWNAAQAQLNGTVHCAYPQWIEVLCHDINVHIPHHISPKIPSYNLRAAHKSLQENWGKYLNEASWNWRLMKTILTVCHVYDKEQNYVSFEEVAPEESHSIKFLKEVMPDYA

SEQ ID NO: 4783 - protein, 446 aa, Trifolium pratense
MACTSANSLLQLKGSSHHRPVLNFRRNIAAHYSPGLFNLKSDGLIHKGFRHQSPKHFVPRNKVTVIRAVAIPVEPAPVESVEYRKQLAERYGFEQIGEPLPDNVTLKDVITSLPKKVFEIDDVKAWKTVLISATSYALGLLMISKAPWYLLPLAWAWTGTAVTGFFVIGHDCAHKSFSTNKLVEDIVGTLAFLPLIYPYEPWRFKHDKHHAKTNMLKEDTAWQPVWKDEFESKPLLRKAIIFGYGPFRCWMSIAHWLVCHFNLKTFRPNEIKRVKISLACVFAFMAIGWPLIIYKTGIMGWIKFWLMPWLGYHFWMSTFTMVHHTAPHIPFKYSEEWNAAQAQLNGTVHCAYPQWIEVLCHDINVHIPHHISPKIPSYNLRAAHKSLQENWGKYLNEASWNWRLMKTILTVCHVYDKEQNYVSFEEVAPEESNSIKFLKEVMPDYA

SEQ ID NO: 4784 - protein, 446 aa, Trifolium pratense
MACTSANSLLQLKGSSHHRPVLNFRRNIAPHYSPGLFNLKSDGLIHKGFRHQSPKHFVPRNKVTVIRAVAIPVEPAPVESVEYRKQLAERYGFEQIGEPLPDNVTLKDVMTSLPKKVFEIDDVKAWKTVLISATSYALGLLMISKAPWYLLPLAWAWTGTAVTGFFVIGHDCAHKSFSTNKLVEDIVGTLAFLPLIYPYEPWRFKHDKHHAKTNMLKEDTAWQPVWKDEFESKPLLRKAIIFGYGPFRCWMSIAHWLVCHFNLKTFRPNEIKRVKISLACVFAFMAIGWPLIIYKTGIMGWIKFWLMPWLGYHFWMSTFTMVHHTAPHIPFKYSEEWNAAQAQLNGTVHCAYPQWIEVLCHDINVHIPHHISPKIPSYNLRAAHKSLQENWGKYLNEASWNWRLMKTILTVCHVYDKEQNYVSFEEVAPEESNSIKFLKEVMPDYA

SEQ ID NO: 4785 - protein, 446 aa, Cicer arietinum
MACTPANSLLQLKGSSQQRPVLNLRRNIAAHYSPGLFNLKGDGLIHKGFRLQSQRHFIPRNKFTVVRAVAIPVEPAPTESTEYRKQIAERYGFKKIGEPLPDNVTLKDVITSLPKTVFEIDDVKAWKTVLISVTSYALGLLMISKAPWYLLPLAWAWTGTAVTGFFVIGHDCAHKSFSTNKLVEDIVGTLAFLPLIYPFEPWRFKHDKHHAKTNMLKEDTAWQPVWKDEFDSSPFLRKAIIYGYGPFRCWMSIAHWLVCHFDLKKFRPNEIKRVKISLACVFAFIAIGWPLIVYKTGIIGWIKFWLMPWLGYHFWMSTFTMVHHTAPHIPFKHSEEWNAAQAQLNGTVHCAYPQWIEILCHDINVHIPHHISPKIPSYNLRAANKSLQENWGKYLNEASWNWRLMKTIMTVCHVYDKEQNYVAFDEVAPEESSSIKFLKQIMPDYA

SEQ ID NO: 4786 - protein, 436 aa, Trifolium pratense
QLKGSSHHRPVLNFRRNIAAHYSPGLFNLKSDGLIHKGFRHQSQKHFVPRNKVTVIRAVAIPVEPAPVESVEYRKQLAERYGFEQIGEPLPDNVTLKDVITSLPKKVFEIDDVKAWKTVLISATSYALGLLMISKAPWYLLPLAWAWTGTAVTGFFVIGHDCAHKSFSTNKLIEDIVGTLAFLPLIYPYEPWRFKHDKHHAKTNMLKEDTAWQPVWKDEFESKPLLRKAIIFGYGPFRCWMSIAHWLVCHFDLKKFRPNEIKRVKISLACVFAFMAIGWPLIIYKTGIMGWIKFWLMPWLGYHFWMSTFTMVHHTAPHIPFKYSEEWNAAQAQLNGTVHCAYPQWIEVLCHDINVHIPHHISPKIPSYNLRAAHKSLQENWGKYLNEASWNWRLMKTILTVCHVYDKEQNYVSFEEVAPEESNSIKFLKEVMPDYA

SEQ ID NO: 4787 - protein, 442 aa, Phaseolus vulgaris
MACTLADSLLLFKGSFQKPLRKRDIAAHYSPGVFSSNSDGLIRKGFRRQRSFVNRNKVTLIRAVAVPVQQPAPVESVEYRKQLAEDYGFRQIAEPLPSNVTLKDVINSLPKEVFEIDDVKAWKSVLISATSYALGIFMISKAPWFLLPLAWAWTGTAVTGFFVIGHDCAHKSFSSNKLVEDIVGTLAFLPLIYPYEPWRFKHDRHHAKTNMLSEDTAWNPVSKDEFESSPLLRKAIIYGYGPFRCWMSIAHWLLLHFDLKKFRPSEVKRVKISLACVFSFIAIGWPLIIYKTGIMGWIKFWLMPWLGYHFWMSTFTMVHHTAPHIPFRISEEWNAAQAQLNGTVHCDYPKWIEILCHDINVHIPHHISPRIPSYNLRAAHKSIEENWGKYLNEASWNWRLMKTIMTVCHVYDKEQNYVAFDDVAPEDSGPIAFLKKSMPDYA

SEQ ID NO: 4788 - protein, 441 aa, Glycine max
MACTLADSLLLFKGSYQKPVLRRDIAARYSPGIFSLNSNGLIQKRFRRQRNFVTRNKVTVIHAVAIPVQPAPVESAEYRKQLAEDYGFRQVGEPLPDDVTLKDVINSLPKEVFEIDDVKAWKSVLISVTSYALGLFMISKAPWYLLPLAWVWTGTAITGFFVIGHDCAHRSFSSNKLVEDIVGTLAFMPLIYPYEPWRFKHDRHHAKTNMLREDTAWHPVWKDEFESTPLLRKAIIYGYGPFRCWMSIAHWLMWHFDLKKFRPSEVPRVKISLACVFAFIAIGWPLIIYKTGIMGWIKFWLMPWLGYHFWMSTFTMVHHTAPHIPFKYSEEWNAAQAQLNGTVHCDYPKWIEILCHDINVHIPHHISPRIPSYNLRAAHKSLQENWGQYLNEASWNWRLMKTIMTVCHVYDKEQNYVAFDELAPEDSRPITFLKETMPDYA

SEQ ID NO: 4789 - protein, 419 aa, Lotus japonicus
TNCHPPHSTGIFNIKVDGLIHKGFRHQRHLIPRNKVAVIRAVAIPVEPAPAESAEYRKQLAESYGFRKIGEDLPDNVTLKDVISSLPKKVFEIDDVKAWKTVLISATSYALGLFMISKAPWYLLPLAWAWTGTAVTGFFVIGHDCAHKSFSTNKLVEDIVGTLAFLPLIYPYEPWRFKHDKHHAKTNMLNEDTAWNPVSKDEFDSDPLLRKAIIYGYGPIRCWMSVAHWLLLHFDLKKFRPNEVKRVKISLACVFAFIGIGWPLIIYKTGIMGWIKFWLMPWLGYHFWMSTFTMVHHTAPHIPFKDSEKWNAAQAQLNGTVHCDYPQWIEILCHDINVHIPHHISPRIPSYNLRAAHKSLQENWGKYLNEASWNWRLMKTIMTVCHVYDKEQNYVAFDELAPEDSQPIKFLKNVMPDYA

SEQ ID NO: 4790 - protein, 442 aa, Arachis hypogaea
MACRLADSFILFKGSHQKPLQSKRAIVAQYSPRVCNLKECGLIQKGFRHRLNFVPRKKVTVIQAVAVPLEPFPVESAEYRKQLAESYGFRQIGEPLPDDITLKDVIDSLPKKVFEIDDTKAWKTVLISVASYALGLFMISKAPWYLLPLAWAWTGTAVTGFFVIGHDCAHKSFSKNKLVEDIVGTLAFLPLIYPYEPWRFKHDRHHAKTNMLYEDTAWHPVWKDEFDSSPALRNAIIYGYGPFRTWMSIAHWLMWHFDLKKFRTNEVKRVKISLACVFAFMAIGWPLIIYKTGIMGWIKFWFMPWLGYHFWMSTFTMVHHTAPHIPFKYSENWNAAQAQLNGTVHCDYPQWIEILCHDINVHIPHHISPRIPSYNLRAAHKSLQENWGKYLNEASWNWRLMKTIMTVCHVYDKQQNYVAFDELAPEDSRPITFLKEVMPDYA

SEQ ID NO: 4791 - protein, 444 aa, Lupinus angustifolius
MASTLVDPLLLFKFSHQKQRFHKTNISAQYSPSLFNLKSDEFIQKGFRNQRHLIHRDRKKVTVVQAVAIPVEPSPLESAEYRKQLAQSYGFNQIGEQLPSNVTLKDVIDSLPKKVFEIDDAKAWKSVLVSATSYALGLFMISKAPWYLLPLAWAWTGTAVTGFFVIGHDCAHKSFSKNKLVEDIIGTLAFLPLIYPYEPWRFKHDRHHAKTNMLKGDTAWHPVWKKEFDSSPLLRKALIFAYGPFRPWMSIAHWLVLHFDLKKFRPNEVNRVKISLACVFAFMAIGWPLIIYKTGIMGWIKFWLMPWLGYHFWMSTFTMVHHTAPHIPFKDSEEWNAAQAQLSGTVHCDYPKWIEVLCHDINVHIPHHISPRIPSYNLRAAHKSIQENWGKYLNEASWNWRLMKTIMTVCHVYDKERNYVGFDELAPEDSHPIEFLKELMPDYA

SEQ ID NO: 4792 - protein, 418 aa, Cajanus cajan
ISCDSAATGIINLNRDGLIRKGFRRQRNFVTRNKVTVVRAVAIPVQPAPVESAEYRKELAENYGFRQIGEHLPDDVTLKDVINSLPKKVFEIDDVKAWKSVLISVTSYAMGLLMISKAPWYLLPLAWAWTGTAITGFFVIGHDCAHKSFSSNKLVEDVVGNLAFMPLIYPYEPWRFKHDRHHAKTNMLYEDTAWHPVLKDEFESSPPLRKAIIYGYGPFRCWMSIAHWLMWHFDLKKFRPNEVPRVKISLACVFAFIAIGWPLIIYKTGIMGWIKFWLMPWLGYHFWMSTFTMVHHTAPHIPFRYSEEWNAAQAQLNGTVHCDYPNWIEILCHDINVHIPHHISPKIPSYNLRAAHKSLQENWGKHLNEASWNWRLMKTIMTVCHVYDKGQNYVAFDELAPEDSRPITFLKEAMPDYA

SEQ ID NO: 4793 - protein, 473 aa, Trifolium pratense
MYMATLGANSNIIIKTDLRFHRTKTTTRFQCLPSTVAVFKVLSLSTVTKPTTRLHFLRHHRHSRALVCQCQHKHDSSPTPTNIPHVIGIGMNRMLVSLKDWRNLRIMEVAGLLVCILMVVPSADAVDALKTCACLLKECRVELAKCLANPSCAANIACLQTCNNRPDETECQIKCGDVFENKVVDEFNECAVSRKKCVPKKSDVGEFPVPNPDVLVKSFNIADFSGKWFITSGLNPTFDAFDCQLHEFHTESNKLVGNITWRIPTPDGGFLTRSAVQKFEQDPANPGILYNHDNEYLNYQDDWYVLSSQIENKPDDYIFIYYRGRNDAWDGYGGAVVYTRSAVLPESIIPELDRAAKSVGRDFSKFIRTDNTCGPEPTIVERIEKKVEEGEKTIVREVEEIEEEVEKEVELVGKTEMSLLQRLAEGFKVFQEDEENFLKGLSKEEMEILDSLKLEAKEVEELFGNALPLRKLR

SEQ ID NO: 4794 - protein, 406 aa, Trifolium pratense
CQCQHKHDSSPTPTNIPHVIGIGVNRMLVSLKDWRNLRIMEVAGLLVCILMVVPSADAVDALKTCACLLKECRVELARCLANPSCAANIACLQTCNNRPDETECQIKCGDVFENKVVDEFNECAVSRKKCVPKKSDVGEFPVPNPDVLVKSFNIADFSGKWFITSGLNPTFDAFDCQLHEFHTESNKLVGNITWRIPTPDGGFLTRSAVQKFEQDPANPGILYNHDNEYLNYQDDWYVLSSQIENKPDDYIFIYYRGRNDAWDGYGGAVVYTRSAVLPESIIPELDKAAKSVGRDFSKFIRTDNTCGPEPSIVERIEKKVEEGEKTIVREVEELEEEVEKEVEKVGKTEMTLLQRLAEGFKVFQEDEENFLKGLSKEEMEILESLKLEAKEVEELFGNALPLRKLR

SEQ ID NO: 4795 - protein, 342 aa, Trifolium pratense
MSSFINCNHFVLHRFPIMAMRSTFNYRHFSLHISNASTQPQAQGIETPPRVGFLGLGIMGTPMAQNLIKAGVDLTVWNRTKSKCDPLINLGAKYKPSPEEVAASCDLTFAMLADPQSAVDVALGKHGAANGIGPGKGYVDVSTVDVDTSKLINGQIKSTGALFLEAPVSGSKKPAEDGQLIFLTAGDKNLYDTVAPFLDIMGKSRFYLGDVGNGAAMKLVVNMIMGSMMASFSEGLLLSEKVGLDPKVLVEVISQGAISAPMYSMKGPSMIQSHYPTAFPLKHQQKDLRLALGLAESVSQPIPIAAAANELYKVAKSHGYSDEDFSAVIEALKSKFQHSENQ

SEQ ID NO: 4796 - protein, 342 aa, Trifolium pratense
MSSFINCNHFVLHRFPIMAMRSTFNYRHFSLHISNASTQPQAQGIETPPRVGFLGLGIMGTPMAQNLIKAGVDLTVWNRTKSKCDPLINLGAKYKPSPEEVAASCDLTFAMLADPQSAVDVALGKHGAANGIGPGKGYVDVSTVDVDTSKLINGQIKSTGALFLEAPVSGSKKPAEDGQLIFLTAGDKSLYETVASLLDIMGKSRFYLGDVGNGAAMKLVVNMIMGSMMASFSEGLLLSEKVGLDPKVLVEVISQGAISAPMYSMKGPSMIQSHYPTAFPLKHQQKDLRLALGLAESVSQPIPIAAAANELYKVAKSHGYSDEDFSAVIEALKSKFQQSEKQ

SEQ ID NO: 4797 - protein, 340 aa, Trifolium pratense
MSSLISCNHFVLHRFPIMAMRSSFNYRHFSLHISNASAQSQGIETPPRVGFLGLGIMGTPMAQNLIKAGVDLTVWNRTKSKCDPLISLGAKYKPSPEEVAASCDLTFAMLADPQSAVDVACGKHGAANGMGPGKGYVDVSTVDVDTSKLINGQIKSTGALFLEAPVSGSKKPAEDGQLIFLTAGDKSLYETVASLLDIMGKSRFYLGDVGNGAAMKLVVNMIMGSMMASFSEGLLLSEKVGLDPKVLVEVISQGAISAPMYSLKGPSMIQSHYPTAFPLKHQQKDLRLALGLAESVSQPIPIAAAANELYKVAKSHGYSDEDFSAVIEALKSKFQQSEKQ

SEQ ID NO: 4798 - protein, 333 aa, Glycine max
MRSTFCCHLNLSPVMIMKGFSAPISSYVSPRAQAVTEPPARIGFLGLGIMGSPMAHNLLKAGVDLTVWNRTKSKCDPLISLGAKYKPSPEEVAASCDVTFAMLADPQSAVDVACGKHGAANGMGPGKGYVDVSTVDGDTSKLINGHMKSTGALFLEAPVSGSKKPAEDGQLIFLTAGDKNLYEAVGSLLDIMGKSKFYLGDVGNGAAMKLVVNMIMGSMMASFSEGLLLSEKVGLDPDVLVQVVSQGAISAPMYSTKGPSMIQSLYPTAFPLKHQQKDLRLALGLAESVSQPTPIASAANELYKVAKSNGLSDQDFSAVIEALKSKFQHSETK

SEQ ID NO: 4799 - protein, 334 aa, Cajanus cajan
MRCSTFCSHHLNLSAMIMKRFSAPISSHVSPRAQAITEPPARVGFLGIGIMGSPMAHNLLKAGVDLTVWNRTKTKCDPLISLGAKYKPSPEEVAASCDVTFAMLADPQSAVDVACGKHGAANGIGPGKGYVDVSTVDGDTSKLISAQINSTGALFLEAPVSGSKKPAEDGQLIFLTAGDKALYETVGSLLDIMGKSKFYLGDVGNGAAMKLVVNMIMGSMMASFSEGLLLCEKVGLDPDVLVKVVSQGAINAPMYSTKGPSMIQSLYPTAFPLKHQQKDLRLALGLAESVSQSTPIAAAANELYKVAKSHGLSDQDFSAVIEALKSKIQHSENQ

SEQ ID NO: 4800 - protein, 808 aa, Glycine max
MANSETCCSTQLIDGDGTFNVSGLESFMKEVKLAECGLSYAVVSIMGPQSSGKSTLLNNLFGTNFREMDAFKGRSQTTKGIWMARCADIEPCTLVMDLEGTDGRERGEDDTAFEKQSALFALAVSDIVLINMWCHDIGREQAANKPLLKTVFQVMMRLFSPRKTTLLFVIRDKTRTPLENLEPVLREDIQKIWDSVPKPQAHKETPLSEFFNVEVVALSSYEEKEEQFKEQVASLQKRFHHSIAPGGLAGDRRGVVPASGFSFSSEHIWKVIKENKDLDLPAHKVMVATVRCEEIANEKYASFVANEDWCQLEEAVQSGPIPGFGKKLSSLLDTCFSEYDAEATYFDEGVRSSKQKQLQEKLFQLVQPAFQSALGHIRSGTLDKFKEAFDKALKGGEGFSVAANNCIGSGLVQFDEACTDVVIEQTNWDTSKVREKLLRDIDAYVATVRATKISELTSSYEEKLKQALSGPVEALLDGANRDTWPSIRNLLRRETESAVSGFSAALTGFDMDEETRQKMILSLEAYARGLVEGKAREEAGRVLMRMKDRFTMLFSHDSDSMPRVWTGKEDIRAITKTARSSSLKLLSVMAAIRLDDDDTDNIEKVLAVALVDSSPSSNATRSITMVDPLASSSWEQVSSSKTLITPVQCKSLWRQFKTETEYSVSQAISAQEANKRNNNWLPPPWAIVALVILGFNEFMTLLRNPLYLGVIFVGFLLIKALWVQLDVSGEFRNGALPGIISLSSKFIPTIMNLMRKLAEEGQNPAANNPQRTPSKNSYNDGHAVSSSASSNLTALDNGTEYASPLKDE

SEQ ID NO: 4801 - protein, 808 aa, Phaseolus vulgaris
MANSESCCSTQLIDGDGTFNISGVESFMKEVKLAECGLSYAVVSIMGPQSSGKSTLLNNLFRTNFREMDAFKGRSQTTKGIWMAKCTGIEPCTLVMDLEGTDGRERGEDDTAFEKQSALFALAVSDIVLINMWCHDIGREQAANKPLLKTVFQVMMRLFSPRKTTLLFVIRDKTRTPLENLEPVLREDIQKIWDSVPKPQAHKETPLSEFFNVEVVALSSYEEKEEQFKEQVASLRQRFQHSIAPGGLAGDRRGVVPASGFSFSSEHIWKVIKENKDLDLPAHKVMVATVRCEEITNEKYTSFAAHEDWCQLEEAVQSGPVPGFGRKLSSLLGTCLSEYDAEATYFDEGVRSSKQKQLQEKLFQLVQPAFQSALGHIRSGTLDKFKVAFDKALNGGEGFSVAANNCSASCMVQFDEACVDIVIEQTNWDTSKVRDKLLRDIEAHVATVRAAKISELTSSYEEKLKHALSGPVEALLDGASSDTWSSIRNLLTRETVSAVSGFSAALTGFDMDEETRLKMLKSLEDYARGLVEGKAREEVGRVLIRMKDRFTMLFSHDADSMPRVWTGKEDIRAITKTARSASLKLLSVMAAIRLDDDDSDNIEKVLAVALVEPSPSSNGTRSMTTVDPLASSSWEEVSSSKTLITPVQCKSLWRQFKTETEYSVSQAISAQEANKRNNNWLPPPWAIAALVILGFNEFMTLLRNPLYLGVIFVGYLLAKALWVQLDISGEFRNGALPAIISLSTKFVPTIMNLMKKLAEEGQNHATNNPQRSPTKNSYNETHGVSSSTSSNLTALDNGTEYASPVKDE

SEQ ID NO: 4802 - protein, 809 aa, Cajanus cajan
MANSDSCCSTQLIDGDGTFNVSGIEKFMKEVKLAECGLSYAVVSIMGPQSSGKSTLLNNLFGTNFREMDAFKGRSQTTKGIWMARCNGIEPCTLVMDLEGTDGRERGEDDTAFEKQSALFALAVSDIVLINMWCHDIGREQAANKPLLKTVFQVMMRLFSPRKTTLLFVIRDKTRTPLENLEPVLREDIQKIWDSVPKPQAHKETPLSEFFNVEVVALSSFEEKEEQFREQVASLRQRFHHSIAPGGLAGDRRGVVPASGFSFSSEQIWKVIKENKDLDLPAHKVMVATVRCEEIANEKYASFVANEDWCQLEEAVQSGPIPGFGKKLNSLLDTYLSEYDAEATYFDEGVRSSKQKQLQEKLFQLVQPAFQSALGHVRSGTLDKFKEAFDKALNRGEGFSVAANNCIESCMAQFDEACADVVIEQTNWDTTKVREKLRRDVDAHVATVRATMISELTSKYEEKLKTALSGPVEALLDGANSETWPSIRNLLRREAQSAVSEFSAALDGFDMDEETRQKMILSLEDHARGLVEGKAKEEAGRVLIRMKDRFTTLFSHDSDSMPRVWTGKEDIRAITKTARSASLKLLAVMAAVRLDDDDTDNIEKVLSVALVDSPSGSAATKSITMVDPLASSSWEQVSSSKTLITPVQCKSLWRQFKTETEYSVSQAISAQEASKRNNNWLPPPWAIVALVVLGFNEFMTLLRNPLYLGVIFVGYLLIKALWVQLDVSGEFRNGALPGIISLSSKFLPTIMNIMKKLAEEGQNTTVNNPQRTPSKNSYNDGRRAAPSSASSNLTSLDNGAEQESPLKDD

SEQ ID NO: 4803 - protein, 179 aa, Lupinus angustifolius
MASSDSSCSTQLLDGDGVFNVAGIETFMKEVKLAECGLSYAVVSIMGPQSSGKSTLLNHLFGTNFREMDAFKGRSQTTKGIWMARCAGIEPCTLVMDLEGTDGRERGEDDTAFEKQSALFALAVSDIVLINMWCHDIGREQAANKPLLKTVFQVMMRLFSPRKTTMLFVIRDKTRVYTT

SEQ ID NO: 4804 - protein, 812 aa, Cicer arietinum
MENSETCCSTQLIDGDGIFNATGIDKFMKEVKLGECGLSYAVVSIMGPQSSGKSTLLNNLFSTNFREMDAFKGRSQTTKGIWMARCAGIEPCTLVMDLEGTDGRERGEDDTAFEKQSALFALAVSDIVLINMWCHDIGREQAANKPLLKTVFQVMMRLFSPRKTTMLFVIRDKTRTPLENLEPVLREDIQKIWDSVPKPQAHKETPLSEFFNVEVVALSSYEEKEEQFREQVASLRQRFHHSIAPGGLAGDRRGVVPASGFSFSAQQIWKVIKENKDLDLPAHKVMVATVRCEEIANEKYASFVANEEWCQLEEAVQSGPIPGFGKKINSLLRACLSEYDAEATYFDEGVRSSKQKQLQDKLLQLVQPAFQSALGHIRSVTLDKFKETFEKALKGGERFSPAANTCIESCMAQFDEASADVVIEQANWDASKVREKLLRDIDAHVASVREAKISELTSSYEDKLKIALSGPVEALLDGANSDTWPSIRNLLKREIESSVLGFSAALNGFDMDEETRQNMILSLKDYARGVVEGKAKEEAGRVLIRMKDRFTMLFSHDSDSMPRVWTGKEDIRVITKTARSASLKLLSVMAAIRLDDGDTDDIEKTLAVALLDPSSNSVKDRSITAVDRLASSSWEKVPSTKTLITPVQCKSLWRQFKMETEYSVSQAISAQEANKRNNNWLPPPWAILALVVLGFNEFMTLLKNPLYLGVIFVVFLLLKALWVQLNIAGEFRHGILPGLISLSTKFVPTIMNLIKRLAEEGQNPTANNPQRTSSKNNTSNAVPVGSSASSSASSNLTSLDNGNRYTGSSKDE

SEQ ID NO: 4805 - protein, 819 aa, Medicago truncatula
MSAILEIRATNSETCCSTQLIDGDGLFNASGIEKFMKEVKLGECGLSYAVVSIMGPQSSGKSTLLNNLFHTNFREMDAFKGRSQTTKGIWMARCAGIEPCTLVMDLEGTDGRERGEDDTAFEKQSALFALAVSDIVLINMWCHDIGREQAANKPLLKTVFQVMMRLFSPRKTTLLFVIRDKTRTPLENLEPVLREDIQKIWDSVPKPQAHKDTPLSEFFNVEVVALSSYEEKEEQFREQVASLRQRFNQSIAPGGLAGDRRGVVPASGFSFSAQEIWKVIKENKDLDLPAHKVMVATVRCEEIANEKYAAFVANEEWCQLEETVQSDPIPGFGKKINSLLHACLSEYDAEATYFDEGVRTAKQKQLQEKLLQLVQPAYQSALGHMRSVTLEKFKETFEKALKGGERFSAAANNCIESCVDQFDKACADVVIELTNWDTSKVREKLLRDIDAHVASVREAKISELTSSYEEKLKVSLSGPVEALLDGANSDTWPSVRSLLKREIQSSVLGFSAALNGFDMDEETRQNMILSLEDYARGVVEGKAREEAGRVLIRMKDRFTMLFSHDSDSMPRVWTGNEDIRAITKTARSASLKLLSVMAALRLDDGDKDDIEKTLKVALLDSSSSANISRSITAVDPLATSSWEQIPSSKTLITPVQCKTLWRQFKMETEYSVSQAISAQEANKRHNNWLPPPWAILALVILGFNEFMTLLKNPLYLGVIFVGFLLIKALWVQLNIAGEFRHGVLPGVISLATKFVPTIMNLMKRLAEEGNNPAANNPQRHTSRNNTNAVPVGSSVSSSSSSNITALENGNRYTSSSKDE

SEQ ID NO: 4806 - protein, 352 aa, Trigonella foenum-graecum
MANSETCCSTQLIDGDGGFNASGIEKFMKEVKLSECGLSYAVVSIMGPQSSGKSTLLNNLFRTNFREMDAFKGRSQTTKGIWMARCAGIEPCTLVMDLEGTDGRERGEDDTAFEKQSALFALAVSDIVLINMWCHDIGREQAANKPLLKTVFQVMMRLFSPRKTTLLFVIRDKTRTPLENLEPVLREDIQKIWDSVPKPQAHKETPLSEFFNVEVVALSSYEEKEDQFREQVASLRERFHQSIAPGGLAGDRRGVVPASGFSFSAQEIWKVIKENKDLDLPAHKVMVATVRCEEIANEKYAALLQMRNGVNWKRLCNLILFLDLGTKSIHFFMLLCQSMMLRPLISMKVLEL

SEQ ID NO: 4807 - protein, 810 aa, Prunus mume
MANSEECCSTQLIDGDGTFNATGIDRLIKEVKLGECGLSYAIVSIMGPQSSGKSTLLNNLFATNFREMDAFRGRSQTTKGIWLAKCAGIEPCTLVMDLEGTDGRERGEDDTAFEKQSALFALAVSDIVLINMWCHDIGREQAANKPLLKTVFQVMMRLFSPRKTTLMFVIRDKTRTPLENLEPVLREDIQKIWDSVPKPEAHKETPLSEFFNVEVVALSSYEEKEEQFKEQVASLRQRFFHSIAPGGLAGDRRGVVPASGFSFSAQQIWKVIKENKDLDLPAHKVMVATVRCEEIANEKYADFSGNEEWSQLEEAVQSGPISGFGKKLSSILDTCLSEYDAEATYFDEGVRTGKRSQLEEKLLQLVQPAFQALLGHIRSGSLDKFKEAFDKALNGGEAFSVAACNCSESFMALFDEGCAHAVITQANWDTSKVRDKLKRDIEAHIASVRAAKLAELTALYEAKLKEALSGPVEALLDGANSETWPAIRKLFRHETESAVSGLSSALSGFDMDEQSRGKLLSSLEAYARGVVEAKTKEEAGRVLIRMKDRFTTLFSHDSDSMPRVWTGKEDIRSITKTARSSSLKLLSVMAAIRLDDGDADNIENTLSLALVDSTNVAAKDRSITTADPLASSTWQEVSSSKTLITPVQCKSLWRQFKAETEYSVSQAISAQEANKRNNNWLPPPWAIVALIVLGFNEFMTLLRNPLYLGVIFVGFLLIKALWVQLDVAGEFRNGALPGLISLSSKLVPTIMNMIKRLADEGANAAANDPHRNPPLASKNFTNEGNASSEMSSSASSGLTESDYSSPSKQD

SEQ ID NO: 4808 - protein, 813 aa, Theobroma cacao
MAKSEECCSTQLIDGDGIFNDTGIDQFIKEVKLGECGLSYAVVSIMGPQSSGKSTLLNNLFGTNFREMDAFKGRSQTTKGIWLANCAGIEPCTLVMDLEGTDGRERGEDDTAFEKQSALFALAVSDIVLINMWCHDIGREQAANKPLLKTVFQVMMRLFSPRKTTLMFVIRDKTRTPLENLEPVLREDIQKIWDSVPKPQAHKETPLSEFFNVEVVALSSYEEKEEQFKEQVANLRQRFFHSIAPGGLAGDRRGAVPASGFSFSAQQIWKVIKENKDLDLPAHKVMVATVRCEEIANEKYVSFMANENWCLLEEAVQSGPIAGFGKKLNSILYTFLSEYEAEATYFDEGVRSAKRKQLEEKLLQLVQPAYQSMLGHLRSGTLQKFKEAFEKALNGGEGFSMAARNCTESYMALFDEGCADAVVELANWDSSKVRDKLHRDIDAHVASVRAAKLSELTSSYEAKLNEALSGPVEALLDGASNETWPAIRKLLQRETESAISGLSGALSGFDMDEQTKDKMLTSLEDYARGVVEAKAREEAGRVLIRMKDRFSTLFSHDSDSMPRVWTGKEDIRAITKTARSASLKLLSVMAAIRLDDNADNIENTLSSALVDTKNNAAVTDRSITAFDPLASSTWEQVPPAKTLITPVQCKSLWRQFRAETEYSVTQAISAQEANKRNNNWLPPPWAIVALIVLGFNEFMTLLRNPLYLGVIFVGFLIMKALWVQLDISGEFRNGALPGLLSLSTKFLPTVMNLLRKLAEEGQIPANNNPQRNPAVASKGFQNGSTSSDLSSSASSEVTSSGNGTEYSSPTKED

SEQ ID NO: 4809 - protein, 715 aa, Prunus persica
MDLEGTDGRERGEDDTAFEKQSALFALAVSDIVLINMWCHDIGREQAANKPLLKTVFQVMMRLFSPRKTTLMFVIRDKTRTPLENLEPVLREDIQKIWDSVPKPESHKETPLSEFFNVEVVALSSYEEKEEQFKEQVASLRQRFFHSIAPGGLAGDRRGVVPASGFSFSAQQIWKVIKENKDLDLPAHKVMVATVRCEEIANEKYADFSGNEEWGQLEEAVQSGPISGFGKKLSSILDTCLSEYDAEATYFDEGVRTGKRKQLEEKLLQLVQPAFQALLGHIRSGSLDKFKEAFDKALNGGEAFSVAACNCFESFMALFDEGCADAVITQANWDTSKVRDKLKRDMEAHIASVRASKLAELTALYEAKLKEALSGPVEALLDGANSETWPAIRKLFQHETESAVSGLTSALSGFDMDEQSKGKLLSSLEAYARGVVEAKTKEEAGRVLIRMKDRFTTLFSHDSDSMPRVWTGKEDIRAITKTARSSSLKLLSVMAAIRLDDGDADNIENTLSLALVDSTNVAAKDRSITTADPLASSTWQEVSSSKTLITPVQCKSLWRQFKAETEYSVSQAISAQEANKRNNNWLPPPWAIVALIVLGFNEFMTLLRNPLYLGVIFVGFLLIKALWVQLDVAGEFRNGALPGLISLSSKLVPTIMNMIKRLADEGANAAANDPHRNPPLASKNFTNEGNASSEMSSSASSGLTESDYSSPSKQD

SEQ ID NO: 4810 - protein, 813 aa, Ricinus communis
MANSEESCSTQLIDGDGTFNAAGLEHFTKEVRLGECGLSYAVVSIMGPQSSGKSTLLNNLFGTNFREMDAFRGRSQTTKGIWLARCAGIEPCTLVMDLEGTDGRERGEDDTAFEKQSALFALAVSDIVLINMWCHDIGREQAANKPLLKTVFQVMMRLFSPRKTTLMFVIRDKTRTPLENLEPVLREDIQKIWDAVPKPQEHKETPLSEFFNVEVVALSSYEEKEEQFKEQVASLRQRFFHSIAPGGLAGDRRGVVPASGFSFSAQQMWKVIKENKDLDLPAHKVMVATVRCEEIANEKYANFTTNEEWHQIEEAVQSGPVSGFGKKLSSTLSTSFSEYDAEAIYFDEGVRSAKRKQLEEKLLQLVQPAHQSMLGHIRSGTLDKFKEAFDKALAAGEGFSSAAYSCTQYYMTVFDEGCTDAIIEQASWDTSKVRDKLRRDIDAHVASVRAAKLSELTSSFEAKLNEALSGPVEALLDGATSETWPAIRKLLQRESESAVSGLSSALAGFDMDKQSKDKMLSSLETYARGVVEAKAKEEAGRVLIRMKDRFSMLFSHDSDSMPRVWTGKEDIRAITKTARSASLKLLSVMVAIRLDDEVDNVESTLSSVFLDTKNNAAVTERSITKTDPLASSTWDEVPSSKTLITPVQCKSLWRQFKAETEYSVTQAISAQEANKRNNNWLPPPWAIVALVVLGFNEFMTLLRNPLYLGFIFVVFLLVKALWVQLDVSGEFRNGALPGLISLSTKFLPTIMNLIKKLAEEGQKPATNDPQRNPALAAKSFRNGVGSSDDMSTASSGVTSTENGTEFSSASKDD

SEQ ID NO: 4811 - protein, 812 aa, Glycine max
MANNEKCCSTQLIDGDGAFNVAGIENFMKEVKLSECGLSYAVVSIMGPQSSGKSTLLNSLFCTNFTEMDAFKGRSQTTRGIWMARCVGIEPCTLVMDLEGTDGRERGEDDTTFEKQSALFALAISDIVLINMCCHDIGREQAANKPLLKTVFQVMMRLFSPRKTTMLFVIRDKTKTPLENLEPVLREDIQKIWDSVPKPDAHKETPLSEFFIVEVVALSSFEEKEEQFKEQVANLRQRFYHSIAPGGLAGDRRGVVPASGFSFSAQEIWKIIKENKDLDLPAHKVMVATVRCEEIANEKYDLFATNKDWCELEEAVQSGPISEFGKKLNSLLIACLSEYDAEANYFDEGVRSAKQKQLQEKLFQLVQPTFQIVLGHMRSGILDKFKEAFDKALNGGEGFSSAANKCIEIYMAQFDEGCADVVIEIANWDTSKVREKLQRDIDAHVASVRASKMSELVSSYEEKLKEALSAPVETLLDAANSDTWPSIRKLLNHETQSAVSGFCVELIRFDVDEQTKKSMIVSLDDYAKGVIEAKAREEAGRVLIRMKDRFLTLFSHDSDSMPRIWTGKEDVRAITKSARSSCLKLLSVMAVIRLDDGDDIYNIEKTLIVALADSSSSSAKDKSMTAVKPLASSTWDQVPPSKTLITPVQCKSLWRQFKMETEYCVSQAISAQEANNRSSNWLPPPWAIVALIILGFNEFMTLLRNPLYLGVIFVGYLLIKALWAQLDITGEFRNGALPGIISLSSKFVPTIMRIIRKLAEEGQGHANNDPRRSPSKNNQSAIPAGRVTSSSASSSVTSPGNGAEYTSSSKHE

SEQ ID NO: 4812 - protein, 813 aa, Ricinus communis
MANSEESCSTQLIDGDGTFNAAGLEHFTKEVRLGECGLSYAVVSIMGPQSSGKSTLLNNLFGTNFREMDAFRGRSQTTKGIWLARCAGIEPCTLVMDLEGTDGRERGEDDTAFEKQSALFALAVSDIVLINMWCHDIGREQAANKPLLKTVFQVMMRLFSPRKTTLMFVIRDKTRTPLENLEPVLREDIQKIWDAVPKPQEHKETPLSEFFNVEVVALSSYEEKEEQFKEQVASLRQRFFHSIAPGGLAGDRRGVVPASGFSFSAQQMWKVIKENKDLDLPAHKVMVATVRCEEIANEKYANFTTNEEWHQIEEAVQSGPVSGFGKKLSSTLSTSFSEYDAEAIYFDEGVRSAKRKQLEEKLLQLVQPAHQSMLGHIRSGTLDKFKEAFDKALAAGEGFSSAAYSCTQYYMTVFDEGCTDAIIEQASWDTSKVRDKLRRDIDAHVASVRAAKLSELTSSFEAKLNEALSGPVEALLDGATSETWPAIRKLLQRESESAVSGLSSALAGFDMDKQSKDKMLSSLETYARGVVEAKAKEEAGRVLIRMKDRFSMLFSHDSDSMPRVWTGKEDIRAITKTARSASLKLLSVMVAIRLDDEVDNVESTLSSVFLDTKNNAAVTERSITKTDPLASSTWDEVPSSKTLITPVQCKSLWRQFKAETEYSVTQAISAQEANKRNNNWLPPPWAIVALVVLGFNEFMTLLRNPLYLGFIFVVFLLVKALWVQLDVSGEFRNGALPGLISLSTKFLPTIMNLIKKLAEEGQKPATNDPQINPALAAKSFRNGVGSSDDMSTASSGVTSTENGTEFSSASKDD

SEQ ID NO: 4813 - protein, 811 aa, Populus trichocarpa
MEKSDGCCSTHLIDGDGMFNDTGLEQLIKEVRLGECGLSYAIVSIMGPQSSGKSTLLNHLFGTSFREMDAFKGRSQTTKGIWLARCAGIEPCTLVMDLEGTDGRERGEDDTAFEKQSALFALAVSDIVLINMWCHDIGREQAANKPLLKTVFQVMMRLFSPRKTTLMFVIRDKTRTPLENLEPVLREDIQKIWDSVPKPEAHKETRLSEFFNVEVVALSSYEEKEEQFKEQVASLRQRFFHSIAPGGLAGDRRGVVPASGFSFSAQEIWKVIKENKDLDLPAHKVMVATVRCEEIANEKYGSFVANEKWCQMEEAVESGPVSGFGKKLSAILNISLSEYDAEAIYFDEGVRSAKRKQLEEKLLQLVQPAHQSMLGHIRSGTLEKFKEAFDKALNAGEGFSLAAQTCTQSYMAQFDEWCADAVIEQANWDTSKVRDKLRRDIDAHIASVHAAKLSELTSSFEAKLNAALSGPVEALLDGANSETWSAIKKLLLRETESAVAGFCNAIFGFDMDEQSKDKLIASLENYGRGVVEAKAREESGRVLIRMKDRFSMLFSHDSDSMPRIWTGKEDIRAITKTARSASLKLLSVMAAIRLDDDVDNIETTLSSALMDAKNNAAVKDRSIIPFDPLASNSWEKIPSSRTLITPVQCKSLWRQFKTETEYTVTQAISAQEAHKRNNNWLPPPWAILALVVLGFNEFMTLLRNPLYLGVIFVGFLLIKALWVQLDISGEFRNGALPGLLSLSSKFVPTIMNLLKRLAEEGQKPATADPQRNATKSFQNGSSSFSDSSSSASSGVTSPKQGTEYSNTLKDD

SEQ ID NO: 4814 - protein, 64 aa, Trifolium pratense
MSTKQGGKAKPLKKPKSDKKDYDEVDMANIQKKKDEEKALKELKAKAQQKGSFGGSGLKKSGKK

SEQ ID NO: 4815 - protein, 64 aa, Arachis hypogaea
MSTKQGGKAKPLKKPKSDKKDYDEVDMANIQKEKEEEKALKELKAKAQQKGSFGGSGLKKSGKK

SEQ ID NO: 4816 - protein, 64 aa, Medicago truncatula
  Sequence also found in Organisms: Vicia sativa
MSTKQGGKAKPLKKPKSDKKDYDEVDMANIQKKKDEEKALKELKAKASQKGSFGGSGLKKSGKK

SEQ ID NO: 4817 - protein, 64 aa, Cicer arietinum
MSTKQGGKAKPLKKPKSDKKDYDEIDMANIQKKKDEEKALKELKAKAQQKGSFGGSGLKKSGKK

SEQ ID NO: 4818 - protein, 64 aa, Lupinus angustifolius
MSTKQGGKAKPLKKPKSDKKDYDEIDMANIQKKKEEEKALKELKAKASQKGSFGGSGLKKSGKK

SEQ ID NO: 4819 - protein, 64 aa, Glycine max
MSTKQGGKAKPLKKPKSDKKDYDEIDVANIQKKKEEEKALKELKAKAQQKGSFGGSGLKKSGKK

SEQ ID NO: 4820 - protein, 64 aa, Phaseolus vulgaris
MSTKQGGKAKPLKKPKSDKKDYDDVDMANLQKKKEEEKALKELKAKAQQKGSFGGSGLKKSGKK

SEQ ID NO: 4821 - protein, 64 aa, Vigna unguiculata
MLTKQGGKAKPLKKPKFDKKDYDEVDMANIQKKKEEEKALKELKAKAQQKGSFGGFGLKKSGKK

SEQ ID NO: 4822 - protein, 64 aa, Lupinus angustifolius
MSSKQGGKAKPLKKPKSDKKDYDEIDMANIQKKKEEEKALKELKAKASQKGSFGGSGLKKSGKK

SEQ ID NO: 4823 - protein, 64 aa, Glycine max
MSTKQGGKAKPLKKPKSDKKDYDEVDMANIQKNKEEEKALKELKAKAQHKGSFGGFGLKKSGKK

SEQ ID NO: 4824 - protein, 111 aa, Cyamopsis tetragonoloba
HEEGTYIDKKCPFTGNVSIRGRILAGTCHSAKMTRTIIVRRNYLHFIKKYQRYEKRHSNIPAHISPCFRVKEGDHVIIGQCRPISKTVRFNVLKVIPAGSSSGAKKAFTGM

SEQ ID NO: 4825 - protein, 64 aa, Lupinus angustifolius
MSSKQGGKAKPLKKPKSDKKDYDEIDIANIQKKKDEEKALKELKAKASQKGSFGGSGLKKSGKK

SEQ ID NO: 4826 - protein, 64 aa, Theobroma cacao
MSSKQGGKLKPLKQPKSDKKEYDEHDMANIQKKKEEEKALKELRAKAQQKGSFGGSGLKKSGKK

SEQ ID NO: 4827 - protein, 64 aa, Cucumis melo
MSSKQGGKAKPLKQPKVDKKDYDEVDMANIQKKKEEEKALKELRAKAQQKGTFGGAGLKKSGKK

SEQ ID NO: 4828 - protein, 64 aa, Triphysaria pusilla
MSSKQGGKAKPLKQPKADKKEYDEIDMANIQKKKDEEKALKELKAKAQQKGSFGGSGLKKSGKK

SEQ ID NO: 4829 - protein, 64 aa, Mimulus guttatus
MSSKQGGKAKPLKQPKAASKEYDEVDMANIQKKKEEEKALKELKAKAQQKGSFGGSGLKKSGKK

SEQ ID NO: 4830 - protein, 64 aa, Lippia dulcis
MSSKQGGKAKPLKQPKADKKEYDETDMANIQKKKEEEKALKELRAKAQQKGSFGGSGLKKSGKK

SEQ ID NO: 4831 - protein, 64 aa, Brassica oleracea
  Sequence also found in Organisms: Eutrema halophilum
MSSKQGGKAKPLKQPKADKKEYDEHDMANIQKKKEEEKALKELRAKASQKGSFGGSGLKKSGKK

SEQ ID NO: 4832 - protein, 62 aa, Triphysaria pusilla
SKQGGKAKPLKQPKSDKKEYDEFDMANIQKKKEDEKALKELKAKAQQKGSFGGSGLKKSGKK

SEQ ID NO: 4833 - protein, 140 aa, Glycine max
MYKYFLFTIHEFVNEIIMKIHNSWSLKAIVSFTCALRRRRSNFIPSCSVSYLKFVEFALDETKRHTHLIPSPLQEKFSFMNSKDVKGSLSMLSFEATKIRLLRRLIIETETMQVVFLMPINYQIDIWLVSTSVLTKYAFV

SEQ ID NO: 4834 - protein, 64 aa, Brassica juncea
MSSKQGGKAKPLKQPKADKKEYDEHDMANIQKKKDEEKALKELRAKASQKGSFGGSGLKKSGKK

SEQ ID NO: 4835 - protein, 64 aa, Vaccinium corymbosum
MSSKQGGKAKPLKQPKADKKEYDEHDLANLQKKKDEEKALKELKAKAQQKGSFGGSGLKKSGKK

SEQ ID NO: 4836 - protein, 64 aa, Cucumis sativus
MSSKQGGKAKPLKQPKVDKKDYDEVDMANMQKKKDEEKALKELRAKAQQKGTFGGAGLKKSGKK

SEQ ID NO: 4837 - protein, 64 aa, Carica papaya
MSSKQGGKIKPLKQPKSDKKDYDEHDLANLQKKKEEEKALKELKAKAQQKGSFGGTGMKKSGKK

SEQ ID NO: 4838 - protein, 65 aa, Arachis hypogaea
MSTKQGGKAKPLKKPKSDKKDYDEVDMANIQKKKEEEKALKELKAKARFWAQEEWKEMRALSHDT

SEQ ID NO: 4839 - protein, 64 aa, Triphysaria pusilla
MSSKQGGKAKPLKQPKAEKKEYDEIDKANIQKKKDEEKALKELKAKAQQKGSFGGSGLKKSGKK

SEQ ID NO: 4840 - protein, 64 aa, Triphysaria pusilla
MSSKQGGKAKPLKQPKTEKKEYDEIDKANIQKKKDEEKALKELKAKAQQKGSFGGSGLKKSGKK

SEQ ID NO: 4841 - protein, 64 aa, Bruguiera gymnorhiza
MSSKQGGKAKPLKQPKADKKELDEVDKANLQKKKEEEKALKELKAKAQQKGAFGGSGLKKSGKK

SEQ ID NO: 4842 - protein, 64 aa, Ocimum basilicum
MSSKQGGKAKPLKQPKAEKKEYDEMDKANIQKKKEEEKALKELKAKAQQKGAFGGSGLKKSGKK

SEQ ID NO: 4843 - protein, 85 aa, Allium cepa
MSSKQGGKAKPLKQPKSDKKEYDETDLANLQKKREEEKALKELKAKASQKGSFGGAGLKKSGKKYDGMFSKTIYFHVYLIHMLFM

SEQ ID NO: 4844 - protein, 182 aa, Brassica juncea
MARRDVLFLSVLLILATVFSISSADDEPDCVYTFYLRTGSIWKAGTESIISARIYDKYGDYIGIRNLEAWGGLMGPGYKYYERGNLDIFSGRAPCLPSPVCSLNLTSDGSGDHHGWYVNYVEVTTAGVHATCSQQSFEVEQWLATDTSPYELTAVRNNCPVSLRESVGRVGSEIRKTLSWIV

SEQ ID NO: 4845 - protein, 64 aa, Brassica juncea
  Sequence also found in Organisms: Brassica oleracea, Raphanus sativus, Eutrema parvulum
MSSKQGGKAKPLKQPKADKKEYDEHDMANLQKKKDEEKALKELRAKASQKGSFGGSGLKKSGKK

SEQ ID NO: 4846 - protein, 64 aa, Allium cepa
MSSKQGGKAKPLKQPKSDKKEYDETDLANLQKKKDEEKALKELKAKASQKGSFGGAGLKKSGKK

SEQ ID NO: 4847 - protein, 64 aa, Allium cepa
MSSKQGGKAKPLKQPKSDKKEYDETDLANLQKKREEEKALKELKAKASQKGSFGGAGLKKSGKK

SEQ ID NO: 4848 - protein, 64 aa, Petroselinum crispum
MSSKQGGKAKPLKAPKVDKKEYDEDDLAKLQKKKEEEKALKELKAKAQQKGAFGGSGLKKSGKK

SEQ ID NO: 4849 - protein, 64 aa, Arabidopsis thaliana
  Sequence also found in Organisms: Arabidopsis lyrata
MSSKQGGKAKPLKQPKADKKEYDETDLANIQKKKDEEKALKELRAKASQKGSFGGSGLKKSGKK

SEQ ID NO: 4850 - protein, 64 aa, Cucurbita pepo
MSSKQGGKAKPLKQPKIEKKDYDEVDMANIQKKKDEEKALRELRAKAQQKGAFGGAGLKKSGKK

SEQ ID NO: 4851 - protein, 64 aa, Gossypium raimondii
MSSKQGGKAKPLKQPKSEKKEYDEHDLANIQKKKEEEKALRELRAKASQKGSFGGSGLKKSGKK

SEQ ID NO: 4852 - protein, 64 aa, Momordica charantia
MSSKQGGKAKPLKQPKVDKKEYDEVDMANIQKKKDEEKALRELRAKAQQKGTFGGAGLKKSGKK

SEQ ID NO: 4853 - protein, 64 aa, Platanus occidentalis
MSSKQGGKAKPLKQPKSEKKDYDEVDMMNIQKKKDEEKALKELRAKATQKGTFGGTGLKKSGKK

SEQ ID NO: 4854 - protein, 64 aa, Prunus mume
MSSKQGGKAKPLKQPKSEKKDYDESDLANLQKKKDEEKALKELRAKAQQKGSFGGAGLKKSGKK

SEQ ID NO: 4855 - protein, 64 aa, Citrullus lanatus
MSSKQGGKAKPLKQPKVDKKDYDEVDLANIQKKKEEEKALRDLRAKAQQKGTFGGAGLKKSGKK

SEQ ID NO: 4856 - protein, 64 aa, Sesamum indicum
MSSKQGGKAKPLKQPKAEKKEYDEIDKANIQKKKDEEKALKELKAKAQQKGAFGGSGLKKSGKK

SEQ ID NO: 4857 - protein, 64 aa, Raphanus sativus
MSSKQGGKAKPLKQPKTDKKEYDEHDMANLQKKKDEEKALKELRAKASQKGSFGGSGLKKSGKK

SEQ ID NO: 4858 - protein, 64 aa, Populus trichocarpa
MSSKLGGKAKPLKAPKSEKKEYDETDLANIQKKKDEEKALKELRAKAQQKGSFGGSGLKKSGKK

SEQ ID NO: 4859 - protein, 63 aa, Castanea mollissima
MSSKQGGKAKPLKQPKAEKKDYDEVDMANIQKKKEEEKALKELRAKAQKGPIGGAGLKKSGKK

SEQ ID NO: 4860 - protein, 64 aa, Daucus carota
  Sequence also found in Organisms: Petroselinum crispum
MSSKQGGKAKPLKAPKAEKKEYDEDDLAKLQKKKEEEKALKELKAKAQQKGAFGGSGLKKSGKK

SEQ ID NO: 4861 - protein, 64 aa, Allium cepa
MSSKQGGKAKPLKQPKADKKEYDEIDRANLQKKKDEEKALKELKAKAAQKGSFGGAGLKKSGKK

SEQ ID NO: 4862 - protein, 63 aa, Cucurbita pepo
MSSKQGGKAKPLKQPKIEKKDYDEVDMANIQKKDEEKALRELRAKAQQKGAFGGAGLKKSGKK

SEQ ID NO: 4863 - protein, 64 aa, Panax ginseng
MSSKQGGKAKPLKQPKAEKKEYDEDDLAKLQKKKEEEKALKELKAKAQQKGAFGGSGLKKSGKK

SEQ ID NO: 4864 - protein, 64 aa, Mimulus guttatus
MSTKQGGKAKPLKQPKAEKKEYDEIDKANIQKKKDEEKAIKELKAKAQQKGAFGGAGLKKSGKK

SEQ ID NO: 4865 - protein, 64 aa, Tropaeolum majus
MSSKQGGKAKPLKQPKVDKKDYDEHDLANMQKKKDEEKALRDLRAKAQQKGSFGGSGLKKSGKK

SEQ ID NO: 4866 - protein, 64 aa, Ocimum basilicum
MSSKAGGKAKPLKQPKVAKKEYDEDDLANLQKKKEEEKALKELKAKAQQKGAFGGSGLKKSGKK

SEQ ID NO: 4867 - protein, 79 aa, Allium cepa
MSSKQGGKAKPLKQPKSDKKEYDETDLANLQKKREEEKALKELKDKSISEGIIRWCRPEEEWQKIMMACSVKQFIFTFI

SEQ ID NO: 4868 - protein, 66 aa, Panax ginseng
KQWYQRRVHGENIKRYSYNFRRPKVIRFGIKGYLINSISLRIRENPKISHVVQARWKSKAFKATQG

SEQ ID NO: 4869 - protein, 64 aa, Allium cepa
SPFTKSIMSSKQGGKAKPLKQPKSDKKEYDETDLANLQKKREEEKALKELKAKHLRRDHSVVQA

SEQ ID NO: 4870 - protein, 85 aa, Euphorbia esula
DRAIPLCILLRLGPNPNDISAMSSKQGGKAKPLKQPKVDKKEYDEVDLANMQKKKEEEKAIRELRAKAQQKGTFGGAGLKKSGKK

SEQ ID NO: 4871 - protein, 64 aa, Musa acuminata
MSSKQGGKLKPLKQPKADKKEYDEMDKANIQKKKDEEKALKELRAKASQKGSFGGTGLKKSGKK

SEQ ID NO: 4872 - protein, 64 aa, Ricinus communis
MSSKQGGKAKPLKQPKAGKKEYDETDLANIQKKKDEEKALKELKAKAAQKGALGGSGLKKSGKK

SEQ ID NO: 4873 - protein, 63 aa, Cyclamen graecum
  Sequence also found in Organisms: Ananas comosus
MSTKQGGKAKPLKAPKAEKKDYDEVDKANLQKKKDEEKALKELRAKAQKGALGGTGLKKSGKK

SEQ ID NO: 4874 - protein, 62 aa, Echinochloa colona
MSKQGGKAKPLKAPKVDKKDYDETDLAYLQKKKDEEKALKELKAKAQKGAIGGSGLKKSGKK

SEQ ID NO: 4875 - protein, 64 aa, Allium cepa
MSSKQGGKAKPLKQPKANKKEYDENDLALLQKKKEEEKALKELKAKAAQKGSFGGAGLKKSGKK

SEQ ID NO: 4876 - protein, 64 aa, Cycas rumphii
MSSKQGGKAKPLKQPKQEKKEYDEADMAHIQKKKDEEKALKELKSKASQKGSFGGAGLKKSGKK

SEQ ID NO: 4877 - protein, 63 aa, Echinacea purpurea
MSSKQGGKAKPLKQPKAEKKEYDEIDKANIQKKKEEEKALKELRAKAQKGALGGSGLKKSGKK

SEQ ID NO: 4878 - protein, 64 aa, Eschscholzia californica
MSSKQGGKAKPLKQPKVEKKEYDEDDLAKIQKKKEEEKALKELRAKASQKGSFGGAGLKKSGKK

SEQ ID NO: 4879 - protein, 64 aa, Eschscholzia californica
MSSKQGGKAKPLKQPKVDKKEYDEDDLAKIQKKREEEKALKELRAKASQKGSFGGAGLKKSGKK

SEQ ID NO: 4880 - protein, 64 aa, Panax ginseng
MSSKQGGKAKPLKQPKAEKKEYDEDDLAKLQKKKEEEKALKELKTKAQQKGAFGGSGLKKSGKK

SEQ ID NO: 4881 - protein, 64 aa, Elaeis guineensis
MSSKQGGKAKPLKQPKVEKKEYDETDHANIQKKKEEEKALKELRAKASQKGTFGGAGLKKSGKK

SEQ ID NO: 4882 - protein, 64 aa, Citrullus lanatus
MSSKQGGKAKPLKQPKVDKKEYDEVDLANMQKKKEEEKAIRELRAKAQQKGTFGGAGLKKSGKK

SEQ ID NO: 4883 - protein, 63 aa, Juglans hindsii x Juglans regia
MSSKQGGKAKPLKQPKADKKEYDEVDKANIQKKKDEEKALKELRAKAQKGPIGGAGLKKSGKK

SEQ ID NO: 4884 - protein, 64 aa, Musa acuminata
MSSKQGGKLKPLKQPKSDKKDYDETDLANLQKKKDEEKAMKELRAKASQKGSFGGTGLKKSGKK

SEQ ID NO: 4885 - protein, 63 aa, Lactuca sativa
MSSKQGGKAKPLKQPKSEKKEYDEVDKANIQKKKDEEKALKELRAKAQKGALGGTGLKKSGKK

SEQ ID NO: 4886 - protein, 62 aa, Tamarix hispida
MPSKQGGKAKPLKQPKSDKEYDEIDRANLQKKKEEEKALKELRAKAQKGSLGGSGLKKSGKK

SEQ ID NO: 4887 - protein, 63 aa, Olea europaea
MSSKQGGKAKPLKQPKADKKEYDEDDKAFIQKKKEEEKALKELKAKAQKGALGGAGLKKSGKK

SEQ ID NO: 4888 - protein, 132 aa, Cocos nucifera
MGCLKPLLLAILIISSFALLAESRVSRMELDLGLGLGVGVGVGIGGGGGGSGSGSGSGSGSGSGSGSGSGSGASSSAGSGASSSAGSGSGSGAGSSAGSGASSSAGSGGNSGSGGGYGEGHGYGSGGGGNGN

SEQ ID NO: 4889 - protein, 69 aa, Humulus lupulus
MSSKQGGKAKPLKQPKKDQKDYDETDLANIQKKKEEEKALRELKAKAQQKGAFGGSGLRKWKNKGGLVP

SEQ ID NO: 4890 - protein, 79 aa, Allium cepa
MSSKQGGKAKPLKQPKSDKKEYDETDLANLQKKREEERTLKELKDKSISEGIIRWCRPEEEWQKIMMACSVKQFIFTFI

SEQ ID NO: 4891 - protein, 64 aa, Allium cepa
MSSKQGGKAKPLKQPKSDKKEYDETDLANLQKKREEEKALKELRQSISEGIIRWCRPEEVWQKI

SEQ ID NO: 4892 - protein, 84 aa, Sarracenia psittacina
MSSKQGGKAKPLKQPKVDKKDYDENDLANLQKKKEEEKALKDLRAKAQQKGAFGGSGLKKVGRNEERFQVKCTLICAMILQMHR

SEQ ID NO: 4893 - protein, 63 aa, Chrysanthemum coronarium
MSSKMGGKAKPLKAPKSEKKEYDEVDKANIQKKKDEEKALKELRAKAQKGALGGAGLKKSGKK

SEQ ID NO: 4894 - protein, 63 aa, Cichorium intybus
MSSKQGGKAKPLKQPKAEKKEYDEVDKANIQKKKDEEKALKELRAKAQKGALGGTGLKKSGKK

SEQ ID NO: 4895 - protein, 64 aa, Cocos nucifera
MSSKQGGKAKPLKHPKTEKKEYDETDLANIQKKKEEEKALKELRSKATQKGTFGGAGLKKSGKK

SEQ ID NO: 4896 - protein, 64 aa, Cocos nucifera
MSSKQGGKAKPLKQAKVQKKEYDETDLANLQKKKEEEKALKELKAKASQKGTFGGAGLKKSGKK

SEQ ID NO: 4897 - protein, 62 aa, Zea mays
  Sequence also found in Organisms: Echinochloa colona
MSKQGGKAKPLKAPKADKKEYDETDLAYLQKKKDEEKALKELKAKAQKGAIGGSGLKKSGKK

SEQ ID NO: 4898 - protein, 62 aa, Zea mays
  Sequence also found in Organisms: Sorghum bicolor, Setaria italica
MSKQGGKAKPLKAPKVDKKEYDESDLAYLQKKKDEEKALKELKAKAQKGAIGGSGLKKSGKK

SEQ ID NO: 4899 - protein, 64 aa, Arabidopsis thaliana
MSSKQGGKLKPLKQPKSGKKEYDEHDMELMQKKKDEEKALKELRAKASQKGSFGGSGLKKSGKK

SEQ ID NO: 4900 - protein, 63 aa, Echinacea purpurea
MSSKQGGKAKPLKQPKAEKKDYDEIDKANLQKKKEEEKALKELRAKAQKGALGGTGLKKSGKK

SEQ ID NO: 4901 - protein, 64 aa, Euphorbia peplus
MSSKQGGKAKPLKQPKVDKKEYDEVDLANMQKKKEEEKAIRELRAKAQQKETFGGAGLKKSGKK

SEQ ID NO: 4902 - protein, 64 aa, Panax ginseng
MSSKQGGKAKPLKQPKAEKKEYDEDDLAKLQKKKEEEKSLKDLKAKAQQKGAFGGSGLKKSGKK

SEQ ID NO: 4903 - protein, 64 aa, Vitis vinifera
MSSKAGGKLKPLKQPKADKKEYDEDDLAKLQKKKEEEKALKELKAKAAQKGAFGGSGLKKSGKK

SEQ ID NO: 4904 - protein, 64 aa, Hevea brasiliensis
MSSKQGGKAKPLKQAKVEKKEYDETDKVNIQKKKDEEKALKELRAKAAQKGSFGGSGLKKSGKK

SEQ ID NO: 4905 - protein, 63 aa, Olea europaea
MSSKQGGKAKPLKAPKSEKKEYDENDKAFIQKKKEEEKALKELKSKAQKGALGGAGLKKSGKK

SEQ ID NO: 4906 - protein, 63 aa, Olea europaea
MSSKQGGKAKPLKQPKADKKEYDEDDKAFLQKKKEEEKALKELKAKAQKGALGGAGLKKSGKK

SEQ ID NO: 4907 - protein, 62 aa, Eragrostis curvula
MSKQGGKAKPLKAPKTDKKEYDESDLAYLQKKKDEEKALKELKAKAQKGAIGGSGLKKSGKK

SEQ ID NO: 4908 - protein, 62 aa, Panicum virgatum
MSKQGGKAKPLKAPKADKKEYDESDLAYLQKKKEEEKALKDLKAKAQKGAIGGSGLKKSGKK

SEQ ID NO: 4909 - protein, 62 aa, Panicum virgatum
MSKQGGKAKPLKAPKVDKKEYDESDLAYLQKKKEEEKALKDLKAKAQKGAIGGSGLKKSGKK

SEQ ID NO: 4910 - protein, 64 aa, Zostera marina
MSSKQGGKAKPLKQPKAKGKEYDETDLANLQKKKDEEKALKELKAKASQKGSFGGAGLKKSGKK

SEQ ID NO: 4911 - protein, 63 aa, Euphorbia esula
MSSKQGGKAKPLKAPKAAKKEYDEDDLANIQKKKEEEKALKELRAKAQKGPIGGAGLKKSGKK

SEQ ID NO: 4912 - protein, 64 aa, Musa acuminata
MSSKQGGKLKPLKQPKSDKKEYDETDLANLQKKKDEEKAMKELRAKASQKGSFGGTGLKKSGKK

SEQ ID NO: 4913 - protein, 64 aa, Ananas comosus
MSSKQGGKLKPLKQAKADKKEYDETDLANIQKKKDEEKALKELRAKASQKGSFGGAGLKKSGKK

SEQ ID NO: 4914 - protein, 535 aa, Glycine max
MALAFDEFGRPFIILKEQEQKSRLRGLDAQKANISAGKAVARILRTSLGPKGMDKMLQSPDGDVTITNDGATILDQMDVDNQIAKLMVELSRSQDYEIGDGTTGVVVMAGALLEKAERLLERGIHPIRIAEGYEMASRIAVEHLERVANKFEFDESNLEPLIQTCMTTLSSKIVNRCKRSLAEIAVKAVLAVADLARKDVNLDLIKVEGKVGGKLEDTELIYGIVVDKDMSHPQMPKQIEDAKIAILTCPFEPPKPKTKHKVDIDTVEKFQTLRLQEQKYFDDMVQKCKDVGATLVICQWGFDDEANHLLMHRNLPAVRWVGGVELELIAIATGGRIVPRFQELSPEKLGKAGMVREKSFGTTKDRMLYIEHCANSRAVTIFIRGGNKMIIEETKRSLHDALCVARNLIRNNSIVYGGGSAEISCSIAVEAAADRYPGVEQYAIRAFGDALEAIPMALAENSGLQPIETLSAVKSQQIKDNNPHFGIDCNDVGTNDMREQNVFETLIGKQQQLLLATQVVKMILKIDDVISPYEY

SEQ ID NO: 4915 - protein, 535 aa, Phaseolus vulgaris
MALAFDEFGRPFIILKEQEQKSRLRGLDAQKSNISAGKAVARILRTSLGPKGMDKMLQSPDGDVTITNDGATILEQMDVDNQIAKLMVELSRSQDYEIGDGTTGVVVMAGALLEKAERLLERGIHPIRIAEGYETASRISVEHLDRVANKFEFGESNLEPLIQTCMTTLSSKIVNRCKRSLAEIAVKAVLAVADLERKDVNLDLIKVEGKVGGKLEDTELIYGIVVDKDMSHPQMPKQIEDANIAILTCPFEPPKPKTKHKVDIDTVEKFQTLRVQEQKYFDEMVQKCKDVGATLVICQWGFDDEANHLLMHRNLPAVRWVGGVELELIAIATGGRIVPRFQELTTEKLGKAGIVREKSFGTTKDRMLYIEHCANSRAVTIFIRGGNKMIIEETKRSLHDALCVARNLIRNNSIVYGGGSAEISCSIAVDAAADRYPGVEQYAIRAFGDALEAIPMALAENSGLQPIETLSAVKSQQIKDNNPHFGIDCNDVGTNDMREQNVFETLIGKQQQILLATQVVKMILKIDDVISPSDY

SEQ ID NO: 4916 - protein, 535 aa, Arachis hypogaea
MALAFDEFGRPFIILKEQEQKSRLRGLDAQKANISAGKAVARILRTSLGPKGMDKMLQSPDGDVIITNDGATILEQMDVDNQIAKLMVELSRSQDYEIGDGTTGVVVMAGALLEQAERLLERGIHPIRVAEGYEMASRIAVDHLENIAKKFEFGPTDLEPLIQTCMTTLSSKIVNRCKRSLAEIAVKAVLAVADLERKDVNLDLIKVEGKVGGKLEDTELIYGIVVDKDMSHPQMPKRIEDAKIAILTCPFEPPKPKTKHKVDIDTVEKFQTLRKQEQQYFDDMVQKCKDVGATLVICQWGFDDEANHLLMHRNLPAVRWVGGVELELIAIATGGRIVPRFQELSPEKLGKAGVVREKSFGTTKDRMLYIEHCANSRAVTIFTRGGNKMIIEETKRSLHDALCVARNLIRNNSIVYGGGSAEISCSIAVEAAADRYPGVEQYAIRAFGDALEAIPMALAENSGLQPIETLSAVKSQQIKDNNPNFGIDCNDVGTNDMREQNVFETLIGKQQQILLATQVVKMILKIDDVISPSEF

SEQ ID NO: 4917 - protein, 378 aa, Arachis hypogaea
MALAFDEFGRPFIILKEQEQKSRLRGLDAQKANISAGKAVARILRTSLGPKGMDKMLQSPDGDVIITNDGATILEQMDVDNQIAKLMVELSRSQDYEIGDGTTGVVVMAGALLEQAERLLERGIHPIRVAEGYEMASRIAVDHLENIAKKFEFGPTDLEPLIQTCMTTLSSKIVNRCKRSLAEIAVKAVLAVADLERKDVNLDLIKVEGKVGGKLEDTELIYGIVVDKDMSHPQMPKRIEDAKIAILTCPFEPPKPKTKHKVDIDTVEKFQTLRKQEQQYFDDMVQKCKDVGATLVICQWGFDDEANHLLMHRNLPAVRWVGGVELELIAIATGGRIVPRFQELSPEKLGKAGVVRENPLVQQKTGCCTLSIVQTRGL

SEQ ID NO: 4918 - protein, 535 aa, Trifolium pratense
MALAFDEFGRPFIILREQENKNRLRGLDAQKANISAGKAVARILRTSLGPKGMDKMLQSPDGDVIISNDGATILEQMDVDNQIAKLMVELSRSQDYEIGDGTTGVVVLAGSLLEQAERLLERGIHPIRIAEGYEMASRIAVENLERIANKFEFGETILEPLIQTCMTTLSSKIVNRCKRSLAEIAVKAVLAVADLERKDVNLDLIKVEGKVGGKLEDTELVYGIIVDKDMSHPQMPKQIEDAKIAILTCPFEPPKPKTKHKVDIDTVEKFQTLRKQEQKYFDDMVQQCKDVGATLVICQWGFDDEANHLLMHRNLPAVRWVGGVELELIAIATGGRIVPRFQELTAEKLGKAGIVREKAFGTTKDRMLYIEHCANSRAVTIFIRGGNKMIIEETKRSIHDALCVARNLIRNNSIVYGGGSAEIACSIAVEAAADKYPGVEQYAIRAFGDALESIPMALAENSGLQPIETLSAVKSQQIKDNNPHFGIDCNDVGTNDMREQNVFETLIGKQQQILLATQVVKMILKIDDVISPSEY

SEQ ID NO: 4919 - protein, 535 aa, Lupinus angustifolius
MALAFDEYGRPFIILKEQEQKSRLRGLDAQKSNISAGKAVARILRTSLGPKGMDKMLSSPDGDVTISNDGATILEQMDVDNQIAKLMVELSRSQDYEIGDGTTGVVVLAGALLEQAEKLLERGIHPIRVAEGYETASRIAVEHLEHVANKFEFGVTDLEPLIQTCMTTLSSKIVNRCKRSLAEIAVKAVLAVADLERKDVNLDLIKVEGKVGGKLEDTELIYGIVVDKDMSHPQMPKQIEDAQIAILTCPFEPPKPKTKHKVDIDTVEKFQTLRKQEQQYFDDMVQKCKDVGATLVICQWGFDDEANHLLMNRNLPAVRWVGGVELELIAIATGGRIVPRFQELTPEKLGKAGLVREKSFGTTKDRMLYIEHCANSRAVTIFIRGGNKMIIEETKRSIHDALCVARNLIRNNSIVYGGGSAEISCSIAVEAAADKHPGVEQYAIRAFRDALEYIPMALAENSGLQPIETLSAVKSQQIKDNYPHFGIDCNDVGTNDMREQNVFETLIGKQQQILLATQVVKMILKIDDVISPSEY

SEQ ID NO: 4920 - protein, 535 aa, Solanum lycopersicum
MALAFDEFGRPFIILREQEQKTRLRGLDAQKANISAGKAVARILRTSLGPKGMDKMLQSPDGDVTITNDGATILEQMDVDNQIGKLMVELSRSQDYEIGDGTTGVVVMAGALLEQAEKLLERGIHPIRIAEGYEMASRIAVEHLERVAHKFEFGQNDVEPLVQTCMTTLSSKIVNRCKRSMAEIAVKAVLAVADLERKDVNLDLIKVEGKVGGKLEDTELIYGIIVDKDMSHPQMPKQIEDAKIAILTCPFEPPKPKTKHKVDIDTVEKFQTLRLQEQKYFDDMVQKCKDVGATLVICQWGFDDEANHLLMHRNLPAVRWVGGVELELIAIATGGRIVPRFQELTPEKLGKAGIVREKSFGTTKDRMIYIEHCANSRAVTIFIRGGNKMMIEETKRSIHDALCVARNLIRNNSIVYGGGSAEISCSIAVEAAADKHPGVEQYAIRAFADALDAVPMALAENSGLQPIETLSAVKSQQIKENNPCCGIDCNDVGTNDMREQNVFETLIGKQQQILLATQVVKMILKIDDVITPSEY

SEQ ID NO: 4921 - protein, 535 aa, Medicago truncatula
MALAFDEYGRPFIILREQESKNRLRGLDAQKANISAGKAVARILRTSLGPKGMDKMLQSPDGDVIISNDGATILEQMDVDNQIAKLMVELSRSQDYEIGDGTTGVVVLAGSLLEQAERLLERGIHPIRIAEGYEMASRIAVENLEKIANKFEFGETILEPLIQTCMTTLSSKIVNRCKRSLAEIAVKAVLAVADLERKDVNLDLIKVEGKVGGKLEDTELVYGIIVDKDMSHPQMPKQIEDAKIAILTCPFEPPKPKTKHKVDIDTVEKFQTLRKQEQKYFDDMVQQCKDVGATLVICQWGFDDEANHLLMHRNLPAVRWVGGVELELIAIATGGRIVPRFQELTAEKLGKAGIVREKAFGTTKDRMLYIEHCANSRAVTIFIRGGNKMIIEETKRSIHDALCVARNLIRNNSIVYGGGSAEIACSIAVEAAADRYPGVEQYAIRAFGDALESIPMALAENSGLQPIETLSSVKSQQITEKNPHFGIDCNDVGTNDMREQNVFETLIGKQQQILLATQVVKMILKIDDVISPSEY

SEQ ID NO: 4922 - protein, 535 aa, Lupinus angustifolius
MALAFDEYGRPFIIIKEQDQKTRLRGLDAQKSNISAAKAVARILRTSLGPKGMDKMLSSPDGDVTISNDGATILEQMDVDNQIAKLMVELSRSQDYEIGDGTTGVVVLAGALLEQAERLLERGIHPIRVAEGYETASRISVEHLERVANKFEFGVTDLEPLIQTCMTTLSSKIVNRCKRSLAEIAVKAVLAVADLERKDVNLDLIKVEGKVGGKLEDTELIYGIVVDKDMSHPQMPKQIEDAKIAILTCPFEPPKPKTKHKIDIDTVEKFQTLRKQEEQYFDDMVKKCKDVGATLVICQWGFDDEANHLLMNRNLPAVRWVGGVELELIAIATGGRIVPRFQELTPEKLGKAGLVREKSFGTTKDRMLYIEHCANSRAVTIFIRGGNKMIVEETKRSIHDALCVARNLIRNNSIVYGGGSAEISCSIAVEAAADRYPGVEQYAVRAFADALEYIPMALAENSGLQPIETLSAVKSQQIKDNYPHFGIDCNDVGTNDMREQNVFETLIGKQQQILLATQVVKMILKIDDVISPSEY

SEQ ID NO: 4923 - protein, 535 aa, Theobroma cacao
MALAFDEFGRPFIIIKEQEQKTRLRGIEAQKANISAGKAVARILRTSLGPKGMDKMLQSPDGDVTITNDGATILEQMDVDNQIAKLMVELSRSQDYEIGDGTTGVVVMAGALLEQAERLLERGIHPIRVAEGYELASRIAVEHLEHIAQKFDFGPTNIEPLVQTCMTTLSSKIVNRCKRPLAEISVKAVLSVADLERKDVNLDLIKVEGKVGGKLEDTELIYGITVDKDMSHPQMPKQIEDAKIAILTCPFEPPKPKTKHKVDIDTVEKFQTLRLQEQKYFDDMVQKCKDVGATLVICQWGFDDEANHLLMHRNLPAVRWVGGVELELIAIATGGRIVPRFQELTPEKLGRAGLVREKSFGTTKDKMLYIEHCANSRAVTIFIRGGNKMMIEETKRSIHDALCVARNLIRNNSIVYGGGSAEISCSIAVEAAADKYPGVEQYAIRAFADALDAVPMALAENSGLQPIETLSAVKSEQIKENNPHFGIDCNDVGTNDMREQNVFETLIGKQQQILLATQVVKMILKIDDVISPSDY

SEQ ID NO: 4924 - protein, 535 aa, Capsicum annuum
MALAFDEFGRPFIILREQEQKTRLRGLDAQKANISAGKAVARILRTSLGPNGMDKMLQSPDGDVTITNDGATILEQMDVDNQIGKLMVELSRSQDYEIGDGTTGVVVMAGALLEQAEKLLERGIHPIRIAEGYEMASRIAVEHLERVAHKFEFGLNDVEPLVQTCMTTLSSKIVNRCKRSMAEIAVKAVLAVADLERKDINLDLIKVEGKVGGKLEDTELIYGIIVDKDMSHPQMPKQIEDAKIAILTCPFEPPKPKTKHKVDIDTVEKFQTLRKQEQKYFDDMVQKCKDVGATLVICQWGFDDEANHLLMHRNLPAVRWVGGVELELIAIATGGRIVPRFQELTPEKLGRAGMVREKSFGTTKDRMIYIEHCANSRAVTIFIRGGNKMMIEETKRSIHDALCVARNLIRNNSIVYGGGSAEISCSIAVEAAADKHPGVEQYAIRAFADALDSVPMALAENSGLQPIETLSAVKAQQIKENNPCCGIDCHDVGTNDMREQNVFETLIGKQQQILLATQVVKMILKIDDVITPSEY

SEQ ID NO: 4925 - protein, 535 aa, Gossypium raimondii
MALAFDEYGRPFIILKEQDQKTRLRGIDAQKANISAGKAVARILRTSLGPKGMDKILQSPDGDVTITNDGATILEQMDVDNQIAKLMVELSRSQDYEIGDGTTGVVVMAGALLEQAERLLERGIHPIRIAEGYEMASRIAVEHLEHISQKFDFGASNIEPLVQTCMTTLSSKIVNRCKRHLAEISVKAVLSVADLERKDVNLDMIKVEGKVGGKLEDTELIYGITVDKDMSHPQMPKQIEDAKIAILTCPFEPPKPKTKHKVDIDTVEKFQTLRLQEQKYFDDMVQKCKDVGATLVICQWGFDDEANHLLMHRNLPAVRWVGGVELELIAIATGGRIVPRFQELTPEKLGRAGLVREKSFGTTKDKMLYIEHCANSRAVTIFIRGGNKMMIEETKRSIHDALCVARNLIRNNSIVYGGGSAEISCSIAVEAAADKYPGVEQYAIRAFADALDSVPMALAENSGLQPIETLSAVKSQQIKDNNPHYGIDCNDVGTNDMREQDVFETLIGKQQQILLATQVVKMILKIDDVISPSDY

SEQ ID NO: 4926 - protein, 535 aa, Castanea mollissima
MALAFDEFGRPFIIIKEQEQKTRLRGLEAQKANISAGKAIARILKTSLGPKGMDKMLQSPDGDVTITNDGATILEQMDVDNQIAKLMVELSRSQDYEIGDGTTGVVVMAGALLEQAELLLERGIHPIRIAEGYEMASRIAFEHMEKIAQKFDYGVSNFEPLVQTCMTTLSSKIVNRCKRNLAEIAVKAVLAVADLERKDVNLDLIKVEGKVGGKLEDTELIYGILVDKDMSHPQMPKQIEDAKIAILTCPFEPPKPKTKHKVDIDTVEKFQNLRQQEHKYFDDMVQQCKDVGATLVICQWGFDDEANHLLMHRNLPAVRWVGGVELELIAIATGGRIVPRFQELTPEKLGKAGLVREKAFGTTKDRMLYIEHCANSRAVTIFIRGGNKMMIEETKRSIHDALCVARNLIRNNRIVYGGGSAEISCSIAVEAAADRYPGVEQYAIRAFADALDAVPMALAENSGLQPIETLSAVKSQQIKENNPYCGIDCNDVGTNDMREQNVFETLIGKQQQLLLATQVVKMILKIDDVISPSEY

SEQ ID NO: 4927 - protein, 535 aa, Vitis vinifera
MALAFDEFGRPFIILRGQEQKSRLRGLDAQKANISAGKAVARILRTSLGPKGMDKILQSPDGDVTITNDGATILEQMDVDNQIAKLMVELSRSQDYEIGDGTTGVVVLAGALLEQAEGLLERGIHPIRVAEGYEMACRIAVEHLEHIAQKFEFGVTNIEPLVQTCMTTLSSKIVNRCKRSLAEIAVKAVMAVADLERRDVNLDLIKVEGKVGGKLEDTELIHGIVVDKDMSHPQMPKHIEDAKIAILTCPFEPPKPKTKHKVDIDTVEKFQTLRLQEQKYFDDMVQKCKDVGATLVICQWGFDDEANHLLMHRNLPAVRWVGGVELELIAIATGGRIVPRFQELTPEKLGKAGLVREKSFGTTKDRMLYIERCANSRAVTIFVRGGNKMIIEETKRSIHDALCVARNIIRNNSIVYGGGSAEISCSIAVEAAADKYPGVEQYAIRAFGDALDSIPMALAENSGLQPIETLSAVKSQQIKDNNAYCGIDCNDVGTYDMREQNVFETLIGKQQQILLATQVVKMILKIDDVISPTDY

SEQ ID NO: 4928 - protein, 535 aa, Ricinus communis
MALAFDEYGRPFIILKEQEAKSRLRGLDAQKANISAGKAVARILRTSLGPKGMDKMLQSPDGDVTITNDGATILEQMDVDNQIAKLMVELSRSQDYEIGDGTTGVVVMAGSLLEQAEKLLERGIHPIRVAEGYEMASKIAVEHLEHISEKFDFGLNDIEPLVQTCMTTLSSKIVNRCKRSLAEISVKAVLAVADLERKDVNLDLIKVEGKVGGKLEDTELIYGIVVDKDMSHPQMPKHIEDAKIAILTCPFEPPKPKTKHKVDIDSVEKFQTLRKQEQQYFDDMVQKCKDAGATLVICQWGFDDEANHLLMHRNLPAVRWVGGVELELIAIATGGRIVPRFQELTPEKLGKAGMVREKSFGTTKDRMLYIEHCANSRAVTIFIRGGNKMMIEETKRSIHDSLCVARNLIRNNSIVYGGGSAEISCSIAVEAAADKYPGVEQYAIRAFADSLDAIPMALAENSGLQPIETLSAVKSQQIKENNPHCGIDCNDAGTNDMREQYVFETLIGKQQQILLATQVVKMILKIDDVISPSEY

SEQ ID NO: 4929 - protein, 535 aa, Panax ginseng
MALAFDEFGRSFIIIKEQERKSRLRGLEAQKSNISAGKAVARILRTSLGPKGMDKMLQSPDGEITITNDGATILEQMDVDNQIGKLMVELSRSQDYEIGDGTTGVVVMAGALLEQAERLLEHGIHPIRIAEGFEMASRIAVEHLERVSHKFDFDATNIEPLVQTCMTTLSSKIVNRCKRSLAEIAVKAVMAVADLGRKDVNLDLIKVEGKVGGKLEDTELIYGILVDKDMSHPQMPKQIEDAKIAILTCPFEPPKPKTKHKVDIDTVEKFQTLRQQEQKYFDDMVQKCKDVGATLVICQWGFDDEANHLLMHRNLPAVRWVGGVELELIAIATGGRIVPRFQELTPEKLGKAGLVREKSFGTTKDRMLYIEHCSNSRAVTVFIRGGNKMMIEETKRSIHDALCVARNLIRNNSIVYGGGSAEISCSIAVEAAADRCPGVEQYAIRAFADALDSVPMALAENSGLQPIETLSAVKSQQIKENNHCCGIDCNDVGTNDMREQNVFETLIGKQQQLLLATQVVKMILKIDDVISPSDY

SEQ ID NO: 4930 - protein, 535 aa, Ocimum basilicum
MALAFDEFGRPFIILREQEQKTRLRGLDAQKANIAAGQAVARILRTSLGPKGMDKILQSPDGEVTITNDGATILEQMDVDNQIAKLMVELSRSQDYEIGDGTTGVVVLAGSLLEQAQKLLERGIHPIRIAEGYELASRIATEHLERIANKFEFSSENTEPLIQTCMTTLSSKIVNRCKRNLAEIAVKAVLAVADLERKDVNLDLIKVEGKVGGKLEDTELIYGIVVDKDMSHPQMPKQIEDAKIAILTCPFEPPKPKTKHKVDIDTVEKFQTLRQQEQKYFDDMVQKCKDVGATLVICQWGFDDEANHLLMHRNLPAVRWVGGVELELIAIATGGRIVPRFQELTPEKLGNAGMVREKGFGTTKDRMIYIEHCANSRAVTIFIRGGNKMMIEETKRSLHDALCVARNLIRNNSIVYGGGSAEVACSIAVEAAADKYPGVEQYAIRGFAEALDAIPMALAENSGLQPIETLSAVKSQQIKENNSYCGIDCNDVGTNDMREQNVFETLIGKQQQILLATQVVKMILKIDDVISPSQY

SEQ ID NO: 4931 - protein, 535 aa, Panax ginseng
MALAFDEFGRSFIIIKEQERKSRLRGLEAQKSNISAGKAVARILRTSLGPKGMDKMLQSPDGEITITNDGATILEQMDVDNQIGKLMVELSRSQDYEIGDGTTGVVVMAGALLEQAERLLEHGIHPIRIAEGFEMASRIAVEHLERVSHKFDFDATNIEPLVQTCMTTLSSKIVNRCKRSLAEIAVKAVMAVADLGRKDVNLDLIKVEGKVGGKLEDTELIYGILVDKDMSHPQMPKQIEDAKIAILTCPFEPPKPKTKHKVDIDTVEKFQTLRQQEQKYFDDMVQKCKDVGATLVICQWGFDDEANHLLMHRNLPAVRWVGGVELELIAIATGGRIVPRFQELTPEKLGKAGLVREKSFGTTKDRMLYIEHCSNSRAVTVFIRGGNKMMIEETKRSIHDALCVARNLIRNNSIVYGGGSAEISCSIAVEAAADRCPGVEQYAIRAFADALDSVPMALAENSGLQPIETLSAVKSQQIKEKNHCCGIDCNDVGTNDMREQNVFETLIGKQQQLLLATQVVKMILKIDDVISPSDY

SEQ ID NO: 4932 - protein, 535 aa, Panax ginseng
MALAFDEFGRPFILIKEQEQKSRLRGLDAQKSNISAGKAVARILRTSLGPKGMDKMLQSPDGEITITNDGATILEQMDVDNQIGKLMVELSRSQDYEIGDGTTGVVVMAGALLEQAERLLEHGIHPIRIAEGFEMASRIAVEHLERVSHKFDFDATNIEPLVQTCMTTLSSKIVNRCKRSLAEIAVKAVMAVADLDRKDVNLDLIKVEGKVGGKLEDTELIYGILVDKDMSHPQMPKQIEDAKIAILTCPFEPPKPKTKHKVDIDTVEKFQTLRQQEQKYFDDMVQKCKDVGATLVICQWGFDDEANHLLMHRNLPAVRWVGGVELELIAIATGGRIVPRFQELTPEKLGKAGLVREKSFGTTKDRMLYIEHCSNSRAVTVFIRGGNKMMIEETKRSIHDALCVARNLIRNNSIVYGGGSAEISSSIAVEAAADRCPGVEQYAIRAFADALDSVPMALAENSGLQPIETLSAVKSQQIKESNHCCGIDCNDAGTNDMREQNVFETLIGKQQQLLLATQVVKMILKIDDVISPSDY

SEQ ID NO: 4933 - protein, 535 aa, Liriodendron tulipifera
MALAFDDFGRPFIIIKEQEQKSRLRGLDAQKANISAGKAVARILRTSLGPKGMDKMLQSPDGEVTITNDGATILEQMDVDNQIAKLMVELSRSQDYEIGDGTTGVVVVAGALLEQAERLLERGIHPIRIAEGYETASRIAVEHLEHISQKFDFSLSNIESLVQTCMTTLSSKIVNRCKRTLAEIAVKAVMAVADLERKDVNLDLIKVEGKVGGKLEDTELIYGIVVDKDMSHPQMPKRIEDAKIAILTCPFEPPKPKTKHKVDIDTVEKFQTLRQQEQKYFDDMVQKCKDVGATLVICQWGFDDEANHLLMHRNLPAVRWVGGVELELIAIATGGRIVPRFQELTPEKLGKAGLVREKSFGTTKDRMLYIEQCANSRAVTIFIRGGNKMIIEETKRSIHDALCVARNLIRNNSIVYGGGSAEISCSIAVETAADRYPGVEQYAIRAFADALDAIPLALAENSGLQPIDTLTAVKAQQIKESNPHCGIDCNDVGTNDMREQNVFETLIGKQQQMSLATQVVKMILKIDDVIAPSDY

SEQ ID NO: 4934 - protein, 535 aa, Gossypium raimondii
MALAFDEYGRPFIILKEQEQKTRLSGLEAQKANISAGRAVSRILRTSLGPKGMDKMLQSPDGDVTITNDGATILEQMDVDNQIAKLMVELSRSQDYEIGDGTTGVVVMAGALLEQAERLLERGIHPIRIAEGYEMASRIAVEHLERIAQKFDFGPTNIEPLVQTCMTTLSSKIVNRCKRALAEISVKAVLSVADLERKDVNLDLIKVEGKVGGKLEDTELIYGITVDKDMSHPQMPKQIEDAKIAILTCPFEPPKPKTKHKVDIDTVEKFQTLRQQEQKYFDDMVQKCKDVGATLVICQWGFDDEANHLLMHQNLPAVRWVGGVELELIAIATGGRIVPRFQELTPEKLGRAGLVREKSFGTTKDKMLYIEHCANSRAVTIFIRGGNKMMIEETKRSIHDALCVARNLIRNNFIVYGGGAAEISCSIAVEAAADKYPGVEQYAIRAFADALDAVPVALAENSGLQPIETLSAVKSQQIKENNPHFGIDCNDVGTNDMCEQNVFETLIGKQQQILLATQVVKMILKIDDVISPSDY

SEQ ID NO: 4935 - protein, 535 aa, Gossypium raimondii
MALAFDEYGRPFIILKEQEQKTRLRGIEAQKANISAGKAVARILRTSLGPKGMDKMLQSPDGDVTITNDGATILEQMDVDNQIAKLMVELSRSQDYEIGDGTTGVVVMAGALLEQAERLLERGIHPIRIAEGYEMASRIAVEHLDHIAQKFDFGPTNIEPLVQTCMTTLSSKIVNRCKRPLAEIAVKAVLSVADLERKDVNLDLIKVEGKVGGKLEDTELVYGITVDKDMSHPQMPKKIDDAKIAILTCPFEPPKPKTKHKVDIDTVEKFQTLRQQEQKYFDDMVQKCKDVGATLVICQWGFDDEANHLLMHRNLPAVRWVGGVELELIAIATGGRIVPRFQELTPEKLGRAGLVREKSFGTTKDKMLYIEHCANSRAVTIFIRGGNKMMIEETKRSIHDALCVARNLIRNNSIVYGGGSAEISCSIAVEAAADKYPGVEQYAIRAFADALDSVSIALAENSGLQPIETLSAVKSQQIKENNPHFGIDCNDVGTNDMREQNVFETLIGKQQQILLATQVVKMILKIDDVISPSDF

SEQ ID NO: 4936 - protein, 535 aa, Cocos nucifera
MALAFDEYGRPFIILKEQEQKSRLRGLEAQKANISAGKAVARILRTSLGPKGMDKMLQSRDGDVTITNDGATILEQMDVDNQIAKLMVELSRSQDYEIGDGTTGVVVMAGALLEQAEKLLERGIHPIRIAEGYEMASRIAVEHLERISQKFEFSVSNIEPLVQTCMTTLSSKIVNRCKRMLAEIAVKAVLAVADLERKDVNLDLIKIEGKVGGKLEDTELIYGITVDKEMSHPQMPKRIEDAKIAILTCPFEPPKPKTKHKVDIDTVEKFQTLRQQEQKYFDDMVKKCKDVGATLVICQWGFDDEANHLLMHRNLPAVRWVGGVELELIAIATGGRIVPRFQELTPEKLGRAGLVREKSFGTTKDWMLYIEQCANSRAVTIFIRGGNKMIIEETKRSLHDALCVARNLIRNNSIVYGGGSAEIACSIGVEAAADRYPGVEQYAIRSFAEALDSIPMALAENSGLQPIDTLTAVKSQQIKDNNPYCGIDCNDVGTNNMKEQNVFETLIGKQQQILLATQVVKMILKIDDVITPSDY

SEQ ID NO: 4937 - protein, 535 aa, Lupinus angustifolius
MALAFDEYGRPFIIIKDQDQKFRLRGLDAQKSNIAAAKAVAQILRTSLGPKGMDKILSSPDGDVTISNDGATILEQMDVDNQIAKLMVELSRSQDYEIGDGTTGVVVLAGALLEQAERLLERGIHPIRVAEGYETASRISVEHLEHVANKFEFGVADLEPLIQTCMTTLSSKIVNRCKRSLAEIAVKAVVAVADLERKDVNLDLIKVEGKVGGKLEDTELVYGVIVDKDMSHPQMPKQIEDAKIAILTCPFEPPKPKTKHKVDIDTVEKFQTLRKQEQQYFDDMVEKCKDVGATLVICQWGFDDEANHLLMHRNLPAVRWVGGVELELIAIATGGRIVPRFQELTPEKLGKAGLVREKSFGTTKDRMLYIEHCANSKAVTIFIRGGNKMIVEETKRSIHDALCVARNLIRNNSIVYGGGSAEISCSIAVEAAADKYPGVEQYAIRAFGDALEYIPMALAENSGLQPIETLSSVKSQQIKDNYPHYGIDCNDVGTNDMREQNVFETLIGKQQQILLATQVVKMILKIDDVISPSEY

SEQ ID NO: 4938 - protein, 535 aa, Daucus carota
MALAFDEYGRPFIILREQDQKSRLRGIDAQKSNISAAKAVARILRTSLGPKGMDKMLQSPDGEITITNDGATILEQMDVDNQIGKLMVELSRSQDYEIGDGTTGVVVMAGALLEQAERLLERGIHPIRIAEGFEMASKIAVEHLESVSNKFEFSASNIEPLVQTCMTTLSSKIVNRCKRDLAEIAVKAVMAVADLDRKDVNLDLIKVEGKVGGKLEDTELIYGILVDKDMSHPQMPKQIVDANIAILTCPFEPPKPKTKHKVDIDTVEKFQTLRQQEQKYFDDMVQKCKDVGATLVICQWGFDDEANHLLMHRNLPAVRWVGGVELELIAIATGGRIVPRFQELTPEKLGKAGLVREKSFGTTKDRMLYIEHCANSKAVTIFIRGGNKMMIEETKRSIHDALCVARNLIRNNSIVYGGGSAEISCSLAVEAAADKYPGVEQYAIRAFADALDSVPMALAENSGLQPIETLSAVKSQQTKDKYSWYGVDCNDVGTNDMREQNVFETLIGKQQQLLLATQVVKMILKIDDVISPSEY

SEQ ID NO: 4939 - protein, 535 aa, Ananas comosus
MALAFDEFGRPFIILKEQEQKTRLRGLDAQRANISAGRAVARILRTSLGPKGMDKMLQSPDGDVIITNDGATILEQMDVDNQIAKLMVELSRSQDYEIGDGTTGVVVMAGALLEQAEKLLERGIHPIRIAEGYEMASRIAFEHLERISQKFEFSATDIEPLVQTCMTTLSSKIVNRCKRMLAEIAVKAVLAVADLDRKDVNLDLIKVEGKVGGKLEDTELIYGIVVDKDMSHPQMPKRIENAKIAILTCPFEPPKPKTKHKVDIDTVEKFQTLRQQEQQYFDDMVQKCKDVGATLVICQWGFDDEANHLLMHRNLPAVRWVGGVELELIAIATGGRIVPRFQELTPEKLGKAGLVREKSFGTTKDRMLYIEQCANSRAVTIFIRGGNKMMIEETKRSLHDALCVARNLIRNNSIVYGGGSAEISCSIAVDAAADRYPGVEQYAIRSFAEALDSIPLALAENSGLQPINTLTAVKSQQVKENNPFCGIDCNDVGTNDMKEQNVFETLIGKQQQILLATQVVKMILKIDDVIAPSDY

SEQ ID NO: 4940 - protein, 535 aa, Centaurea maculosa
MALAFDEYGRPFIILREQESKSRLRGIDAQKANISAGVAVARILRTSLGPKGMDKMLQSPDGDITITNDGATILEQMDVDNQIGKLMVELSRSQDYEIGDGTTGVVVMAGALLEQAERLLERGIHPIRVAEGYEIASKIAVDHLQQIAHKFEFTATHIEPLVQTCMTTLSSKIVNRCKRSLAEIAVKAVMAVADLERKDVNLDLIKVEGKVGGKLEDTELIYGILVDKDMSHPQMPKQIEDAKIAILTCPFEPPKPKTKHKVDIDTVEKFQTLRQQEQKYFDDMVQQCKDVGATLVICQWGFDDEANHLLMHRNLPAVRWVGGVELELIAIATGGRIVPRFQELTPEKLGKAGLVREKAFGTTKDRMLYIEHCANSRAVTIFIRGGNKMMIEETKRSLHDALCVARNLIRNNNIVYGGGAAEISCSIAVEAAADKYPGVEQYAVRAFADALDSVPMALAENSGLQPIETLSAVKSQQIKDNNPFCGIDCNDAGTNDMREQNVFETLIGKQQQLLLATQVVKMILKIDDVISPTEY

SEQ ID NO: 4941 - protein, 535 aa, Petroselinum crispum
MALAFDEYGRPFIILREQDQKSRLRGLDAQKSNISAAKAVARILRTSLGPKGMDKMLQSPDGEITITNDGATILEQMDVDNQIGKLMVELSRSQDYEIGDGTTGVVVMAGALLEQAERLLERGIHPIRIAEGFEMASKIAVEHLEQVSNKFDFSASNIEPLVQTCMTTLSSKIVNRCKRDLAEIAVKAVMAVADLERKDVNLDLIKVEGKVGGKLEDTELIYGILVDKDMSHPQMPKQIVDANIAILTCPFEPPKPKTKHKVDIDTVEKFQTLRHQEQKYFDDMVQKCKDVGATLVICQWGFDDEANHLLMHRNLPAVRWVGGVELELIAIATGGRIVPRFQELTPEKLGKAGSVREKSFGTTKDRMLYIEHCANSKAVTIFIRGGNKMMIEETKRSIHDALCVARNLIRNNSIVYGGGSAEISCSIAVESAADKYPGVEQYAIRAFADALDSVPMALAENSGLQPIETLSAVKLQQIKENYPWCGVDCNDVGTNDMRQQNVFETLIGKQQQLLLATQVVKMILKIDDVISPSDY

SEQ ID NO: 4942 - protein, 535 aa, Sorghum bicolor
MALAFDEFGRPFIILREQEKKTRLRGLDAQKANIAAGKAVARILRTSLGPKGMDKMLQSPDGDVTITNDGATILEQMDVDNQIAKLMVELSRSQDYEIGDGTTGVVVMAGALLEQAEKLLERGIHPIRVAEGYEMASRVAFDHLERISQKFEFNADNIEPLVQTCMTTLSSKIVHRCKRALAEIAVKAVLAVADLGRKDVNLDLIKVEGKVGGKLEDTELIYGIVVDKDMSHPQMPKRIEDAKIAILTCPFEPPKPKTKHKVDIDTVEKFQTLREQEQKYFDEMVQKCKDVGATLVICQWGFDDEANHLLMHRNLPAVRWVGGVELELIAIATGGRIVPRFQELSPEKLGKAGLVREKSFGTTKDRMLYIEQCANSRAVTIFIRGGNKMMIEETKRSLHDALCVARNLIRNNSIVYGGGSAEISCSIAVETAADRHPGVEQYAIRSFADALDAVPLALAENSGLPPIDTLTVVKAQQVKDSNPHCGIDCNDVGTNDMKEQNVFETLIGKQQQILLATQVVKMILKIDDVISPSEY

SEQ ID NO: 4943 - protein, 535 aa, Setaria italica
MALAFDEFGRPFIILREQEQKTRLRGLDAQKANIAAGKAVARILRTSLGPKGMDKMLQSPDGDVTITNDGATILEQMDVDNQIAKLMVELSRSQDYEIGDGTTGVVVMAGALLEQAEKLLERGIHPIRVAEGYEMASRIASEHLERISHKYEFTADNIEPLVQTCMTTLSSKIVNRCKRALAEIAVKAVLAVADLERKDVNLDLIKVEGKVGGKLEDTELIYGIVVDKDMSHPQMPKRIEDAKIAILTCPFEPPKPKTKHKVDIDTVEKFQTLREQEQKYFDEMVQKCKDAGATLVICQWGFDDEANHLLMNRNLPAVRWVGGVELELIAIATGGRIVPRFEELSPEKLGKAGLVREKSFGTTKDRMLYIEQCANSRAVTIFIRGGNKMMIEETKRSLHDALCVARNLIRNNSIVYGGGSAEISCSIAVETAADRHPGVEQYAIRSFADALDAVPLALAENSGLPPIDTLTAVKAQQVKESNPHCGIDCNDVGTNDMKEQNVFETLIGKQQQILLATQVVKMILKIDDVISPSEY

SEQ ID NO: 4944 - protein, 535 aa, Triphysaria pusilla
MALAFDEYGRPFIILREQEQKTRLRGLDAQKSNISAGKAVARILRTSLGPKGMDKMLQSPDGDITITNDGATILEQMDVDNQIGKLMVELSRSQDYEIGDGTTGVVVLAGALLEQAERLLERGIHPIRIAEGYEVASRIAFEHLENISHKFVFGATDIEPLIQTCMTTLSSKIVNRCKRNLAEIAVKAVVAVADLERKDVNLDLIKVEGKVGGKLEDTELIYGIVVDKDMSHPQMPKQIQDAKIAILTCPFEPPKPKTKHKVDIDTVEKFQTLREQERKYFDNMVQLCKDVGATLVICQWGFDDEANHLLMNRNLPAVRWVGGVELELIAIATGGRIVPRFQELTPEKLGKAGLVREKAFGTTKDRMIYIEHCANSRAVTIFIRGGNKMMIEETKRSIYDALCVARNLIRNNSIVYGGGSAEIACSIAVEAAADKYPGVEQYAIRAFADALDAIPMALAENSGLQPIETLSAVKSQQIKENNSCCGIDCNDVGTNDMREQNVFETLIGKQQQLLLATQVVKMILKIDDVISPSEY

SEQ ID NO: 4945 - protein, 535 aa, Cocos nucifera
MALAFDEYGRPFIILKEQEQKSRLRGLEAQKANISAGKAVARILRTSLGPKGMDKMLQSRDGDVTITNDGATILEQMDVDNQIAKLMVELSRSQDYEIGDGTTGVVVMAGALLEQAEKLLERGIHPIRIAEGYEMASRIAVEHLERISQKFEFSVSNIEPLVQTCMTTLSSKIVNRCKRMLAEIAVKAVLAVADLERKDVNLDLIKIEGKVGGKLEDTELIYGITVDKEMSHPQMPKRIEDAKIAILTCPFEPPKPKTKHKVDIDTVEKFQTLREQERKYFDDMVQKCKDVGATLVICQWGFDDEANHLLMHRNLPAVRWVGGVELELIAIATGARIVPRFQELTPDKLGRAGLVREKSFGTTKDRMLYIEQCANSRAVTIFIRGGNKMMIEETKRSLHDALCVARNLIRNNSIVYGGGSAEISCSIAAEAAADKYPGVEQYAIRSFAEALDSIPMALAENSGLQPINTLTAVKSQQIKENNPYCGIDCNDVGTNNMQQQNVFETLIGKQQQILLATQVVKMILKIDDVITPSDY

SEQ ID NO: 4946 - protein, 459 aa, Triphysaria pusilla
MDVDNQIGKLMVELSRSQDYEIGDGTTGVVVMAGALLEQAEKLLERGIHPIRIAEGYEVASRIAYEHLEHISHKFVFGATDIEPLIQTCMTTLSSKIVNRCKRSLAEIAVKAVVAVADLERKDVNLDLIKVEGKVGGKLEDTELIYGIVVDKDMSHPQMPKQIQDANIAILTCPFEPPKPKTKHKVDIDTVEKFQTLREQERKYFDNMVQQCKDVGATLVICQWGFDDEANHLLMNRNLPAVRWVGGVELELIAIATGGRIVPRFQELTPEKLGKAGLVREKAFGTTKDRMIYIEHCANSRAVTIFIRGGNKMMIEETKRSIHDALCVARNLIRNNSIVYGGGSAEIACSIAVEAAADKHPGVEQYAIRAFADALDAIPMALAENSGLQPIETLSAVKSQQIKENNSCCGIDCNDVGTNDMREQNVFETLIGKQQQLLLATQVVKMILKIDDVISPSEY

SEQ ID NO: 4947 - protein, 535 aa, Carthamus tinctorius
MALAFDEYGRPFIILREQESKSRLRGLDAQKANISAGVAVARILRTSLGPKGMDKMLQSPDGDITITNDGATILEQMDVDNQIGKLMVELSRSQDYEIGDGTTGVVVMAGALLEQAERLLERGIHPIRVAEGYEIASKIAVDHLQQIAHKFEFTATHIEPLVQTCMTTLSSKIVNRCKRSLAEIAVKAVMAVADLERKDVNLDLIKVEGKVGGKLEDTELIYGILVDKDMSHPQMPKQIEDTKIAILTCPFEPPKPKTKHKVDIDTVEKFQTLRQQEQKYFDDMVQQCKDVGATLVICQWGFDDEANHLLMHRNLPAVRWVGGVELELIAIPTGGRIVPRFQELTPEKLGKAGLVREKAFGTTKDRMLYIEHCANSRAVTIFIRGGNKMMIEETKRSLHDALCVARNLIRNNNIVYGGGAAEISCSIAVEAAADKYPGVEQYAVRAFADALDSVPMALAENSGLQPIETLSAVKSQQIRDNNPFCGIDCNDAGTNDMREQNVFETLIGKQQQLLLATQVVKMILKIDDVISPAEY

SEQ ID NO: 4948 - protein, 535 aa, Amaranthus tuberculatus
MALAFDEFGRPFIILREQESKTRLRGIDAQKANISAGKAVARILRSSLGPKGMDKMLQSPDGDITITNDGATILEQMDVDNQIAKLMVELSRSQDYEIGDGTTGVVVMAGSLLEQAENLLDRGIHPIRIAEGYEVASRIAVEHLEKIAHKFEFDETDVEPLIQTCMTTLSSKIVNRCKRSLAEIAVKAVLAVADLERKDVNLDLIKVEGKVGGKLEDTELIYGIVVDKDMSHPQMPKKIEDAKIAILTCPFEPPKPKTKHKVDIDTVEKFETLRKQEQQYFDDMVQKCKDVGATLVICQWGFDDEANHLLMNRNLPAVRWVGGVELELIAIATGGRIVPRFQELTPEKLGQAGLVREKAFGTTKDRMLYIEHCANSRAVTIFIRGGNKMMIEETKRSIHDALCVARNLIRNNSIVYGGGSAEIACSLAVEAGADQYPGVEQYAIRAFAEALDAVPMALAENSGLQPIETLSAVKHQQVKENNTCCGIDCNDVGTNDMREQNVFETLIGKQQQILLATQVVKMILKIDDVITPSEF

SEQ ID NO: 4949 - protein, 535 aa, Oryza sativa
MALAFDEFGRPFIILREQEKKSRLRGLDAQKANIAAGKAVARILRTSLGPKGMDKMLQSPDGDVTITNDGATILEQMDVDNQIAKLMVELSCSQDYEIGDGTTGVVVMAGSLLEQAEKLLERGIHPIRIAEGYELASRIAFDHLEHISHKFEFSATNIEPLVQTCMTTLSSKIVNRCKRTLAEIAVKAVLAVADLERKDVNLDLIKVEGKVGGKLEDTELVYGIIVDKDMSHPQMPKRIEDAKIAILTCPFEPPKPKTKHKVDIDTVEKFQMLREQEQKYFDEMVQKCKDVGATLVICQWGFDDEANHLLMHRNLPAVRWVGGVELELIAIATGGRIVPRFQELSPEKLGKAGIVREKSFGTTKDRMLYIEQCANSRAVTIFIRGGNKMMIEETKRSLHDALCVARNLIRNNSIVYGGGSAEISCSVAVEAAADRYPGVEQYAIRSFADALDAIPLALAENSGLSPIDTLTAVKSQQVKESNPHCGIDCNDVGTNHMKEQNVFETLIGKQQQILLATQVVKMILKIDDVISPSDY

SEQ ID NO: 4950 - protein, 535 aa, Cichorium intybus
MALAFDEYGRPFIILREQESKSRLRGIDAQKANISAGTAVARILRTSLGPKGMDKMLQSPDGDITITNDGATILEQMDVDNQIGKLMVELSRSQDYEIGDGTTGVVVMAGALLEQAERLLERGIHPIRVAEGYEIASKIAVDHLQQISHKFEFNASNIEPLVQTCMTTLSSKIVNRCKRSLAEIAVKAVMAVADLERKDVNLDLIKVEGKVGGKLEDTELIYGILVDKDMSHPQMPKQIEDAKIAILTCPFEPPKPKTKHKVDIDTVEKFQTLREQEKKYFDNMVQQCKDVGATLVICQWGFDDEANHLLMHRNLPAVRWVGGVELELIAIATGGRIVPRFQELTADKLGKAGLVREKAFGTTKDRMLYIEHCANSRAVTIFIRGGNKMMIEETKRSIHDALCVARNLIRNNSIVYGGGAAEISCSIAVEAAADKYPGVEQYAVRAFADALDSVPMALAENSGLQPIETLSAVKSQQIKENNACCGIDCNDAGTNDMREQNVFETLIGKQQQLLLATQVVKMILKIDDVISPSEY

SEQ ID NO: 4951 - protein, 535 aa, Echinochloa colona
MALAFDEFGRPFIILREQEKKTRLRGLDAQKANIAAGKAVARILRTSLGPKGMDKMLQSPDGDVTITNDGATILEQMDVDNQIAKLMVELSRSQDYEIGDGTTGVVVMAGALLEQAEKLLERGIHPIRVAEGYEMASRIAFEHLEHISQKFEFSADNIEPLVQTCMTTLSSKIVNRCKRALAEIAVKAVLAVADLERKDVNLDLIKVEGKVGGKLEDTELIYGIVVDKDMSHPQMPKRIEDAKIAILTCPFEPPKPKTKHKVDIDTVEKFQTLREQEQKYFDEMVQKCKDAGATLVICQWGFDDEANHLLMHRNLPAVRWVGGVELELIAIATGGRIVPRFQELSADKLGKAGLVREKSFGTTKDRMLYIEQCANSRAVTIFIRGGNKMMIEETKRSLHDALCVARNLIRNNSIVYGGGSAEISCSIAVETAADRHPGVEQYAIRSFADALDAVPLALAENSGLPPIDTLTAVKAQQVKESNPHCGIDCNEVGTDDMKEQNVFETLIGKQQQILLATQVVKMILKIDDVISPSEY

SEQ ID NO: 4952 - protein, 535 aa, Echinochloa colona
MALAFDEFGRPFIILREQEKKTRLRGLDAQKANIAAGKAVARILRTSLGPKGMDKMLQSPDGDVTITNDGATILEQMDVDNQIAKLMVELSRSQDYEIGDGTTGVVVMAGALLEQAEKLLERGIHPIRVAEGYEMASRIAFEHLEHISQKFEFSADNIEPLVQTCMTTLSSKIVNRCKRALAEIAVKAVLAVADLERKDVNLDLIKVEGKVGGKLEDTELIYGIVVDKDMSHPQMPKRIEDAKIAILTCPFEPPKPKTKHKVDIDTVEKFQTLREQEQKYFDEMVQKCKDAGATLVICQWGFDDEANHLLMHRNLPAVRWVGGVELELIAIATGGRIVPRFQELSADKLGKAGLVREKSFGTTKDRMLYIEQCANSRAVTIFIRGGNKMMIEETKRSLHDALCVARNLIRNNSIVYGGGSAEISCSIAVETAADRHPGVEQYAIRSFADALDAVPLALAENSGLPPIDTLTAVKAQQVKESNPHCGIDCNEVGANDMKEQNVFETLIGKQQQILLATQVVKMILKIDDVISPSEY

SEQ ID NO: 4953 - protein, 535 aa, Cenchrus ciliaris
MALAFDEFGRPFIILREQEKKTRLRGLDAQKANIASGKAVARILRTSLGPKGMDKMLQSPDGDVTITNDGATILEQMDVDNQIAKLMVELSRSQDYEIGDGTTGVVVMAGALLEQAEKLLERGIHPIRVAEGYEMASRIAFDHLERISQKFEFSADNIEPLVQTCMTTLSSKIVNRCKRALAEIAVKAVLAVADLERKDVNLDLIKVEGKVGEKLEDTELIYGIVVDKDMSHPQMPKRIEDAKIAILTCPFEPPKPKTKHKVDIDTVEKFQTLREQEQKYFDEMVQKCKDAGATLVICQWGFDDEANHLLMNRNLPAVRWVGGVELELIAIATGGRIVPRFQELSPEKLGKAGLVREKSFGTTKDRMLYIEQCANSRAVTIFIRGGNKMMIEETKRSLHDALCVARNLIRNNSIVYGGGSAEISCSIAVETAADRHPGVEQYAIRSFADALDAVPLALAENSGLPPIDTLTAVKAQQVKESNAHCGIDCNDVGTNDMKEQNVFETLIGKQQQILLATQVVKMILKIDDVISPSEY

SEQ ID NO: 4954 - protein, 535 aa, Setaria italica
MALAFDEFGRPFIILREQEKKTRLRGLDAQKANIAAGKAVARILRTSLGPKGMDKMLQSPDGDVTITNDGATILEQMDVDNQIAKLMVELSRSQDYEIGDGTTGVVVMAGALLEQAEKLLERGIHPIRVAEGYEMASRIAFDHLEHISRKFEFSADNIEPLVQTCMTTLSSKIVNRCKRALAEIAVKAVLAVADLERKDVNLDLIKVEGKVGGKLEDTELIHGIVVDKDMSHPQMPKRIEDAKIAILTCPFEPPKPKTKHKVDIDTVEKFQTLREQEQKYFDEMVQKCKDAGATLVICQWGFDDEANHLLMHRNLPAVRWVGGVELELIAIATGGRIVPRFQELSPEKLGKAGLVREKSFGTTKDRMLYIEQCANSRAVTIFIRGGNKMMIEETKRSLHDALCVARNLIRNNSIVYGGGSAEISCSIAVETAADRHPGVEQYAIRSFADALDAVPLALAENSGLPPIDTLTVVKAQQVKESNPHCGIDCNDVGTNDMKEQDVFETLIGKQQQILLATQVVKMILKIDDVISPSEY

SEQ ID NO: 4955 - protein, 535 aa, Cichorium intybus
MALAFDEYGRPFIILREQESKSRLRGLDAQKANIAAGVAVSRILRTSLGPKGMDKMLQSPDGDITITNDGATILEQMDVDNQIGKLMVELSRSQDYEIGDGTTGVVVMAGALLEQAERLLERGIHPIRVAEGYEIASKIAVDHLQQISHKFEFNASNIEPLVQTCMTTLSSKIVNRCKRSLAEIAVKAVMAVADLERKDVNLDLIKVEGKVGGKLEDTELIYGILVDKDMSHPQMPKQIEDAKIAILTCPFEPPKPKTKHKVDIDTVEKFQTLREQEKKYFDNMVQQCKDVGATLVICQWGFDDEANHLLMHRNLPAVRWVGGVELELIAIATGGRIVPRFQELTADKLGKAGLVREKAFGTTKDRMLYIEHCANSRAVTIFIRGGNKMMIEETKRSIHDALCVARNLIRNNSIVYGGGAAEISCSIAVEAAADKYPGVEQYAVRAFADALDSVPMALAENSGLQPIETLSAVKSQQIKENNACCGIDCNDAGTNDMREQNVFETLIGKQQQLLLATQVVKMILKIDDVISPSEY

SEQ ID NO: 4956 - protein, 535 aa, Brassica oleracea
MALAFDEFGRPFIILREQDQKTRLRGIDAQKANIAAGKAVARILRSSLGPKGMDKMLQGPDGDVTISNDGATILEQMDVDNQIAKLMVELSRSQDYEIGDGTTGVVVMAGALLEQAERQLDRGIHPIRIAEGYETASRVAVEHLERIAQKFEFDVNNYEPLVQTCMTTLSSKIVNRCKRSLAEIAVKAVLAVADLERRDVNLDLIKVEGKVGGKLEDTELIYGILVDKDMSHPQMPKQIEDAHIAILTCPFEPPKPKTKHKVDIDTVEKFETLRKQEQQYFDEMVQKCKDVGATLVICQWGFDDEANHLLMHRNLPAVRWVGGVELELIAIATGGRIVPRFQELTPEKLGKAGMVREKSFGTTKERMLYIEHCANSKAVTIFIRGGNKMMIEETKRSIHDALCVARNLIRNKSIVYGGGAAEITCSLAVDAAADKYPGVEQYAIRAFAEALDSVPMALAENSGLQPIETLSAVKSQQIKENIPFYGIDCNDVGTNDMREQNVFETLIGKQQQILLATQVVKMILKIDDVISNSEY

SEQ ID NO: 4957 - protein, 535 aa, Brachypodium distachyon
MVLVFDEFGRRFIILREQESKSRLRGLDAHKANVAAGKAVARILRTSLGPKGMDKMLQSPDGDVTITNDGATILEQMDVDNQIAKLMVELSRSQDYEIGDGTTGVVVMAGSLLEQAEKLLERGIHPIRIAEGYEMASRIAFDHLEHISNKFEFTATNIEPLVQTCMTTLSSKIVNRCKRMLAEIAVKAVLAVADLERKDVNLDLIKVEGKVGGKLEDTELIYGIAVDKDMSHPQMPKRIEDANIAILTCPFEPPKPKTKHKVDIDTVEKFQTLREQEQKYFDEMVQKCKDVGATLVICQWGFDDEANHLLMHRNLPAVRWVGGVELELIAIATGGRIVPRFQELSPEKLGKAGLVREKSFGTTKDRMLYIEKCANSRAVTIFIRGGNKMMIEEAKRSIHDALCVARNLIRNNSIVYGGGSAEISCSIAVDAAADRYAGVEQYAIRSFADALDGIPLALAENSGLPPIDTLTAVKSQQVKEGNPHCGIDCNDVGTNDMREQNVFETLIGKQQQLLLATQVVKMILKIDDVITPSEF

SEQ ID NO: 4958 - protein, 535 aa, Zea mays
MALAFDEFGRPFIILREQEKKTRLRGLDAQKANIGAGKAVARILRTSLGPKGADKMLQSPDGDVIITNDGATILEQMDVDNQIAKLMVELSRSQDYEIGDGTTGVVVMAGALLEQAEKLLERGIHPIRVAEGYEMASKVAFDHLERISEKFEFSADNIEPLVQTCMTTLSSKIVNRCKRALAEIAVKAVLAVADLERKDVNLDLIKVEGKVGGKLEDTELVYGIIVDKDMSHPQMPKRIEDAKIAILTCPFEPPKPKTKHKVDIDTVEKFQTLREQEQKYFDEMVQKCKDAGATLVICQWGFDDEANHLLMHRNLPAVRWVGGVELELIAIATGGRIVPRFQELSPEKLGKAGLVREKSFGTTKDRMLYIEQCANSRAVTIFIRGGNKMMIEETKRSLHDALCVARNLIRNNSIVYGGGSAEISCSIAVETAADRHPGVEQYAIRSFADALDAVPLALAENSGLSPIDTLTAVKAQQVKESNPHCGIDCNDVGTNDMKEQNVFETLIGKQQQILLATQVVKMILKIDDVISPSEY

SEQ ID NO: 4959 - protein, 535 aa, Eutrema halophilum
  Sequence also found in Organisms: Eutrema parvulum
MALAFDEFGRPFIILREQDQKTRLRGIDAQKANIAAGKAVARILRSSLGPKGMDKMLQGPDGDVTITNDGATILEQMDVDNQIAKLMVELSRSQDYEIGDGTTGVVVMAGALLEQAERQLDRGIHPIRIAEGYEMASRVAVEHLERIAQKFEFDVNNFEPLVQTCMTTLSSKIVNRCKRSLAEIAVKAVLAVADLERRDVNLDLIKVEGKVGGKLEDTELIYGILVDKDMSHPQMPKQIEDAHIAILTCPFEPPKPKTKHKVDIDTVEKFETLRKQEQQYFDEMVKKCKDVGATLVICQWGFDDEANHLLMHRNLPAVRWVGGVELELIAIATGGRIVPRFQELTPEKLGKAGLVREKSFGTTKERMLYIEHCANSRAVTVFIRGGNKMMIEETKRSIHDALCVARNLIRNKSIVYGGGAAEIACSLAVDAAADKYPGVEQYAIRAFAEALDSVPMALAENSGLQPIETLSAVKSQQIKENIPFYGIDCNDVGTNDMREQNVFETLIGKQQQILLATQVVKMILKIDDVISNSEY

SEQ ID NO: 4960 - protein, 535 aa, Sorghum bicolor
MALAFDEFGRPFIILREQEKKTRLRGLDAQKANIAAGKAVARILRTSLGPKGMDKMLQSPDGDVIITNDGATILEQMDVDNQIAKLMVELSRSQDYEIGDGTTGVVVMAGALLEQAEKLLERGIHPIRVAEGYEMASRVAFDHLERISQKFEFTADNIEPLVQTCMTTLSSKIVNRCKRALAEIAVKAVLAVADLERKDVNLDLIKVEGKVGGKLEDTELVYGIIVDKDMSHPQMPKRIEDAKIAILTCPFEPPKPKTKHKVDIDTVEKFQTLREQEQKYFDEMVQKCKDAGATLVICQWGFDDEANHLLMHRNLPAVRWVGGVELELIAIATGGRIVPRFQELSPEKLGKAGLVREKAFGTTKDRMLYIEQCANSRAVTIFIRGGNKMMIEETKRSLHDALCVARNLIRNNSIVYGGGSAEISCSIAVETAADRHPGVEQYAIRSFADALDAVPLALAENSGLSRIDTLTAVKAQQVKESNPHCGIDCNDVGTNDMKEQNVFETLIGKQQQILLATQVVKMILKIDDVISPSEY

SEQ ID NO: 4961 - protein, 535 aa, Raphanus sativus
MALAFDEFGRPFIILREQDQKTRLRGIDAQKANIAAGKAVARILRSSLGPKGMDKMLQGPDGDVTISNDGATILEQMDVDNQIAKLMVELSRSQDYEIGDGTTGVVVMAGALLEQAERQLDRGIHPIRIAEGYEMASRVAVEHLERIAQKFEFDVDNYEPLVQTCMTTLSSKIVNRCKRSLAEIAVKAVLAVADLERRDVNLDLIKVEGKVGGNLADTELIYGILVDKDMSHPQMPKQIEDAHIAILTCPFEPPKPKTKHKVDIDTVEKFETLRKQEQQYFDEMVQKCKDVGATLVICHWGFDDEANHLLMHRNLPAVRWVGGVELELIAIATGGRIVPRFQELTPEKLGKAGMVREKSFGTTKERMLYIEHCANSKAVTIFIRGGNKMMIEETKRSIHDALCVARNLIRNNSIVYGGGAAEITCSLAVDAAADKYPGVEQYAIRAFAEALDSVPMALAENSGLQPIETLSAVKSQQIKENIPFYGIDCNDVGTNDMREQNVFETLIGKQQQILLATQVVKMILKIDDVISNSEY

SEQ ID NO: 4962 - protein, 535 aa, Brassica oleracea
MALAFDEFGRPFIILREQDQKTRLRGIDAQKANIAAGKAVARILRSSLGPKGMDKMLQGPDGDVTITNDGATILEQMDVDNQIAKLMVELSRSQDYEIGDGTTGVVVMAGALLEQAERQLDRGIHPIRIAEGYEMASRVAVEHLERISQKFEFDVNNYEPLVQTCMTTLSSKIVNRCKRRLAEIAVKAVLAVADLERRDVNLDLIKVEGKVGGNLEDTELIYGILVDKDMSHPQMPKQIEDAHIAILTCPFEPPKPKTKHKVDIDTVEKFETLRKQEQQYFDEMVQKCKDVGATLVICQWGFDDEANHLLMHRNLPAVRWVGGVELELIAIATGGRIVPRFQELTPEKLGKAGMVREKSFGTTKERMLYIEHCANSKAVTIFIRGGNKMMIEETKRSIHDALCVARNLIRNKSIVYGGGAAEIACSLAVDAAADKYPGVEQYAIRAFAEALDSVPMALAENSGLQPIETLSAVKSQQLKENIPFYGIDCNDVGTNDMREQNVFETLIGKQQQILLATQVVKMILKIDDVISNSEY

SEQ ID NO: 4963 - protein, 535 aa, Musa acuminata
MALAFDEYGRPFIIIKEQGQKARLRGLEAQKANISAGKAVARILRTSLGPKGMDKMLQSPDGDVVITNDGATILEQMDVDNQIAKLMVELSRSQDYEIGDGTTGVVVLAGALLEQAEKLLERGIHPIRISEGYEMASKLSVEHLESISQKFEFSVTNIEPLVQTCMTTLSSKIVNRCKRALAEIAVKAVLAVADLERKDVNLELIKVEGKVGGKLEDTELIYGILVDKDMSHPQMPKRIEDANIAILTCPFEPPKPKTKHKIDIDTVEKFQTLRQQEQNYFDDMVQKCKDVGATLVICQWGFDDEANHLLMHRNLPAVRWVGGVELELIAIATGGRIVPRFQELTTEKLGKAGLVREKSFGTTKDRMLYIEHCANSRAVTIFIRGGNKMMIEETKRSLHDALCVARNLIRNNSIVYGGGSAEISCSIAVEAAADRYPGVEQYAIRSFAEALDSIPMALAENSGLPPIDTLTAVKSQQIKESNPYCGIDCNDVGTNNMREQNVFETLIGKQQQILLATQVVKMILKIDDVITPAEY

SEQ ID NO: 4964 - protein, 535 aa, Arabidopsis thaliana
MALAFDEFGRPFIILREQDQKTRLRGIDAQKANIAAGKAVARILRSSLGPKGMDKMLQGPDGDITITNDGATILEQMDVDNQIAKLMVELSRSQDYEIGDGTTGVVVMAGALLEQAERQLDRGIHPIRIAEGYEMASRVAVEHLERIAQKFEFDVNNYEPLVQTCMTTLSSKIVNRCKRSLAEIAVKAVLAVADLERRDVNLDLIKVEGKVGGKLEDTELIYGILIDKDMSHPQMPKQIEDAHIAILTCPFEPPKPKTKHKVDIDTVEKFETLRKQEQQYFDEMVQKCKDVGATLVICQWGFDDEANHLLMHRNLPAVRWVGGVELELIAIATGGRIVPRFQELTPEKLGKAGVVREKSFGTTKERMLYIEHCANSKAVTVFIRGGNKMMIEETKRSIHDALCVARNLIRNKSIVYGGGAAEIACSLAVDAAADKYPGVEQYAIRAFAEALDSVPMALAENSGLQPIETLSAVKSQQIKENIPFYGIDCNDVGTNDMREQNVFETLIGKQQQILLATQVVKMILKIDDVISNSEY

SEQ ID NO: 4965 - protein, 535 aa, Brassica oleracea
MALAFDEFGRPFIILREQDQKTRLRGIDAQKANIAAGKAVARILRSSLGPKGMDKMLQGPDGDVTITNDGATILEQMDVDNQIAKLMVELSRSQDYEIGDGTTGVVVMAGALLEQAERQLDRGIHPIRVAEGYEMASRVAVEHLERISQKFEFDVNNFEPLVQTCMTTLSSKIVNRCKRSLAEIAVKAVLAVADLERRDVNLDLIKIEGKVGGNLEDTELIYGILVDKDMSHPQMPKQIEDAHIAILTCPFEPPKPKTKHKVDIDTVEKFETLRKQEQQYFDEMVQKCKDVGATLVICQWGFDDEANHLLMHRNLPAVRWVGGVELELIAIATGGRIVPRFQELTPEKLGKAGMVREKSFGTTKERMLYIEHCANSKAVTIFIRGGNKMMIEETKRSIHDALCVARNLIRNKSIVYGGGAAEIACSLAVDAAADKYPGVEQYAIRAFAEALDSVPMALAENSGLQPIETLSAVKSQQLKENIPFYGIDCNDVGTNDMREQNVFETLIGKQQQILLATQVVKMILKIDDVISNSEY

SEQ ID NO: 4966 - protein, 535 aa, Cichorium intybus
MALAFDEYGRPFIILREQESKSRLRGLDAQKANIAAGVAVSRILRTSLGPKGMDKMLQSPDGDITITNDGATILEQMDVDNQIGKLMVELSRSQDYEIGDGTTGVVVLAGALLEQAEKLLERGIHPIRVAEGFEISSRIAVDHLEQISHKFDFNATNIEPLVQTCMTTLSSKIVNRCKRSLAEIAVKAVMAVADLERKDVNLDLIKVEGKVGGKLEDTELIYGIIVDKDMSHPQMPKQIEDAKIAILTCPFEPPKPKTKHKVDIDTVEKFQTLRKQEQKYFDDMVQRCKDVGATLVICQWGFDDEANHLLMHRNLPAVRWVGGVELELIAIATGGRIVPRFQELTTEKLGKAGLVREKSFGTTKDRMLYIEHCANSRAVTVFIRGGNKMMIEETKRSIHDALCVARNLIRNNSIVYGGGAAEISCSIAVEAAADKYPGVEQYAIRAFADALDSVPMALAENSGLSCIETLSAVKAQQIKENNHCCGIDCNDTGTNDMREQNVFETLIGKQQQILLATQVVKMILKIDDVISPSEY

SEQ ID NO: 4967 - protein, 535 aa, Zea mays
MALAFDEFGRPFIILREQEKKTRLRGLDAQKANIASAKAVARILRTSLGPKGMDKMLQSPDGDVIITNDGATILEQMDVDNQIAKLMVELSRSQDYEIGDGTTGVVVMAGALLEQAEKLLERGIHPIRVAEGYEMASKVAFDHLEHISEKFEFSADNIEPLVQTCMTTLSSKIVNRCKRALAEIAVKAVLAVADLERKDVNLDLIKVEGKVGGKLEDTELVYGIIVDKDMSHPQMPKRIEDAKIAILTCPFEPPKPKTKHKVDIDTVEKFQTLREQEQKYFDEMVQKCKDAGATLVICQWGFDDEANHLLMHRNLPAVRWVGGVELELIAIATGGRIVPRFQELSPEKLGKAGLVREKSFGTTKDRMLYIEKCANSRAVTIFIRGGNKMMIEETKRSLHDALCVARNLIRNNSIVYGGGSAEISCSIAVETAADRHPGVEQYAIRSFADALDAVPLALAENSGLSPIDTLTAVKAQQVKESNPHCGIDCNDVGTTDMKEQNVFETLIGKQQQILLATQVVKMILKIDDVISPSEY

SEQ ID NO: 4968 - protein, 535 aa, Chrysanthemum coronarium
MALAFDEYGRPFIILREQESKSRLRGIDAQKANIAAGVAVSRILRTSLGPKGMDKMLQSPDGDITITNDGATILEQMDVDNQIGKLMVELSRSQDYEIGDGTTGVVVMAGALLEQAEKLLERGIHPIRVAEGFEISSRIAVDHLESIADKFDFSATNIEPLVQTCSTTLNSKIVNRCKRSLAEIAVKAVMAVADLERRDVNLDLIKVEGKVGGKLEDTELIYGILVDKDMSHPQMPKQIQDAHIAILTCPFEPPKPKTKHKVDIDTVEKFQTLRKQEQQYFDEMVQKCKDVGATLVICQWGFDDEANHLLMHRNLPAVRWVGGVELELIAIATGGRIVPRFQELTPEKLGKAGLVREKAFGTTKDRMLYIEHCANSRAVTIFIRGGNKMMIEETKRSIHDALCVARNLIRNNSIVYGGGAAEISCSIAVEAAADKYPGVEQYAIRAFADALDAVPMALAENSGLSPIETLSAVKAQQIKDNNHCCGIDCNDTGTNDMREQNVFETLIGKQQQILLATQVVKMILKIDDVISPSEY

SEQ ID NO: 4969 - protein, 535 aa, Chrysanthemum coronarium
MALAFDEYGRPFIILREQESKSRLRGIDAQKANIAAGVAVSRILRTSLGPKGMDKMLQSPDGDITITNDGATILEQMDVDNQIGKLMVELSRSQDYEIGDGTTGVVVMAGALLEQAEKLLERGIHPIRVAEGFEISSRIAVDHLESIADKFDFSATNIEPLVQTCSTTLNSKIVNRCKRSLAEIAVKAVMAVADLERRDVNLDLIKVEGKVGGKLEDTELIYGILVDKDMSHPQMPKQIQDAHIAILTCPFEPPKPKTKHKVDIDTVEKFQTLRKQEQQYFDEMVQKCKDVGATLVICQWGFDDEANHLLMHRNLPAVRWVGGVELELIAIATGGRIVPRFQELTPEKLGKAGLVREKAFGTTKDRMLYIEHCANSRAVTIFIRGGNKMMIEETKRSIHDALCVARNLIRNNSIVYGGGAAEISCSIAVEAAADKYPGVEQYAIRAFADALDAVPMALAENSGLSPIETLSAVKAQQIKENNHCCGIDCNDTGTNDMREQNVFETLIGKQQQILLATQVVKMILKIDDVISPSEY

SEQ ID NO: 4970 - protein, 535 aa, Echinacea purpurea
MALAFDEYGRPFIILREQENKTRLRGIDAQKANIAAGVAVSRILRTSLGPKGMDKMLQSPDGDITITNDGATILEQMDVDNQIGKLMVELSRSQDYEIGDGTTGVVVLAGALLEQAEKLLERGIHPIRVAEGFEISSKMAVDHLEQISHKYDFSATNLESLVQTCMTTLSSKIVNRCKRSLAEIAVKSVLAVADLERKDVNLDLIKVEGKVGGKLEDTELIYGILVDKDMSHPQMPKQIEDAKIAILTCPFEPPKPKTKHKVDIDTVEKFQTLRKQEQKYFDDMVQKCKDVGATLVICQWGFDDEANHLLMNRNLPAVRWVGGVELELIAIATGGRIVPRFQELTPEKLGKAGLVREKAFGTTKDRMLYIEHCANSKAVTIFIRGGNKMVIEETKRSVHDALCVARNLIRNNSIVYGGGAAEISCSIAVEAAADKYPGVEQYAIRAFADALDSVPMALAENSGLQPIETLSAVKAQQIKENNHFCGIDCNDTGTNDMREQNVFETLIGKQQQILLATQVVKMILKIDDVISPSDY

SEQ ID NO: 4971 - protein, 535 aa, Chrysanthemum coronarium
MALAFDEYGRPFIILREQESKSRLRGIDAQKANIAAGVAVSRILRTSLGPKGMDKMLQSPDGDITITNDGATILEQMDVENQIGKLMVELSRSQDYEIGDGTTGVVVMAGALLEQAEKLLERGIHPIRVAEGFEISSKIAVEHLESIADKFEFGATNIEPLVQTCSTTLNSKIVNRCKRSLAEIAVKGVMAVADLERRDVNLDLIKVEGKVGGKLEDTELIYGILVDKDMSHPQMPKQIQDAHIAILTCPFEPPKPKTKHKVDIDTVEKFQTLRKQEQQYFDEMVQKCKDVGATLVICQWGFDDEANHLLMHRNLPAVRWVGGVELELIAIATGGRIVPRFQELTPEKLGKAGLVREKAFGTTKDRMLYIEHCANSRAVTIFIRGGNKMMIEETKRSIHDALCVARNLIRNNSIVYGGGAAEISCSIAVEAAADKYPGVEQYAIRAFADALDAVPMALAENSGLSPIETLSAVKAQQIKENNHCCGIDCNDTGTNDMREQNVFETLIGKQQQILLATQVVKMILKIDDVISPSEY

SEQ ID NO: 4972 - protein, 535 aa, Brachypodium distachyon
MALAFDEFGRPFIILREQEKKSRLQGLDAQKANIAAGKSVARILRTSLGPKGMDKMLQSPDGDVTITNDGATILELMDVDNQIAKLMVELSRSQDYDIGDGTTGVVVMAGSLLEQAEKLLERGIHPIRVAEGYEMASRIAFDHLERISTKFEFSATDIEPLVQTCMTTLSSKIVSRCKRALAEIAVKAVLAVADLERKDVNLDLIKVEGKVGGKLEDTELVHGIIVDKDMSHPQMPKRIEDAHIAILTCPFEPPKPKTKHKVDIDTVEKFQTLRGQEQKYFDEMVQKCKDVGATLVICQWGFDDEANHLLMHRNLPAVRWVGGVELELIAIATGGRIVPRFQELSTEKLGKAGLVREKSFGTTKDRMLYIEKCANSRAVTIFIRGGNKMMIEETKRSLHDALCVARNLIINNSIVYGGGSAEISCSIAVEAAADRHAGVEQYAIRSFADALDAIPLALAENSGLPPIDTLTVVKSQHVKESNPHCGIDCNDVGTNDMKEQNVFETLIGKQQQILLATQVVKMILKIDDVITPSEY

SEQ ID NO: 4973 - protein, 535 aa, Musa acuminata
MALAFDEYGRPFIIIKEQGQKARLRGLEAQKANISAGKAVARILRTSLGPKGMDKMLQSPDGDVIVTNDGATILEQMDVDNQIGKLMVELSRSQDYEIGDGTTGVVVLAGALLEQAEKLLERGIHPIRIAEGYEMASRLAVDHLEHISQKFEFSVTNIEPLVQTCMTTLSSKIVNRCKRALAEIAVKAVLAVADLERKDVNLELIKVEGKVGGKLEDTELIYGIVVDKDMSHPQMPKRIEEAKIAILTCPFEPPKPKTKHKIDIDTVEKFQTLREQEQKYFDDMVQKCKDVGATLVICQWGFDDEANHLLMHRNLPAVRWVGGVELELIAIATGGRIVPRFQDLTDEKLGKAGLVREKSFGTTKDRMLYIEHCANSRAVTIFIRGGNKMMIDETKRSLHDALCVARNLIRSNSIVYGGGSAELSCSIAVEAAADKYPGVEQYAIRSFAEALDFIPMALAENCGLPPIDTVTAVKSQQIKENNPYCGIDCNDVGTNNMMEQNVFETLIGKQQQILLATQVVKMILKIDDVITPSAY

SEQ ID NO: 4974 - protein, 535 aa, Echinacea purpurea
MALAFDEYGRPFIILREQENKTRLRGIDAQKANIAAGVAVSRILRTSLGPKGMDKMLQSPDGDITITNDGATILEQMDVDNQIGKLMVELSRSQDYEIGDGTTGVVVLAGALLEQAEKLLERGIHPIRVAEGFEISSKMAVDHLEQISHKYDFSATNLESLVQTCMTTLSSKIVNRCKRSLAEIAVKSVLAVADLERKDVNLDLIKVEGKVGGKLEDTELIYGILVDKDMSHPQMPKQIEDAKIAILTCPFEPPKPKTKHKVDIDTVEKFQTLRKQEQKYFDDMVQKCKDVGATLVICQWGFDDEANHLLMNRNLPAVRWVGGVELELIAIATGGRIVPRFQELTPEKLGKAGLVREKAFGTTKDRMLYIEHCANSKAVTIFIRGGNKMVIEETKRSVHDALCVARNLIRNNSIVYGGGAAEISCSIAVEAAADKYPGVEQYAIRAFADALDSVPMALAENSGLQPIETLSAVKAQQIKENNHCCGIDCNDTGTNDMREQNVFETLIGKQQQILLATQVVKMILKIDDVISPSDY

SEQ ID NO: 4975 - protein, 530 aa, Chenopodium quinoa
DEFGRPFIILREQESKTRLRGLEAQKSNISAGKAVARILRSSLGPKGMDKMLQSPDGDITITNDGATILDQMDVDNPIAKLMVELSRSQDYEIGDGTTGVVVMAGALLEQAENLLDRGIHPIRIAEGYEVASRIAVEHLEKIAHKFEFGETDVEPLIQTCMTTLSSKIVNRCKRSLAEIAVKAVLAVADLERKDVNLDLIKVEGKVGGKLEDTELIYGIVVDKDMSHPQMPKKIEDANIAILTCPFEPPKPKTKHKVEIDTVEKFETLRKQEQHYFDEMVQKCKDVGATLVICQWGFDDEANHLLMHRNLPAVRWVGGVELELIAIATGGRIVPRFQELTPEKLGRAGLVREKAFGTTKDRMLYIEHCANSKAVTIFIRGGNKMMIEETKRSIHDALCVARNLIRNNSIVYGGGSAEIACSLAVEAGADRFPGVEQYAIRAFAESLDAVPMALAENSGLQPIETLSAVKHQQIKENITHLGIDCNDVGTNDMREQYVFETLIGKQQQILLATQVVKMILKIDDVITPSEF

SEQ ID NO: 4976 - protein, 537 aa, Chrysanthemum coronarium
MALAFDEYGRPFIILREQESKSRLRGIDAQKANIAAGVAVSRILRTSLGPKGMDKMLQSPDGDITITNDGATILEQMDVDNQIGKLMVELSRSQDYENGDGTTGVVVMAGALLEQAEKLLERGIHPIRVAEGFEISSRIAVDHLESIADKFDFSATNIEPLVQTCSTTLNSKIVNRCKRSLAEIAVKAVMAVADLERRDVNLDLIKVEGKVGGKLEDTELIYGILVDKDMSHPQMPKQIQDAHIAILTCPFEPPKPKTKHKVDIDTVEKFQTLRKQEQQYFDEMVQKCKDVGATLVICQWGFDDEANHLLMHRNLPAVRWVGGVELELIAIATGGRIVPRFQELTPEKLGKAGLVREKAFGTTKDRMLYIEHCANSRAVTIFIRGGNKMMIEETKRSIHDALCVARNLIRNNSIVYGGGAAEISCSIAVEAAADKYPGVEQYAIRAFADALDAVPMALAENSGLSSIETLSAVKAQQIKDNNHCCGIDCNDTGTNDMREQNVFETLIGKQQQILLATQVVKMILKIDDVISPSEYCY

SEQ ID NO: 4977 - protein, 535 aa, Allium cepa
MALAFDEYGRPFLIMKEQDQKTRLRGLEAQKSNISAGVAVARILRTSLGPKGMDKMLQSPDGDVVITNDGATILEQMDVDNQIAKLMVELSRSQDYEIGDGTTGVVVLAGSLLEQAEKLLERGIHPIRIAEGYETASRIAVDHLEHISQKFEFSISDIEPLVQTCMTTLSSKIVNRCKRTLAEIAVKAVLAVADLDRKDVNLDLIKVEGKVGGKLEDTELVYGIIIDKDMSHPQMPKHIEDAKIAILTCPFEPPKPKTKHKVDIDTVEKFQTLRKQEQQYFDDMVQKCKDVGATLVICQWGFDDEANHLLMHRNLPAVRWVGGVELELIAIATGGRIVPRFQELTPEKLGKAGLVREKAFGTTKDRMLYIEQCANSRAVTIFIRGGNKMVIEETKRSVHDALCVARNLIRNNSIVYGGGSAEISCSIAVEAAADKNPGVEQYAIRSFADALDAVPMALAENSGLQPIDTLTAVKAQQIKENNAYLGIDCNDVGTNNMQEQNVFETLIGKQQQILLATQVVKMILKIDDVITPNDY

SEQ ID NO: 4978 - protein, 535 aa, Allium cepa
MALAFDEYGRPFLIMKEQDQKTRLRGLEAQKSNISAGVAVARILRTSLGPKGMDKMLQSPDGDVVITNDGATILEQMDVDNQIAKLMVELSRSQDYEIGDGTTGVVVLAGSLLEQAEKLLERGIHPIRIAEGYETASRIAVDHLEHISQKFEFSISDIEPLVQTCMTTLSSKIVNRCKRTLAEIAVKAVLAVADLDRKDVNLDLIKVEGKVGGKLEDTELVYGIIIDKDMSHPQMPKHIEDAKIAILTCPFEPPKPKTKHKVDIDTVEKFQTLRQQEHKYFDDMVQKCKDVGATLVICQWGFDDEANHLLMHRNLPAVRWVGGVELELIAIATGGRIVPRFQELTPEKLGKAGLVREKAFGTTKDRMLYIEQCANSRAVTIFIRGGNKMVIEETKRSVHDALCVARNLIRNNSIVYGGGSAEISCSIAVEAAADKNPGVEQYAIRSFADALDAVPMALAENSGLQPIDTLTAVKAQQIKENNAYLGIDCNDVGTNNMQEQNVFETLIGKQQQILLATQVVKMILKIDDVITPNDY

SEQ ID NO: 4979 - protein, 535 aa, Festuca arundinacea
MALAFDEFGRPFIILREQETKSRLRGLDAHKANVAAGKAVARILRTSLGPKGMDKILQSPDGDVTITNDGATILEQMDVDNQIAKLMVELSRSQDYESGDGTTGVVVLAGSLLEQAEKLLERGIHPIRIAEGYEMASKIAFDHLERISKKFEFTAANIEPLVQTCMTTLSSKIVNRCKRMLAEIAVKAVLAVADLERKDVNLDLIKVEGKVGGKLEDTELIYGIAVDKDMSHPQMPKRIEDVNIAILTCPFEPPKPKTKHKVDIDTVEKFQTLRGQEQKYFDEMVQKCKDVGATLVICQWGFDDEANHLLMQRNLPAVRWVGGVELELIAIATGGRIVPRFQELTRDKLGKAGLVREKSFGTTKDRMLYIEKCANSRAVTIFIRGGNKMMIVEAKRSIHDALCVARNLIRNNSIVYGGGSAEISCSIAVEAAADRYAGVEQYAIRSFADALDGIPLALAENSGLSPIDTLTAVKSQQVKENNPHCGIDCNDIGTNDMREQDVFETLIGKQQQILLATQVVKMILKIDDVITPSEF

SEQ ID NO: 4980 - protein, 527 aa, Cichorium intybus
GRPFIILREQESKSRLRGLDAQKANIAAGVAVSRILRTSLGPKGMDKMLQSPDGDITITNDGATILEQMDVDNQIGKLMVELSRSQDYEIGDGTTGVVVLAGALLEQAEKLLERGIHPIRVAEGFEISSRIAVDHLEQISHKFDFNATNIEPLVQTCMTTLSSKIVNRCKRSLAEIAVKAVMAVADLERKDVNLDLIKVEGKVGGKLEDTELIYGIIVDKDMSHPQMPKQIEDAKIAILTCPFEPPKPKTKHKVDIDTVEKFQTLRKQEQKYFDDMVQRCKDVGATLVICQWGFDDEANHLLMHRNLPAVRWVGGVELELIAIATGGRIVPRFQELTTEKLGKAGLVREKSFGTTKDRMLYIEHCANSRAVTVFIRGGNKMMIEETKRSIHDALCVARNLISNNSIVYGGGAAEISCSIAVEAAADKYPGVEQYAIRAFADALDSVPMALAENSGLSCIETLSAVKAQQIKENNHCCGIDCNDTGTNDMREQNVFETLIGKQQQILLATQVVKMILKIDDVISPSEY

SEQ ID NO: 4981 - protein, 535 aa, Avena sativa
MALAFDEYGRPFIILREQEKKSRLQGLDAQKANIAAGKSVARILRTSLGPKGMDKMLQSPDGDVTITNDGATILELMDVDNQIAKLMVELSRSQDYDIGDGTTGVVVMAGSLLEQAEKLLERGIHPIRVAEGYEMASRIAVDHLESISTKYEFSATDIEPLVQTCMTTLSSKIVSRCKRALAEIAVKAVLAVADLERKDVNLDLIKVEGKVGGKLEDTELVQGIIVDKDMSHPQMPKRIEDAHIAILTCPFEPPKPKTKHKVDIDTVEKFQTLRGQEQKYFDEMVQKCKDVGATLVICQWGFDDEANHLLMQRELPAVRWVGGVELELIAIATGGRIVPRFQELSTEKLGKAGLVREKSFGTTKDRMLYIEKCANSKAVTIFIRGGNKMMIEETKRSIHDALCVARNLIINNSIVYGGGSAEISCSIAVEAAADRHPGVEQYAIRAFADALDAIPLALAENSGLPPIDTLTVVKSQHVKENNSRCGIDCNDVGTNDMKEQNVFETLIGKQQQILLATQVVKMILKIDDVITPSEY

SEQ ID NO: 4982 - protein, 505 aa, Vicia sativa
MALAFDEFGRPFIILREQETKNRLRGLDAQKANISAGKAVARILRTSLGPKGMDKMLQSPDGDVIISNDGATILEQMDVDNQIAKLMVELSRSQDYEIGDGTTGVVVLAGSLLEQAERLLERGIHPIRIAEGYEMASRIAVENLERIANKFEFGETILEPLIQTCMTTLSSKIVNRCKRSLAEIAVKAVLAVADLERKDVNLDLIKVEGKVGGKLEDTELVYGIIVDKDMSHPQMPKQIVDANIAILTCPFEPPKPKTKHKVDIDTVEKFQTLRKQEQQYFDDMVKQCKDVGATLVICQWGFDDEANHLLMHRNLPAVRWVGGVELELIAIATGGRIVPRFQELTAEKLGKAGIVREKAFGTTKDRMLYIEHCANSRAVTIFIRGGNKMIIEETKRSIHDALCVARNLIRNNSIVYGGGSAEIACSIAVEAAADKYPGVEQYAIRAFGDALESIPMALAENSGLQPIETLSAVKSQQIKDNNPHFGIDCNDVGTNDMREQNVFET

SEQ ID NO: 4983 - protein, 536 aa, Festuca arundinacea
  Sequence also found in Organisms: Lolium multiflorum
MALAFDEYGRPFIILREQEKKSRLQGLDAQKANIAAGKSVARILRTSLGPKGMDKMLQSPDGDVTITNDGATILELMDVDNQIAKLMVELSRSQDYDIGDGTTGVVVMAGSLLEQAEKLLERGIHPIRVAEGYEMASRIAVDHLESISTKYEFSATDIEPLVQTCMTTLSSKIVSRCKRALAEIAVKAVLAVADLERKDVNLDLIKVEGKVGGKLEDTELVQGIIVDKDMSHPQMPKRIEDAHIAILTCPFEPPKPKTKHKVDIDTVEKFQTLRGQEQKYFDDMVQKCKDVGATLVICQWGFDDEANHLLMQRDLPAVRWVGGVELELIAIATGGRIVPRFQELSTEKLGKAGLVREKSFGTTKDRMLYIEKCANSKAVTIFIRGGNKMMIEETKRSIHDALCVARNLIINNSIVYGGGSAEISCSIAVEAAADRHPGVEQYAIRAFADALDAIPLALAENSGLPPIDTLTVVKSQHVKENNSRCGIDCNDVGTNDMKEQNVFETLIGKQQQILLATQVVKMILKIDDVITPSEYC

SEQ ID NO: 4984 - protein, 536 aa, Chenopodium quinoa
MSFAAFDESGRRFIILREQEQKARLSGLEAVKTNVTAGKAVSRILRTSLGPKGMDKMLQSPDGDIAITNDGATILDQMDVDNPIAKLMVELSRSQDYEIGDGTTGVVVMAGALLEQAENLLDRGIHPIRIAEGYEVASRIAVEHLEKIAHKFEFGETDVEPLIQTCMTTLSSKIVNRCKRSLAEIAVKAVLAVADLERKDVNLDLIKVEGKVGGKLEDTELIYGIVVDKDMSHPQMPKKIEDANIAILTCPFEPPKPKTKHKVEIDTVEKFETLRKQEQHYFDEMVQKCKDVGATLVICQWGFDDEANHLLMHRNLPAVRWVGGVELELIAIATGGRIVPRFQELTPEKLGRAGLVREKAFGTTKDRMLYIEHCANSKAVTIFIRGGNKMMIEETKRSIHDALCVARNLIRNNSIVYGGGSAEIACSLAVEAGADRFPGVEQYAIRAFAESLDAVPMALAENSGLQPIETLSAVKHQQIKENITHLGIDCNDVGTNDMREQYVFETLIGKQQQILLATQVVKMILKIDDVITPSEF

SEQ ID NO: 4985 - protein, 112 aa, Allium cepa
MALASDEYGRPFLIMKEQDQKTRLRGLEAQKSNISAGVAVARILRTSLGPKGMDKMLQSPDGDVVITNDGATILEQMDVDNQIAKLMVELSRSQDYEIGDGTTGVVVLAGSF

SEQ ID NO: 4986 - protein, 459 aa, Centaurea maculosa
MDVDNQIGKPMVELSQSQDYEIGDGTTSIVVMAGALLEQAERLLERGIHPIRVAEGFEISSRIAVDHLEQISHKFEFTATNIEPLVQTCMTTLSSKIVNRCKRSLAEIAVKGVMAVADLERKDVNLDLIKVEGKVGGKLEDTELIYGIIVDKDMSHPQMPKQIEDAKIAILTCPFEPPKPKTKHKVDIDTVEKFQTLREQEKKYFDEMVQRCKDVGATLVICQWGFDDEANHLLMHRNLPAVRWVGGVELELIAIATGGRIVPRFQELTPEKLGKAGLVREKAFGTTKDRMLYIEHCANSRAVTVFIRGGNKMMIEETKRSIHDALCVARNLIRNNSIVYGGGAAEISCSIAVEAAADKYPGVEQYAIRAFADALDSVPMALAENSGLQPIETLSAVKAQQIKENNPCCGIDCNDAGTNDMREQNVFETLIGKQQQILLATQVVKMILKIDDVISPSDY

SEQ ID NO: 4987 - protein, 535 aa, Allium cepa
MALAFDEYGRPFLIMKEQDQKTRLRGLEAQKSNISAGVAVARILRTSLGPKGMDKMLQSPDGDVVITNDGATILEQMDVDNQIAKLMVELSRSQDYEIGDGTTGVVVLAGSLLEQAEKLLERGIHPIRIAEGYETASRIAVDHLEHISQKFEFSISDIEPLVQTCMTTLSSKIVNRCKRTLAEIAVKAVLAVADLDRKDVNLDLIKVEGKVGGKLEDTELVYGIIIDKDMSHPQMPKHIEDAKIAILTCPFEPPKPKTKHKVDIDTVEKFQTLRQQEHKYFDDMVQKCKDVGATLVICQWGFDDEANHLLMHRNLPAVRWVGGVELELIAIATGGRIVPRFQELTPEKLGKAGLVREKAFGTTKDRMLYIEQCANSRAVTIFIRGGNKMMIEETKRSVHDALCVARNLIRNNSIVYGGGSAEISCSIAVEAAADKHPGVEQYAIRSFAEALDAVPTALAENSGLQPIDTLTAVKAQQIKESNSFLGIDCNDVGTNNMRQQDVFETLIGKQQQIMLATQVVKMILKIDDVITPTEY

SEQ ID NO: 4988 - protein, 535 aa, Allium cepa
MALAFDEYGRPFLIMKEQDQKTRLRGLEAQKSNISAGVAVARILRTSLGPKGMDKMLQSPDGDVVITNDGATILEQMDVDNQIAKLMVELSRSQDYEIGDGTTGVVVLAGSLLEQAEKLLERGIHPIRIAEGYETASRIAVDHLEHISQKFEFSISDIEPLVQTCMTTLSSKIVNRCKRTLAEIAVKAVLAVADLDRKDVNLDLIKVEGKVGGKLEDTELIYGIIIDKDMSHPQMPKHIEDAKIAILTCPFEPPKPKTKHKVDIDTVEKFRTLRKQEQQYFDDMVQKCKDVGATLVICQWGFDDEANHLLMHRNLPAVRWVGGVELELIAIATGGRIVPRFQELTPEKLGKAGLVREKAFGTTKDRMLYIEQCANSRAVTIFIRGGNKMVIEETKRSVHDALCVARNLIRNNSIVYGGGSAEISCSIAVEAAADKHPGVEQYAIRSFAEALDAVPTALAENSGLQPIDTLTAVKAQQIKESNSFLGIDCNDVGTNNMRQQDVFETLIGKQQQIMLATQVVKMILKIDDVITPTEY

SEQ ID NO: 4989 - protein, 467 aa, Avena sativa
MALAFDEYGRPFIILREQEKKSRLQGLDAQKANIAAAKAIARILRTSLGPKGMDKMLQSPDGDVTITNDGATILELMDVDNQIAKLLVELSRSQDYDIGDGTTGVVVMAGSLLEQAEKLLERGIHPIRVAEGYEMASRIAVDHLESISTKYEFSATDIEPLVQTCMTTLSSKIVSRCKRALAEIAVKAVLAVADLERKDVNLDLIKVEGKVGGKLEDTELVQGIIVDKDMSHPQMPKRIEDAHIAILTCPFEPPKPKTKHKVDIDTVEKFQTLRGQEQKYFDEMVQKCKDVGATLVICQWGFDDEANHLLMQRELPAVRWVGGVELELIAIATGGRIVPRFQELSTEKLGKAGLVREKSFGTTKDRMLYIEKCANSKAVTIFIRGGNKMMIEETKRSIHDALCVARNLIINNSIVYGGGSAEISCSIAVEAAADRHPGVEQYAIRAFADALDAIPLALAENKWFATY

SEQ ID NO: 4990 - protein, 535 aa, Allium cepa
MALAFDEYGRPFLIVKEQDQKTRLRGLEAQKSNISAGVAVARILRTSLGPKGMDKMLQSPDGDVVITNDGATILEQMDVDNQIAKLMVELSRSQDYEIGDGTTGVVVLAGSLLEQAEKLLERGIHPIRIAEGYETASRITVDHLEQISQKFVFSINDIEPLVQTCMTTLSSKIVNRCKRTLAEIAVKAVLAVADLERKDVNLDLIKVEGKVGGNLEDTELIYGIIVDKDMSHPQMPKHIEDAKIAILTCPFEPPKPKTKHKVDIDTVEKFQTLRQQEQKYFDDMVQKCKDVGATLVICQWGFDDEANHLLMHRNLPAVRWVGGVELELIAIATGGRIVPRFQELTPEKLGKAGLVREKAFGTTKDRMLYIEQCANSRAVTIFIRGGNKMMIEETKRSIHDALCVARNLIRNNSIVYGGGSAEISCSIAVEAAADKHPGVEQYAIRSFAEALDAVPTALAENSGLQPIDTLTAVKAQQIKESNSFLGIDCNDVGTNNMRQQDVFETLIGKQQQIMLATQVVKMILKIDDVITPTEY

SEQ ID NO: 4991 - protein, 535 aa, Avena sativa
MALAFDEYGRPFIILREQEKKSRLQGLDAHKANIAAAKAIARILRTSLGPKGMDKMLQSPDGDVTITNDGATILELMDVDNQIAKLLVELSRSQDYDIGDGTTGVVVMAGALLEQAEKLLERGIHPIRVAEGYEMASRIAVDHLESISTKYEFSATDIEPLVQTCMTTLSSKIVSRCKRALAEISVKAVLAVADLERKDVNLDLIKVEGKVGGKLEDTELVEGIIVDKDMSHPQMPKRIEDAHIAILTCPFEPPKPKTKHKVDIDTVEKFQTLRGQEQKYFDEMVQKCKDVGATLVICQWGFDDEANHLLMQRELPAVRWVGGVELELIAIATGGRIVPRFQELSTEKLGKAGLVREKSFGTTKDRMLYIEKCANSKAVTIFIRGGNKMMIEETKRSIHDALCVARNLIINNSIVYGGGSAEISCSIAVEAAADRHPGVEQYAIRAFADALDAIPLALAENSGLPPIDTLTVVKSQHVKENNSRCGIDCNDVGTNDMKEQNVFETLIGKQQQILLATQVVKMILKIDDVITPSEY

SEQ ID NO: 4992 - protein, 535 aa, Avena sativa
MALAFDEYGRPFIILREQEKKSRLQGLDAHKANIAAAKAIARILRTSLGPKGMDKMLQSPDGDVTITNDGATILELMDVDNQIAKLLVELSRSQDYDIGDGTTGVVVMAGALLEQAEKLLERGIHPIRVAEGYEMASRIAVDHLESISTKYEFSATDIEPLVQTCMTTLSSKIVSRCKRALAEISVKAVLAVADLERKDVNLDLIKVEGKVGGKLEDTELVQGIIVDKDMSHPQMPKRIEDAHIAILTCPFEPPKPKTKHKVDIDTVEKFQTLRGQEQKYFDEMVQKCKDVGATLVICQWGFDDEANHLLMQRELPAVRWVGGVELELIAIATGGRIVPRFQELSTEKLGKAGLVREKSFGTTKDRMLYIEKCANSKAVTIFIRGGNKMMIEETRRSIHDALCVARNLIINNSIVYGGGSAEISCSIAVEAAADRHPGVEQYAIRAFADALDAIPLALAENSGLPPIDTLTVVKSQHVKENNSRCGIDCNDVGTNDMKEQNVFETLIGKQQQILLATQVVKMILKIDDVITPSEY

SEQ ID NO: 4993 - protein, 535 aa, Allium cepa
MALAFDEYGRPFLIVKEQDQKTRLRGLEAQKSNISAGVAVARILRTSLGPKGMDKMLQSPDGDVVITNDGATILEQMDVDNQIAKLMVELSRSQDYEIGDGTTGVVVLAGSLLEQAEKLLERGIHPIRIAEGYETASRITVDHLEQISQKFVFSINDIEPLVQTCMTTLSSKIVNRCKRTLAEIAVKAVLAVADLERKDVNLDLIKVEGKVGGNLEDTELIYGIIVDKDMSHPQMPKHIEDAKIAILTCPFEPPKPKTKHKVDIDTVEKFQTLRQQEHKYFDDMVQKCKDVGATLVICQWGFDDEANHLLMHRNLPAVRWVGGVELELIAIATGGRIVPRFQELTPEKLGKAGLVREKAFGTTKDRMLYIEQCANSRAVTIFIRGGNKMMIEETKRSVHDALCVARNLIRNNSIVYGGGSVEISCSIAIEAAADKHPGVEQYAIRSFAEALDAVPTALAENSGLQPIDTLTVVKAQQIKENNSFLGIDCNDVGTNNMQEQNVFETLIGKQQQIMLATQVVKMILKIDDVITPTEY

SEQ ID NO: 4994 - protein, 535 aa, Allium cepa
MALAFDEYGRPFLIVKEQDQKTRLRGLEAQKSNISAGVAVARILRTSLGPKGMDKMLQSPDGDVVITNDGATILEQMDVDNQIAKLMVELSRSQDYEIGDGTTGVVVLAGSLLEQAEKLLERGIHPIRIAEGYETASRITVDHLEQISQKFVFSINDIEPLVQTCMTTLSSKIVNRCKRTLAEIAVKAVLAVADLERKDVNLDLIKVEGKVGGNLEDTELIYGIIVDKDMSHPQMPKHIEDAKIAILTCPFEPPKPKTKHKVDIDTVEKFQTLRQQEHKYFDDMVQKCKDVGATLVICQWGFDDEANHLLMHRNLPAVRWVGGVELELIAIATGGRIVPRFQELTPEKLGKAGLVREKAFGTTKDRMLYIEQCANSRAVTIFIRGGNKMMIEETKRSVHDALCVARNLIRNNSIVYGGGSAEISCSIAVEAAADKHPGVEQYAIRSFAEALDAVPTALAENSGLQPIDTLTAVKAQQIKESNSFLGIDCNYVGTNNMRQQDVFETLIGKQQQIMLATQVVKMILKIDDVITPTEY

SEQ ID NO: 4995 - protein, 529 aa, Allium cepa
MNMADRPIMKEQDQKTRLRGLEAQKSNISAGVAVARILRTSLGPKGMDKMLQSPDGDVVITNDGATILEQMDVDNQIAKLMVELSRSQDYEIGDGTTGVVVLAGSLLEQAEKLLERGIHPIRIAEGYETASRIAVDHLEHISQKFEFSISDIEPLVQTCMTTLSSKIVNRCKRTLAEIAVKAVLAVADLDRKDVNLDLIKVEGKVGGKLEDTELIYGIIIDKDMSHPQMPKHIEDAKIAILTCPFEPPKPKTKHKVDIDTVEKFQTLRKQEQQYFDDMVQKCKDVGATLVICQWGFDDEANHLLMHRNLPAVRWVGGVELELIAIATGGRIVPRFQELTPEKLGKAGLVREKAFGTTKDRMLYIEQCANSRAVTIFIRGGNKMVIEETKRSVHDALCVARNLIRNNSIVYGGGSAEISCSIAVEAAADKNPGVEQYAIRSFADALDAVPMALAENSGLQPIDTLTAVKAQQIKENNAYLGIDCNDVGTNNMQEQNVFETLIGKQQQILLATQVVKMILKIDDVITPNDY

SEQ ID NO: 4996 - protein, 522 aa, Chrysanthemum coronarium
MALAFDEYGRPFIILREQESKSRLRGIDAQKANIAAGVAVSRILRTSLGPKGMDKMLQSPDGDITITNDGATILEQMDVDNQIGKLMVELSRSQDYEIGDGTTGVVVMAGALLEQAEKLLERGIHPIRVAEGFEISSRIAVDHLESIADKFDFSATNIEPLVQTCSTTLNSKIVNRCKRSLAEIAVKAVMAVADLERRDVNLDLIKVEGKVGGKLEDTELIYGILVDKDMSHPQMPKQIQDAHIAILTCPFEPPKPKTKHKVDIDTVEKFQTLRKQEQQYFDEMVQKCKDVGATLVICQWGFDDEANHLLMHRNLPAVRWVGGVELELIAIATGGRIVPRFQELTPEKLGKAGLVREKAFGTTKDRMLYIEHCANSRAVTIFIRGGNKMMIEETKRSIHDALCVARNLIRNNSIVYGGGAAEISCSIAVEAAADKYPGVEQYAIRAFADALDAVPMALAENSGLSPIETLSAVKAQQIKDNNHCCGIDCNDTGTNDMREQNVFETLIGKQQQILLATQVVKM

SEQ ID NO: 4997 - protein, 521 aa, Centaurea maculosa
MALAFDEYGRPFIILREQESKSRLRGLDAQKANISAGVAVARILRTSLGPKGMDKMLQSPDGDITITNDGATILEQMDVDNQIGKLMVELSRSQDYEIGDGTTGVVVMAGALLEQAERLLERGIHPIRVAEGYEIASKIAVDHLQQIAHKFEFTATHIEPLVQTCMTTLSSKIVNRCKRSLAEIAVKAVMAVADLERKDVNLDLIKVEGKVGGKLEDTELIYGILVDKDMSHPQMPKQIEDAKIAILTCPFEPPKPKTKHKVDIDTVEKFQTLRQQEQKYFDDMVQQCKDVGATLVICQWGFDDEANHLLMHRNLPAVRWVGGVELELIAIATGGRIVPRFQELTPEKLGKAGLVREKAFGTTKDRMLYIEHCANSRAVTIFIRGGNKMMIEETKRSLHDALCVARNLIRNNNIVYGGGAAEISCSVAVEAAADKYPGVEQYAVRAFADALDSVPMALAENSGLQPIETLSAVKSQQIKDNNPFCGIDCNDAGTNDMRDKTYSRRLSESNSSCCLPHKSSR

SEQ ID NO: 4998 - protein, 535 aa, Physcomitrella patens
MALAFDEYGRPFIIIRDQETKSRVRGLDAQKANIMAAKAVARVLRTSLGPNGMDKMLQSPDGDVTITNDGATILEQMEIENQIGKLMVELSRSQDYEIGDGTTGVVVLAGALLEQAEVLLERGIHPIRVAEGYEMASKLAVENLTRIGQTFEFSPDNIEPLVQTCMTTLSSKIVGRCKRQLAEIAVKAVLAVADLERSDVNLDLIKVEGKVGGKLEDTELVYGIVVDKDMSHPQMPKEIRDAKIAILTCPFEPPKPKTKHKVDIDSVEKFEALQAAEKSYFNEMVQQCKDAGATLVICQWGFDDEANHLLMHENLPAVRWVGGVELELIAIATGGRIVPRFKELTPEKLGKAGLVREKGFGTTKDRMLYIEQCANSRAVTIFIRGGNKMMIEETKRSLHDALCVARNLIRDKAIVYGGGAAEISCSLAVEAAADKISGVEQYAMRAFADALDMVPMALAENSGLQPINTLTAVKAQQVKEQNPHLGIDCNDVGTNDMREQNVFETLIGKKQQVLLATQVVKMILKIDDVISPSSY

SEQ ID NO: 4999 - protein, 568 aa, Chrysanthemum coronarium
MALAFDEYGRPFIILREQESKSRLRGIDAQKANIAAGVAVSRILRTSLGPKGMDKMLQSPDGDITITNDGATILEQMDVDNQIGKLMVELSRSQDYEIGDGTTGVVVMAGALLEQAEKLLERGIHPIRVAEGFEISSRIAVDHLESIADKFDFSATNIEPLVQTCSTTLNSKIVNRCKRSLAEIAVKAVMAVADLERRDVNLDLIKVEGKVGGKLEDTELIYGILVDKDMSHPQMPKQIQDAHIAILTCPFEPPKPKTKHKVDIDTVEKFQTLRKQEQQYFDEMVQKCKDVGATLVICQWGFDDEANHLLMHRNLPAVRWVGGVELELIAIATGGRIVPRFQELTPEKLGKAGLVREKAFGTTKDRMLYIEHCANSRAVTIFIRGGNKMMIEETKRSIHDALCVARNLIRNNSIVYGGGAAEISCSIAVEAAADKYPGVEQYAIRAFADALDAVPMALAENSGLSPIETLSAVKAQQIKDNNHCCGIDCNDTGTNDMREQNVFETLIGKQQQILLATQVVKMILKIDDVILPIRVLILRYLPTSFGLCRTLQPIESLENLFHAFKLVV

SEQ ID NO: 5000 - protein, 459 aa, Ananas comosus
MDVDNQIAKLMVELSRSQDYEIGDGTTGVVVMAGALLEQAEKLLERGIHPIRIAEGYEMASRIAFEHLERISQKFEFSATDIEPLVQTCMTTLSSKIVNRCKCMLAEIAVKAVLAVADLDRKDVNLDLIKVEGKVGGKLEDTELIYGIVVDKDMSHPQMPKRIENAKIAILTCPFEPPKPKTKHKVDIDTVEKFQTLRQQEQQYFDDMVQKCKDVGATLVICQWGFDDEANHLLMHRNLPAVRWVGGVELELIAIATGGRIVPRFQELTPEKLGKAGLVREKSFGTTKDRMLYIEQCANSRAVTIFIRGGNKMMIEETKRSLHDALCVARNLIRNNSIVYGGGSAEISCSIAVDAAADRYPGVEQYAIRSFAEALDSIPLALAENSGLQPINTLTAVKSQQVKENNPFCGIDCNDVGTNDMKEQNVFETLIGKQQQILLATQVVKMILKIDDVIAPSDY

SEQ ID NO: 5001 - protein, 498 aa, Avena sativa
KAIARILRTSLGPKGMDKMLQSPDGDVTITNDGATILELMDVDNQIAKLLVELSRSQDYDIGDGTTGVVVMAGALLEQAEKLLERGIHPIRVAEGYEMASRIAVDHLESISTKYEFSATDIEPLVQTCMTTLSSKIVSRCKRALAEIAVKAVLAVADLERKDVNLDLIKVEGKVGGKLEDTELVQGIIVDKDMSHPQMPKRIEDAHIAILTCPFEPPKPKTKHKVDIDTVEKFQTLRGQEQKYFDEMVQKCKDVGATLVICQWGFDDEANHLLMQRELPAVRWVGGVELELIAIATGGRIVPRFQELSTEKLGKAGLVREKSFGTTKDRMLYIEKCANSKAVTIFIRGGNKMMIEETKRSIHDALCVARNLIINNSIVYGGGSAEISCSIAVDAAADRHPGVEQYAIRAFADALDAIPLALAENSGLPPIDTLTVVKSQHVKESNSRCGIDCNDVGTNDMKEQNVFETLIGKQQQILLATQVVKMILKIDDVITPSEY

SEQ ID NO: 5002 - protein, 481 aa, Cichorium intybus
KMLQSPDGDITITNDGATILEQMDVDNQIGKLMVELSRSQDYEIGDGTTGVVVMAGALLEKAERLLERGIHPIRVAEGYEIASKIAVDHLQQISHKFEFNASNIEPLVQTCMTTLSSKIVNRCKRSLAEIAVKAVMAVADLERKDVNLDLIKVEGKVGGKLEDTELIYGILVDKDMSHPQMPKQIEDAKIAILTCPFEPPKPKTKHKVDIDTVEKFQTLREQEKKYFDDMVQQCKDVGATLVICQWGFDDEANHLLMHRNLPAVKWVGGVELELIAIATGGRIVPRFQELTADKLGKAGLVREKAFGTTKDRMLYIEHCANSRAVTVFIRGGNKMMIEETKRSIHDALCVARNLIRNNSIVYGGGAAEISCSIAVEAAADKYPGVEQYAVRAFADALDSVPMALAENSGLQPIETLSAVKSQQIKENNACCGIDCNDAGTNDMREQNVFETLIGKQQQLLLATQVVKMILKIDDVISPSEY

SEQ ID NO: 5003 - protein, 459 aa, Ananas comosus
MDVDNQIAKLMVELSRSQDYEIGDGTTGVVVMAGALLEQAEKLLERGIHPIRIAEGYEMASRIAFEHLERISQKFEFSATDIEPLVQTCMTTLSSKIVNRCKRMLAEIAVKAVLAVADLDRKDVNLDLIKVEGKVGGKLEDTELIYGIVVDKDMSHPQMPKRIENAKIAILTCPFEPPKPKTKHKVDIDTVEKFQTLRQQEQQYFDDMVQKCKDVGATLVICQWGFDDEANHLLMHRNLPAVRWVGGVELELIAIATGGRIVPRFQELTPEKLGKAGLVREKSFGTTKDRMLYIEQCANSRAVTIFIRGGNKMMIEETKRSLHDALCVARNLIRNNSIVYGGGSAEISCSIAVDAAADRYPGVEQYAIRSFAEALDSIPLALAENSGLQPINTLTAVKSQQVKENNPFCGIDCNDVGTNDMKDQNVFETLIGKQQQILLATQVVKMILKIDDVIAPSDY

SEQ ID NO: 5004 - protein, 495 aa, Chrysanthemum coronarium
MALAFDEYGRPFIILREQESKSRLRGIDAQKANIAAGVAVSRILRTSLGPKGMDKMLQSPDGDITITNDGATILEQMDVDNQIGKLMVELSRSQDYEIGDGTTGVVVMAGALLEQAEKLLERGIHPIRVAEGFEISSRIAVDHLESIADKFDFSATNIEPLVQTCSTTLNSKIVNRCKRSLAEIAVKAVMAVADLERRDVNLDLIKVEGKVGGKLEDTELIYGILVDKDMSHPQMPKQIQDAHIAILTCPFEPPKPKTKHKVDIDTVEKFQTLRKQEQQYFDEMVQKCKDVGATLVICQWGFDDEANHLLMHRNLPAVRWVGGVELELIAIATGGRIVPRFQELTPEKLGKAGLVREKAFGTTKDRMLYIEHCANSRAVTIFIRGGNKMMIEETKRSIHDALCVARNLIRNNSIVYGGGAAEISCSIAVEAAADKYPGVEQYAIRAFADALDAVPMALAENSGLSPIETLSATKARQKDKTFRCSETSYRIPMKW

SEQ ID NO: 5005 - protein, 612 aa, Cajanus cajan
MEDIEDLLIGSSRSEAPPGFRLPLAAAVGVGVGTKRNQLSSSLPSPAIPGTQTIYIKTFGCSHNQSDSEYMAGQLSAFGYSLSDNPDLADLWLINTCTVKSPSQSAMDTIISKGKSSNKPLVVAGCVPQGSRDLKELEGISVVGVQQIDRVVEVVEETLKGHEVRLFTRKKLPALDLPKVRKNKFVEILPINVGCLGACTYCKTKHARGHLGSYTVDSLVGRVKSVISDGVKEIWLSSEDTGAYGRDIGVNLPTLLKALVAELPADASTMLRIGMTNPPYILEHLKEIAEILRHPCVYSFLHVPVQSGSDTILSAMNREYTVSEFRTVVDTLTELVPEMEIATDIICGFPGETDEDFVQTVNLVKEYKFPQVHISQFYPRPGTPAARMKKVPSNVVKRRSRELTNVFESFTPYSGMEGKVERIWITDIASDGVHLVGHTKGYIQVLVLAPDNMLGTSAMVKITSVGRWSVFGEVIETVNHVSDGKALNKLVPNQDMANLCGNPAKNGGFSEVQESCACGNDSCCSQDTLDNSDNSRQNQSKRNFIGWMLRKRKHLHKKVERELASGYVKKQEGSMREWDFVDKALLGGISISLLTIIALVVVALTFRVIWSQ

SEQ ID NO: 5006 - protein, 611 aa, Phaseolus vulgaris
MEDIEDLLVGSGSATAPGFRLPMAAAVGVGVGSKRNKLSSSPSPAIPGTQTIYIKTFGCSHNQSDSEYMAGQLSAFGYSLSDNPEQADLWLINTCTVKSPSQSAMDTIITKGKSSNKPLVVAGCVPQGSRYLKELEGISIVGVQQIDRVVEIVEETLKGHEVRLLTRKTLPALDLPKVRKNKFVEILPINVGCLGACTYCKTKHARGHLGSYTIDSLVGRVKSVISDGVKEIWLSSEDTGAYGRDIGVNLPTLLKALVAELPADASTMLRIGMTNPPYILEHLKEIAEILRHPCVYSFLHVPVQSGSDTVLSAMNREYTVSEFRTVVDTLTELVPEMQIATDIICGFPGETDEDFVQTVNLVKDYKFSQVHISQFYPRPGTPAARMKKVPSKVVKGRSRELTNVFESFTPYSGMEGKVERIWITDVASDGIHLVGHTKGYIQVLVLAPDHMLGASAMAKITSVGRWSVFGEVIETVNHASDNKALNKLVPDRDLHSLCVNPAKAGGFSEEPESCACGSDVCCSIDKSDVSRGTAVPQNQSNRNFFEWMLRKREHLHKKVESELASGSVKKQEGKMKKWDFVDKVLLGGMSISIFTIIALVAALAFRVIWSQ

SEQ ID NO: 5007 - protein, 618 aa, Medicago truncatula
MEDIEDLLIGVATGAPPGFRSPLSSVTVGVATKKIQRSSLLPSPSPSIPGTQTIFIKTFGCSHNQSDSEYMAGQLSAFGYSLSDNPDEADLWLINTCTVKSPSQSAMDTIITKGKSSNKPLVVAGCVPQGSRDVKELEGISIVGVQQIDRVVEVVEETLKGHEVRLLTRKTLPALDLPKVRKNKFVEILPINVGCLGACTYCKTKHARGHLGSYTIDSLAGRVKSVVSDGVKEIWLSSEDTGAYGRDIGVNLPTLLNALVAELPADGSTMLRIGMTNPPFILEHLKEIAEVLRHPCVYTFLHVPVQSGSDAILSAMNREYTVGEFRTVVDTLTELVPGMQIATDIICGFPGETDEDFEQTVNLIKEYKFSQVHISQFYPRPGTPAARMKKVPSNVVKRRSRELTNVFESFTPYSGMEGKVERIWITDIATDGVHLVGHTKGYIQVLVIAPDDMLGSSALAKITSVGRWSVFGEVIETINPASDNKALNKQVPTQDMSSLCCNQTKTCEISEEPESCACGNVDSCCSQSTLVKTDNSRDTVVLPQNQNNKNLFGWILRKRKNLHKRVESELASGSDLKQERSMRKWDFVDKALLGGISISILTIIALLVCLRFSVLWSQ

SEQ ID NO: 5008 - protein, 618 aa, Cicer arietinum
MEDIEDLLIGTETGTPPGFRSPLTSATVGVGTKKNQRSLPSPSPSPSIPGTQTIFIKTFGCSHNQSDSEYMAGQLSAFGYSLSDNPDEADLWLINTCTVKSPSQSAMDTIITKGKSSNKPLVVAGCVPQGSRDAKELEGISIVGVQQIDRVVEVVEETLKGHEVRLLTRKRLPALDLPKVRKNKFVEILPINVGCLGACTYCKTKHARGHLGSYTIDSLAGRVKSVISDGVKEIWLSSEDTGAYGRDIGVNLPTLLNALVAELPADASTMLRIGMTNPPFILEHLKEIAEVLRHPCVYSFLHVPVQSGSDAILSAMNREYTVREFRTVVDTLTELVPEMQIATDIICGFPGETDEDFEQTVNLIKEYKFSQVHISQFYPRPGTPAARMKKVPSNVVKRRSRELTNVFEAFTPYNGMEGRVERIWITDIASDGVHLVGHTKGYIQVLVIASDDMLGTSAMVKITSVGRWSVFGEIIETIKEAKDNKALNTQIPNQDMSLLCCNQTKTGVISEEPESCACGNDIDSCCSQSTLEKIDNSSGTVMQQNQNNKNLFGWILRKRKNLHKRVESEHSSGSDIKQERSMKKWDFVDKALLGGISISILTIVVLLVCLSFSVIWSQ

SEQ ID NO: 5009 - protein, 617 aa, Trifolium pratense
MEDIEDLLIGTGAGTPPGFRSPLTSATVGFETKKNQRSSLLSSPSPSIPGTQTIFIKTFGCSHNQSDSEYMAGQLSAFGYSLSDNPDEADLWLINTCTVKSPSQSAMDTIITKGKSSNKPLVVAGCVPQGSRDTKELEGISIVGVQQIDRVVEVVEETLKGHEVRLLTRKTLPALDLPKVRKNKFVEILPINVGCLGACTYCKTKHARGHLGSYTIDSLVGRVKSVVSDGVKEIWLSSEDTGAYGRDIGVNLPTLLNALVAELPADASTMLRIGMTNPPFILEHLKEIAEVLRHPCVYTFLHVPVQSGSDAILTAMNREYTVSEFRTVVDTLTELVPGMQIATDIICGFPGETDEDFEQTVNLIREYKFSQVHISQFYPRPGTPAARMKKVPSNVVKRRSRELTNVFEAFTPYSGMEGKVERIWITDIASDGVHLVGHTKGYIQVLVIAPDNMLGSSALAKITSVGRWSVFGEIIETINHASDNKALNKQVPNQDMSSLCCNQTNTCVTSEVPESCACGNVDSCCSQSTLETADNSRDTVVLPQKQNSKNLFGWILRKRKNLHKRVESELASGSDIKQEKSMKKWDFVDKALLGGISISILTIIALLVYLRVSVIWS

SEQ ID NO: 5010 - protein, 635 aa, Trifolium pratense
MGRAESVSTEQWQHREEEMEDIEDLLIGTGAGTPPGFRSPLTSVTVGFGTKKNQRSSLLPSPSPSIPGTQTIFIKTFGCSHNQSDSEYMAGQLSAFGYSLSDNPDEADLWLINTCTVKSPSQSAMDTIITKGKSSNKPLVVAGCVPQGSRDTKELEGISIVGVQQIDRVVEVVEETLKGHEVRLLTRKTLPALDLPKVRKNKFVEILPINVGCLGACTYCKTKHARGHLGSYTIDSLVGRVKSVVSDGVKEIWLSSEDTGAYGRDIGVNLPTLLNALVAELPADASTMLRIGMTNPPFILEHLKEIAEVLRHPCVYSFLHVPVQSGSDAILTAMNREYTVNEFRTVVDTLTELVPGMQIATDIICGFPGETDEDFEQTVNLIREYKFSQVHISQFYPRPGTPAARMKKVPSNVVKRRSRELTNVFEAFTPYSGMEGKVERIWITDIASDGVHLVGHTKGYIQVLVIAPDNILGSSALAKITSVGRWSVFGEIIETINHASDNKALNKQVPNQDMSSLCCNQTKTCVTSEVPESCACGNVDSCCSQSTLETTDNSRDTVVLPQNQNSKNLFGWILRKRKNLQKRVESELASGSDIKQEKSMKKWDFVDKALLGGITISILTIIALLVYLRFSVIWS

SEQ ID NO: 5011 - protein, 624 aa, Lupinus angustifolius
MKESMGTEMLLEDIEDLMIGGATGFRLPIASNTVAVAPSTKKRIQPQHSSIPGTQTIYIKTFGCSHNQSDSEYMAGLLSAFGYSLSDNPDQSDLWLVNTCTVKSPSQSAMDTIISRAKSSNKPLVVAGCVPQGSRNIKELQGISIVGVQQIDRVVEVVEETLKGHEVRLLTRTTLPALDLPKVRKNTFVEILPINVGCLGACTYCKTKHARGHLGSYTVQSLVGRVKSVISDGVKEIWLSSEDTGAYGRDLGVNLPTLLNALVAELPADASTMLRIGMTNPPFILEHLKEIAQILRHPCVYSFLHVPVQSGSDTILSAMNREYTVSEFKTVVDTLTELVPGMQIATDIICGFPGETDEDFEQTVNLVNEYQFPQVHISQFYPRPGTPAARMKKVPSNVVKRRSRELTNVFEAFTPYNGMEGRVERIWITDIASDGVHLVGHTKGYIQVLIIASDNMLGTSAMVKITSVGRWSVFGEVIEMVSCSDHKVSCKQIPNQDVPSLCCNPAKNGGLSERPECCACGNDSCCGQSMLEKSDDSRSSVVPQNQNSRSFVGWILRKRKHLLHRGTENDLDSASGSVLKHEGGHGSMTKWDFVDKALLGGISISIFTIIALVVALKFSVFWSK

SEQ ID NO: 5012 - protein, 309 aa, Glycine max
MAKQEVVEGFKFEQRHGKERVRVARVWKTRQGQHFIVEWRVGITLFSDCVNSYLRDDNSDIVATDTMKNTVYAKAKECSDILSAEEFAILLAKHFVSFYQKVTGAIVNIVEKPWERVTVDGQPHEHGFKLGSEKHTTEAIVQKSGSLQLTSGIEGLSVLKTTQSGFVNFIRDKYTALPDTRERMVATEVTALWRYSYESLYSLPQKPLYFTEKYQEVKKVLADTFFGPPKGGVYSPSVQNTLYLMAKATLNRFPDIAYVSLKLPNLHFIPVNISNQDGPIVKFEDDVYLPTDEPHGSIQASLSRLWSKL

SEQ ID NO: 5013 - protein, 308 aa, Phaseolus vulgaris
MAQEVVEGFKFEQRHGKERVRVARVWRTPQGRHFVVEWRVGITLFSDCVNSYLRDDNSDIVATDTMKNTVYAKAKECSDILSVEDFAILLAKHFVSFYKKVTGAIVNIVEKPWERVIVDGQPHQHGFTLGSEKHTTEAIVQKSGSLQLTSGIEGLSVLKTTQSGFENFIRDKYTALPDTRERILATEVTALWRYSYESLYNLPQKPLYFTDKYLEVKKVLADTFFGPPNRGVYSPSVQNTLYLMAKATLNRFPDIAYVHLKMPNLHFLPVNISSKDGPIVKFEDDVYLPTDEPHGSIEASLSRVWSKL

SEQ ID NO: 5014 - protein, 308 aa, Vigna unguiculata
MAHEVVEGFKFEQRHGKERVRVARVWKTPQGRHFVVEWRVGISLFSDCVNSYLRDDNSDIVATDTMKNTVYAKAKECSDILSVEDFAILLAKHFVSFYQKVTGAIVNIVEKPWERVTVDGQPHQHGFKLGSEKHTAEAIVQKSGSLQLTSGIEGLSVLKTTQSGFVNFIRDKYTALPDTRERILATEVTALWRYSYESLYTLPQKPLYFTDKYLEVKTVLADTFFGPPNTGVYSPSVQNTLYLMAKATLNRFPDIAYVHLKMPNLHFLPVNISNKDGPIVKFEDDVYLPTDEPHGSIQASLSRLWSKL

SEQ ID NO: 5015 - protein, 310 aa, Cajanus cajan
MAQEVVEGFKFDQSHGKERVRVARVWKTKQGRHFVVEWRVGITLLSDCVNSYLRDDNSDIVATDTMKNTVYAKAKECSEILSVEDFAIVLAKHFVSFYKQVTGAIVNIVEKPWERVVVDGQPHEHGFKLGSEKHTAEAVVQKSGALQLTSGIEGLSVLKTTKSGFEGFIRDKYTALPDTRERMLATEVTALWRYSYESLYSLPQKPLYFTDKYLEVKKVLADTFFGPPNGGVYSPSVQNTLYLMAKATLNRFPDIAFVHLKMPNLHFIPVNISNKDGPIVKFDDDVYLPTDEPHGSIKASLSRLWSNSKL

SEQ ID NO: 5016 - protein, 307 aa, Lotus japonicus
MAKEVEGFKFEQRHGKERVRVARVWKNNQGHHFVVEWRVSISLLSDCLNSYLRDDNSDIVATDTMKNTVYAKAKECSEILSVEDFAILLAKHFTSFYKQVTTAIVKIVEKPWERVNVDGQPHEHGFKLGSEKHTAEAIVQKSGALQLTSGIEGLSLLKTTKSGFEGFIRDKYTVLPETRERMLATEVTALWRYSYESLYSIPQKPLYFTEKYLDVKKVIVDTFFGHPKEGVYSPSVQSTLYQMAKATLNRFPDVASIQLKMPNIHFIPVNLSNKDGPIVKFDDDVYLPTDEPHGSIEASLSRILSKM

SEQ ID NO: 5017 - protein, 308 aa, Cicer arietinum
MAKNVEGFEFEQRHGKERVRVARVWKSKDGKRHFVVEWRVSINLLSDCVNSYIRDDNSDIVATDTMKNTVYAKAKECSEILSAEDFAILLAKHFTSFYRQVTTAIVNIVEKPWERVSVDGQPHEHGFKLGSEKHTTEAIVKKSGALQLTSGIEGLSLLKTTKSGFEGFIRDKFTALPETRERMLATEVTALWRYTYESFYSIPQKPLYFTDKYLDVKRVLVDTFFGSPKEGVYSPSVQSTLYQMGKATLNRFPDIASIQLKMPNIHFLPVNLSNKDGHIVKFDDDVYLPTDEPHGSIEASLSRTRSKM

SEQ ID NO: 5018 - protein, 308 aa, Trifolium pratense
MAEKVEGYEFSQSHGKERVRVARVWKTKDGQRHFVVEWRVSINLLSDCINSYLRDDNSDIVATDTMKNTVYAKAKECSEILSAEDFAILLAKHFTSFYRQVTTAIVKIVEKPWERVSVDGQPHEHGFKLGSEKHTTEAIVKKSGALQLTSGIEGLSVLKTTKSGFEGFIRDKYTVLPDTRERMLATEVTALWRYSYESVNSIPQKPLYFTDKYLDIKRVLVSTFFGSPKEGVYSPSVQSTLYQMAKATLNRFPDIASIQLKMPNIHFLPVNLSNKNGPIVKFNDNVFLPTDEPHGSIEASLSRSRSKL

SEQ ID NO: 5019 - protein, 309 aa, Trifolium pratense
MGEKVLEGFEFSQCHGKERVRVARVWKTKDGQRHFVVEWRVSINLLSDCVNSYLRDDNSDIVATDTMKNTVYAKAKECSEILSAEDFAILLAKHFTSFYRQVTTAIVKIVEKPWERVSVDGQPHEHGFKLGSEKHTTEAIVKKSGALQLTSGIEGLSVLKTTKSGFEGFIRDKYTVLPDTRERMLATEVTALWRYSYESVNSIPQKPLYFTDKYLDIKRVLVDTFFGSPKEGVYSPSVQSTLYQMAKTALNRFPHIASIQLKMPNIHFLPVNLSNKNGQIVKFNDDVFLPTDEPHGSIEASLSRSRSKL

SEQ ID NO: 5020 - protein, 309 aa, Trifolium pratense
MGEKVLEGFEFSQSHGKDKVRVARVWKSKDGQRHFVVEWRVSINLLSDCVNSYLRDDNSDIVATDTMKNTVYAKAKECSEILSAEDFVILLAKHFTSFYRQVTTAIVKIVEKPWERVSVDGQPHEHGFKLGSEKHTTEAIVKKSGALQLTSGIEGLSVLKTTKSGFEGFIRDKYTVLPDTRERMLATEVTALWRYSYESVNSIPQKPLYFTEKYLDIKRVLVDTFFGSPKEGVYSPSVQSTLYQMAKAALNRFPDIASIQLKMPNIHFLPVNLSNKNGPIVKFNDDVFLPTDEPHGSIEASLSRSRSKL

SEQ ID NO: 5021 - protein, 244 aa, Trifolium pratense
LEGFEFSQSHGKERVRVARVWKSKDGQRHFVVEWRVSINLLSDCINSYLRDDNSDIVATDTMKNTVYAKAKECSEILSAEDFAILLAKHFTSFYRQVTTAIVKIVEKPWERVSVDGQPHEHGFKLGSEKHTTEAVVKKCGALQLTSGIEGLSVLKTTKSGFEGFIRDKYTVLPDTRERMLATEVTALWRYSYESVNSIPQKPLYFTEKYLDIKRVLVDTFFGSPKKGSIVHLFKALSIRWRRPH

SEQ ID NO: 5022 - protein, 308 aa, Medicago truncatula
MAKNVEGFEFEQRHGKERVRVARVWKSKDGKQQFVVEWRVSINLLSDCVNSYVRDDNSDIVATDTMKNTVYAKAKECSEILSVEDFAILLAKHFTSFYSQVTTAIVKIVEKPWERVNVDGQPHDHGFKLGSEKHTTEAIVKKSGALQLTSGIEGLSVLKTTKSGFEGFVRDKYTILPDTRERMLATEVTALWRYSYESLYSVPKKPLYFTEKYLDVKRVLLDTFFGSPKEGVYSPSVQATLYQMAKAALNRFPDIASIQLKMPNIHFIPVNLSNKNGQFVKFDDDVYLPTDEPHGSIEASLSCSRSKM

SEQ ID NO: 5023 - protein, 307 aa, Arachis hypogaea
MAERVEGFNFEQRHGKQRVRVARVWKTKEGKHYVVEWRVSISLLSDCVNSYLRDDNSDIVATDTMKNTVYAKAKECSEILSVENFAIELAKHFISFYRQVTAAIVNIVEKPWERIIMDGQPHMHGFKLGSERHTVEAIVKKSGALQLTSGVEGLSVLKTTKSGFEGFIRDKYTALPETRERMLATEVTGLWRYSYESLSSIPQKPLYFMERYNDVKRVLLETFFGPPNEGVYSPSVQNTLYQMARATLNRFPDIDSVQLKMPNIHFLPVNISNTGGQIVKFNDDVYLPTDEPHGSIQATLSRFWSKM

SEQ ID NO: 5024 - protein, 305 aa, Arachis hypogaea
ERVEGFNFEQRHGKERVRVARLWKTKEGKHYVVEWRVGISLFSDCVNSYLRDDNSDIVATDTMKNTVYAKAKECSEILSVENFAIELAKHFISFYRQVTTAIVNIVEKPWERIIVDGQPHMHGFKLGSERHTVEAIVKKSGALQLTSGVEGLSVLKTTKSGFEGFIRDKYTALPETRERMLATEVTGLWRYSYESLSSVPQKPLYFMERYGDVKRVLLETFFGPPNVGVYSPSVQSTLYQMARATLNRFPDIDSVQLKMPNIHFLPVNISNTGGQIVKFNDDVYLPTDEPHGSIQATLSCFWSKM

SEQ ID NO: 5025 - protein, 105 aa, Trigonella foenum-graecum
MAKNVEGFEFEQRHGKERVRVARVWKSKDGKRHFVVEWRVSINLLSDCVNSYIRDDNSDIVATDTMKNTVYAKAKDVRKYFLWRTLLFYLPNILHHFTARLPLLL

SEQ ID NO: 5026 - protein, 309 aa, Lupinus angustifolius
MTKEVIEGFNFEQSHGKERVRVARVWKNQESGRYFVVEWRVSISLLSHCINSYIHDDNSDIVATDTMKNTVYAKAKECSEILSAENFAIELAKHFTSFYKQVTTAIVNIVEKPWERINVDGQPHEHGFKLGSEKHTTEAIVKKSGELRLTSGIEGLSLLKTTKSGFEGFIRDKYTALPETRERMLATEVTAQWRYSYESLQSVPQKPLYFTEKYLDVKKVLIDTFFGPPNVGVYSPSVQSTLYQMAKATLNRVPDISSIQLKMPNIHFLPANISNKEGQIVKFEDDVYFPTDEPHGSIEASLSRFWSKM

SEQ ID NO: 5027 - protein, 253 aa, Solanum tuberosum
  Sequence also found in Organisms: Solanum phureja
MATTQLTASSISGNGFASFEGLRSTCIVKAVSFTPLKHNNSRSFSRLVVKAATTVAPKYTTLKPLGDRVLVKIKTAEEKTVGGILLPVTAQSKPNGGEVVAVGEGHSAGKIKVDISVKTGAQVIYSKYAGTEVEFDGSKHLILKEDDIVGILETDDVKDLQPLNDRVLIKVAEAEEKTAGGLLLTEAAKEKPSIGSIIAVGPGPIDEEGNRKPLSVSPGNTVLYSKYAGSEFKGADGSDYITLRVSDVMAVLS

SEQ ID NO: 5028 - protein, 254 aa, Solanum melongena
MATTQLTASSISGNGFASFEGLRSTGIVKAISFAPLKRNNGKSFRPLVVKAATTVAPKYTSLKPLGDRVLVKIKTAEEKTVGGILLPVAAQSKPNGGEVVAVGEGHSAGKTKVDISVKTGAQVIYSKYAGTEVEFDGSKHLILKEDDIVGILETDDIKDLQPLNDRVLIKVAEAEEKTAGGLLLTEAAKEKPSIGTIIAVGPGPLDEEGNRKPLSVSAGSTVLYSKYAGSEFKGADGSDYITLRVSDVMAVLSY

SEQ ID NO: 5029 - protein, 252 aa, Capsicum annuum
MASTQLTASSISGNGFASFEGLRSTCIVKSASFAPLKLNNSSFRGLVVKAATTAAPKYTSLKPLGDRVLVKIKTTEEKTVGGILLPITAQSKPNRGEVVAVGEGHSAGKTKVDISVKTGAKVIYSKYAGTEVEFDGSKHLILKEDDIVGILETDDVKDLQPLNDRVLIKVAEAEEKTAGGLLLSEAAKEKPSIGTIIAVGPGLLDEEGNRKPLSVSPGNTVLYSKYAGNEFKGADGSDYITLGAPDVMAVLS

SEQ ID NO: 5030 - protein, 252 aa, Nicotiana tabacum
MATTQLTASSICAKGFVSFEGLRSTGSVKVASFAPLKQNSRSFRSLVVKAATTVAPKYTTLKPLGDRVLVKIKTAEEKTVGGILLPVTAQSKPQGGEVVAVGEGRSAGKTKVDISVKTGAQVVYSKYAGTEVEFDGSKHLILKEDDIVGVLETDDIKDLQPLNDRVLIKVAEAEEKTAGGLLLTEAAKEKPSIGAIIAVGPGPLDEEGNRKPLSVSPGNTVLYSKYAGSEFKGADGSDYITLRASDVMAVLS

SEQ ID NO: 5031 - protein, 252 aa, Nicotiana benthamiana
MATTQLTASSICANGFVSFDGLRSMGSVKVASFAPLKQNRRSFRSLVVKSATTVAPKYTMLKPLGDRVLVKIKTAEEKTVGGILLPVTAQSKPQGGEVVAVGEGRSAGKTKVDISVKTGAQVVYSKYAGTEVEFDGSKHLILKEDDIVGVLETDDIKDLQPLNDRVLIKVAEAEEKTAGGLLLTEAAKEKPSIGAVIAVGPGPLDEEGNRKPLSVSPGNTVLYSKYAGSEFKGADGSDYITLRASDVMAVLS

SEQ ID NO: 5032 - protein, 270 aa, Capsicum annuum
MASTQLTASSISGNGFASFEGLRSTCIVKSASFAPLKLNNSSFRGLVVKAATTAAPKREIRGLMDSIIYLFRDFKYTSLKPLGDRVLVKIKTTEEKTVGGILLPITAQSKPNRGEVVAVGEGHSAGKTKVDISVKTGAKVIYSKYAGTEVEFDGSKHLILKEDDIVGILETDDVKDLQPLNDRVLIKVAEAEEKTAGGLLLSEAAKEKPSIGTIIAVGPGLLDEEGNRKPLSVSPGNTVLYSKYAGNEFKGADGSDYITLGAPDVMAVLS

SEQ ID NO: 5033 - protein, 247 aa, Petunia hybrida
MATTQLTASSIGFGSFEGLRSTTTVKVASLKQNNSRSFRGLVVKAATVVAPKYTALKPLGDRVLVKIKIAEEKTVGGILLPTTAQSKPQGGEVVAVGEGRSVGQNKVDISVKTGAQVVYSKYAGTEVEFNGTNHLILKEDDIVGILETEDIKDLQPLNDRVLIKVAVAEEKTAGGLLLTEAAKEKPSIGTVIAVGPGPLDEEGNRKPLSVSSGNTVLYSKYAGNEFKGADGSDYIALRASDVMAVLS

SEQ ID NO: 5034 - protein, 249 aa, Nicotiana benthamiana
MATTQLTASSISVKGFASFEGLRSTTTVNVASLKQNRRSFRGLIIKAATVVAPKYASLKPLGDRVLVKIKTVEEKTVGGILLPTTAQSKPQGGEVVAVGEGRSVGKTQVDISVKTGAQVIYSKYAGTEVEFNGSNHLILKEDDIVGTLETDEIKDLQPLNDRVLIKVAEAEEKTAGGLLLTEASKEKPSIGTVIAVGPGPLDEEGNRKPLSVSTGNTVLYSKYAGNEFKGADGSEYIALRASDVMAVLS

SEQ ID NO: 5035 - protein, 252 aa, Nicotiana benthamiana
MATTQLTASSISAKGFASFEGLRSTSNVKVVSFAPLKKNSRLSRGLVVKAATTVAPKYTSVKPLGDRVLVKIKTAEEKSVGGILLPTSAQSKPQGGEIVAVGEGRSIGKTKVEISVKNGTQVLYSKYAGTEVLFDGSTHLILKEDDIVGILETDDIKDLQPLNDRILIKVAEVEEKTAGGLFLSEAAKEKPSIGSVIAAGPGPLDDEGNRKSLSVSPGNTVLYSKYAGNDFKGADGADYVTLRASDVIAVLS

SEQ ID NO: 5036 - protein, 252 aa, Nicotiana benthamiana
MATTQLTASFISAKGFASFEGLRSTSNVKVVSFAPLKQNNRLSRGLAVKAATTVAPKYTSVKPLGDRVLVKIKTAEEKSVGGILLPTSAQSKPQGGEIVAVGEGRSIGKTKVEISVKNGTQVLYSKYAGTEVLFDGSTHLILKEDDIVGILETDDIKDLQPLNDRILIKVAEVEEKTAGGLFLSEAAKEKPSIGSVIAAGPGPLDEEGNRKSLSVSPGNTVLYSKYAGNDFKGADGSDYVTLRASDVIAVLS

SEQ ID NO: 5037 - protein, 252 aa, Solanum tuberosum
MATTQLTASSISAKGFASFEGLRSTSNLKVSSFAPLKQNSRSFHGLVVKASTVVSPKYTSLKPLGDRVLVKIKTAEEKSVGGILLPMSAQSKPQGGEVVAVGEGHSIGKTTVEISIKNGTQVLYSKYAGTELEFDGSKHLILKEDDIVGILETDDIKDLQPLNDRVLIKVAEVEEKTTGGLFLSQAAKEKPSFGTVIAVGPGPLDEEGKRKALSVSPGNTVLYSKYAGNDFKGADGSEYITLRASDVIAVLQ

SEQ ID NO: 5038 - protein, 252 aa, Solanum phureja
MATTQLTASSISAKGFASFEGLRSISNLKVSSFAPLKQNSRSFHGLVIKASTVVSPKYTSLKPLGDRVLVKIKTAEEKSVGGILLPMSAQSKPQGGEVVAVGEGHSIGKTTVEISIKNGTQVLYSKYAGTELEFDGSKHLILKEDDIVGILETDDIKDLQPLNDRVLIKVAEVEEKTTGGLFLSQAAKEKPSFGTVIAVGPGPLDEEGKRKALSVSPGNTVLYSKYAGNDFKGADGSEYITLRASDVIAVLQ

SEQ ID NO: 5039 - protein, 252 aa, Solanum lycopersicum
MATTQLTASSISAKGFASFEGLRSISNLKVASFAPLKQNRRSFHGLVVKASTVVSPKYTSLKPLGDRVLVKIKTAEEKSVGGILLPVSAQSKPQGGEVVAVGEGHSIGKTTVEISIKNGTHVVYSKYAGTELEFDGSKHLILKEDDIVGILETDDIKDLQPLNDRVLIKVAEVEEKTSGGLFLSQAAKEKPSFGAVIAVGPGPLDEEGKRKALSVSPGNTVLYSKYAGNDFKGADGSEYITLRASDVIAVLQ

SEQ ID NO: 5040 - protein, 256 aa, Tabernaemontana elegans
MATTQLTASTISAKGFVSFEGLRASSSNVKILSFAPLGQNGVSKRLFRGLVVKAATTVATKYTSLKPLGDRVLVKIKVPEDKTVGGILLPTSAQTKPQGGEVVAVGEGRTVGKTKVDISVKTGTQVVYSKYAGTEVEFNGANHLILKEDDIVGILDTDDVKDMKPLNDRVLIKVAEAEEKTAGGLLLTEASKEKPSIGTVIAVGPGPLDEEGNRKPLSVSPGNTVLYSKYAGNDFKGTDGSEYIALRASDVMAVLS

SEQ ID NO: 5041 - protein, 256 aa, Amsonia hubrichtii
MATTQLTASTISAKGFVSFEGLRASSGSSKISSFAPLGQNGLSKRLFRGLVVKAATTVAPKYTSLKPLGDRVLVKIKVPEEKTVGGILLPTTAQSKPQGGEVVAVGEGRSVGKNKVDISVKTGSQIVYSKYAGTEVEFNGANHLILKEDDIVGILDTDDVKDMKPLNDRVLIKVAEAEEKTAGGLLLTEASKEKPSIGTVVAVGPGPLDEEGNRKPPSLSPGNTVLYSKYAGNDFKGSDGTDYIALRASDVMAVLS

SEQ ID NO: 5042 - protein, 254 aa, Sarracenia psittacina
MATAQLSASSISARNLPQFEGLRPSIVKVSSVTPLRQTGLSLRSFRGLVVKAATTVAPKYTTLKPLGDRVLVKIKTAEEKTVGGILLPTSAQSKPQGGEVVAIGEGKTIGKSKVDISVKPGAQIVYSKYAGTEVEFNGSNHLILKEDDIVGILETDDVKDLKPLNDRVLIKVTEAEQKTAGGLLLTEASKEKPSIGTVIAVGPGPLDEEGKRKALSVSAGNTVLYSKYAGNEFKGADGSDYIALRASDVIAALS

SEQ ID NO: 5043 - protein, 134 aa, Solanum tuberosum
MLVSVFLALFLPCVGMSAVFLVYICLLWYAAAYQSAGPGAENYHNEKTNQELGLSAAQLDKLPKITGNELVMGNDCAVCLDEIENEQIARVVPGCNHGFHLECADTWLSKNPICPVCRTKLEPEFFNPPESNPC

SEQ ID NO: 5044 - protein, 134 aa, Solanum phureja
MLVSVFLALFLPCVGMSAVFLVYICLLWYAAACQSAGPGAENYHNEKTNQELGLSAAQLDKLPKITGKELVMGNDCAVCLDEIENEQIARVVPGCNHGFHLECADTWLSKNPICPVCRTKLEPEFFNPPESNPC

SEQ ID NO: 5045 - protein, 132 aa, Solanum melongena
MLVSVFLALFLPCVGMSAVFLVYICLLWYAAAHQSGPENYPNPVKTNQQVGLSAGQLDKLPKITGKELVMGSDCAVCLDEIENEQMARVVPGCNHGFHLECADTWLSKNPICPVCRTKLEPEFFNPPESNPC

SEQ ID NO: 5046 - protein, 136 aa, Petunia hybrida
MLVSVFLALFLPCIGMSAVFLVYICLLWYAATYQTAGAAAGNYQNDAIKPNQENGLSAAQLDKLPKITGKELVMGNDCAVCLDEIENEQFARVVPGCNHGFHLECADTWLSKHPVCPVCRTKLEPEFFNPPESNPC

SEQ ID NO: 5047 - protein, 136 aa, Nicotiana tabacum
MLVSVFLALFLPCVGMSAVFLVYICLLWYAASYQSAGAGTGNYTNDPVKPNQEKGLSAAQLDKLPKITGKELVMSNDCAVCLDEIESEQFARVVPGCNHGFHLECADTWLSKNPVCPVCRTKLEPDFFNPPENNPC

SEQ ID NO: 5048 - protein, 136 aa, Nicotiana benthamiana
MLVSVFLALFLPCVGMSAVFLVYICLLWYAASNQSAGAGTGNYTNDPVKPNQEKGLSAAQLDKLPKITGKELVMSNDCAVCLDEIESEQYARVVPGCNHGFHLECADTWLSKNPVCPVCRTKLEPDFFCPPENNPC

SEQ ID NO: 5049 - protein, 136 aa, Nicotiana benthamiana
MLVSVFLALFLPCVGMSAVFLVYICLLWYAASNQSAGAGTGNYTNDPVKPNQEKGLSAAQLDKLPKITGKELVMSNDCAVCLEEIESEQYARVVPGCNHGFHIECADTWLSKNPLCPVCRTKLEPDFFNPPESNPC

SEQ ID NO: 5050 - protein, 135 aa, Capsicum annuum
MLVSVFLALFLPCVGMSAVFLVYICLLWYAAAYQNSGATGPGQDPVKTNEQKGLNEAQLDKLPKITGKELVMGNDCAVCLDEIENEQIARIVPGCNHGFHVECADTWLSKNPICPVCRTKLEPEFFNPPESSSPC

SEQ ID NO: 5051 - protein, 498 aa, Sorghum bicolor
MKSISVPRPSALDLVFTSVSATTVSSMVAVEMESFSNSQLLLMTLLMLLGGEVFTSMLGLHFTFTKFIKKREIPHSNNNSLHGNINGPAPAAPSSLEHGHRRRPMEMEAQAAAVQMELAGFNNDDQRDFASIARLLMFIVLGYLSVVHLAGYTLILIYLSVVGSAREVLVGKRISLSTFSVFTVVSTFANCGFVPTNEGMASFKSFPGMLLLVMPHILLGNTLFPVFLRLSITALERVTRRGDLRELLRDGGPGGGGGGGGGPAAAAIGYDHLLPGGRTWCLALTVAVFLAGQLLLYCAMEWGSDGLRGLTAFQKLVAALFMSVNSRHSGEMVVDLATVSSAIVVLYVLMMYLPPYTTFLPIAMEDHQQQQNEAQSDDKSKSSSSISIWQKLLMSPLSCLTIFIVVICITERRQIADDPINFSVLNIVVEVISAYGNVGFSTGYSCSRQVTPDGSCRDAWVGFSGKWSREGKLTLMAVMFYGRLKKFSMHGGQAWKLG

SEQ ID NO: 5052 - protein, 487 aa, Zea mays
MKSSSVPRPSALDLLFTSVSATTVSSMIAVEMESFSNAQLLLMTLLMLLGGEVFTSMLGLHFTCTKLRNKRETPHNNLHGNSLEQSRRRHRPMEMEAQAAAVQMELAGFNKDGHGDFASMARLLMFIVLGYILVVHIAGYALILIYLSVVGSARAVLVRKRISLSTFSVFTVVSSFANCGFVPTNEGMVSFKSFPGMLLLVMPHILLGNTLFPIFLRLSITALERVTRWRDLCELLRDRGPGGGPAAAAAAAAIGYDHLLPGPRTWFLALTVAVFLAVQLVLYCAMEWGSGGLGGLNAFQKLVAAVFMSVNSRHSGEMVVDLATVSSAVVVLYVLMMYLPPYTTFLPVAVEDDQQQQNEAQPHDNSTSKSSTSISIWHNLLMSPLSCLTIFIVVICITERRQIARDPINFSVLNIVVEVISAYGNVGFSTGYSCSRQVTPGGGCCKDAWVSLSGKWSVEGKLTLMAIMFYGRLKKFSMLGGQAWRLN

SEQ ID NO: 5053 - protein, 178 aa, Sorghum bicolor
MQFFGGSSLTSVAPEATPAPAAPPGTGTGASAQVLYVFNRNGVCLLYREWHRPLRTLDPTQDHKLMFGLLFSLRSFTAKIDPTTAEKGNLGVPLLPGQGCSFYSFKTNTYKLNFMESPSGIKLILITHPRTGDQRDSLKHIYNLYVEYVVKNPLYAPGTPIKCELFNKHLDQYVRTLI

SEQ ID NO: 5054 - protein, 178 aa, Zea mays
MQFFGGSSLTSIAPEATPAPAAPPGTGTGASAQVLYVFNRNGVCLLYREWHRPLRTLDPTQDHKLMFGLLFSLRSFTAKIDPTTAEKGNLGVPLLPGQGCSFYSFKTNTYKLNFMESPSGIKLILITHPRTGDQRDSLKHIYNLYVEYVVKNPLYAPGTPIKCELFNKHLDQYVKTLI

SEQ ID NO: 5055 - protein, 178 aa, Panicum virgatum
MQFFGGSSLTSVAPEASPAPAAPPGTGTGANAQVLYVFNRNGVCLLYREWHRPLRTLDPTQDHKLMFGLLFSLRSFTAKIDPTTAEKGNLGVPLLPGQGRSFYSFKTNTYKLNFMESPSGIKLILITHPRTGDQRDSLKHIYNLYVEYVVKNPLYAPGTPIKCELFNKHLDQYVRTLI

SEQ ID NO: 5056 - protein, 178 aa, Setaria italica
MQFFGGSSLTSVAPDASPAPAAPPGTGTGANAQVLYVFNRNGVCLLYREWHRPLRTLDPTQDHKLMFGLLFSLRSFTAKIDPTTAEKGNLGVPLLPGQGCSFYSFKTNTYKLNFMESPSGIKLILITHPRTGDQRDSLKHIYNLYVEYVVKNPLYAPATPIKCELFNKHLDQYVRTLI

SEQ ID NO: 5057 - protein, 175 aa, Echinochloa colona
MQFFGGSSVAPEASPAPAAPPGTGTGANAQVLYVFNRNGVCLLYREWHRPLRTLDPTQDHKLMFGLLFSLRSFTAKIDPTTAEKGNLGVPLLPGQGCSFYSFKTNTYKLNFMESPSGIKLILITHPRTGDQRDSLKHIYNLYVEYVVKNPLYAPGTPIKCELFNKHLDQYVRTLI

SEQ ID NO: 5058 - protein, 111 aa, Saccharum officinarum
MQFFGGSSLTSVAPEATPAPAAPPGTGTGASAQVLYVFNRNGVCLLYREWHRPLRTLDPTQDHKLMFGLLFSLRSFTAKIDPTRLKREILAWHYCQAKVVRFIASRQTHTN

SEQ ID NO: 5059 - protein, 173 aa, Echinochloa colona
GSSLTSVAPEASPAPAAPPGTGTGANAQVLYVFNRNGVCLLYREWHRPLRTLDPTQDHKLMFGLLFSLRSFTAKIDPTTAEKGNLGVPLLPGQGCSFYSFKTNTYKLNFMESPSGIKLILITHPRTGDQRDSLKHIYNLYVEYVVKNPLYAPGTPIKCELFNKHLDQYVRTLI

SEQ ID NO: 5060 - protein, 179 aa, Oryza sativa
MFSFGGGSSLTSVVPDATPAPAAPPGTGTGANAQVLYVFNRGGVCLLYREWHRPLRTLDPTQDQKLMFGLLFSLRSFTAKIDPTTAEKGNLGVPLLPGQGCSFYSFKTNTYKLNFLESPSGIKLILITHPRTGDQRDTLKHIYNLYVEYVVKNPLYAPGTPIKCELFNKHLDQYVKTLI

SEQ ID NO: 5061 - protein, 167 aa, Pennisetum glaucum
VAPDASPAPAAPPGTGTGANAQVLYVFNRNGVCLLYREWHRPLRTLDPTQDHKLMFGLLFSLRSFTAKIDPTTAEKGNLGVPLLPGQGCSFYSFKTNTYKLNFMESPAGIKLILITHPRTGDQRDSLKHIYNLYVEYVVKNPLYAPGTPIKCELFNKHLDQYVRTLI

SEQ ID NO: 5062 - protein, 162 aa, Panicum virgatum
MQFFGGSSLTSVAPEASPAPAAPPGTGTGANAQVLYVFNRNGVCLLYREWHRPLRTLDPTQDHKLMFGLLFSLRSFTAKIDPTAAEKGNLGVPLLPGQGCSFYSFKTNTYKLNFMESPSGIKLILITHPRTGGQRDSLKHIYNLYVEYVVKNPLYAPGTPIK

SEQ ID NO: 5063 - protein, 178 aa, Brachypodium distachyon
MQFFGGSSLTSVAPEASPAPAAPPGTGTGANAQVIYVFNRNGVCLLYREWHRPLRTLARNQDQKLMFGLLFSLRSFTAKIDPTSTEHGNLGAPLLPGQGCSFHSFKTNTYKLNYMESPSGIKLILLTHPRTGDQRDALKQIYSLYVEYVVKNPLYAPGSPIKCDLFNKHLDQYVKTLI

SEQ ID NO: 5064 - protein, 178 aa, Secale cereale
MQFFGGSSLTSVAPESSPAPAAPPGTGTGSNAQVIYVFNRNGVCLLYREWHRPLRTLARNQDQKLMFGLLFSLRSFTAKIDPTSTEHANLGAPLLPGQGCSFHSFKTNTYKLNYMESPSGIKLILLTHPRTGDQRDALKHIYSLYVEYVVKNPLYAPGSPIKCDLFNKHLDQYVKTLI

SEQ ID NO: 5065 - protein, 178 aa, Avena sativa
MQFFSGSSLTSVAPDSTPAPAAPPGTGTGANAQLIYIFNRNGVCLLYREWHRPLRTLARNQDQKLMFGLLFSLRSFTAKIDPTSTENGNLGAPLLPGQGCSFHSFKTNTYKLNYMESPSGIKLILLTHPRTGDQRDVLKHIYSLYVEYVVKNPLYTPGSPIKCELFNKHLDQYVKTLI

SEQ ID NO: 5066 - protein, 178 aa, Avena sativa
MQFFSGSSLTSVAPDSTPAPAAPPGTGTGANAQLIYIFNRNGVCLLYREWHRPLRTLARNQDQKLMFGLLFSLRSFTAKIDPTSTENGNLGAPLLPGQGCSFHSFKTNTYKLNYMESPSGIKLILLTHPRTGDQRDALKHIYSLYVEYVVKNPLYTPGSPIKCELFNKHLDQYVKTLI

SEQ ID NO: 5067 - protein, 178 aa, Lolium multiflorum
MQFFSGSSLTSVAPDSSPAPAAPPGTGTGANAQLIYIFNRNGVCLLYREWHRPLRTLARNQDQKLMFGLLFSLRSFTAKIDPTSTENGNLGAPLLPGQGCSFHSFKTNTYKLNYMESPSGIKLILLTHPRTGDQRDALKHIYSLYVEYVVKNPLYAPGSPIKCELFNKHLDQYVKTLI

SEQ ID NO: 5068 - protein, 178 aa, Triticum aestivum
MQFFGGSSLTSVAPDSSPAPAAPPGTGTGSNAQVIYVFNRNGVCLLYREWHRPLRTLARNQDQKLMFGLLFSLRSFTAKIDPTSTEHANLGAPLLPGQGCSFHSFKTNTYKLNYMESPSGIKLILLTHPRTGDQRDALKHIYSLYVEYVVKNPLYAPGSPIKCDLFNKHLDQYVKTLI

SEQ ID NO: 5069 - protein, 156 aa, Panicum virgatum
MQFFGGSSLTSVAPEASPAPAAPPGTGTGANAQVLYVFNRNGVCLLYREWHRPLRTLDPTQDHKLMFGLLFSLRSFTTKIDPTTAEMGNLGVPLLPGQGCSFYSFKTNTYKLNFMESPSGIKLILITHPRTGDQRDSLKHIYNLYVEYVVKNPLYA

SEQ ID NO: 5070 - protein, 149 aa, Echinochloa colona
ANAQVLYVFNRNGVCLLYREWHRPLRTLDPTQDHKLMFGLLFSLRSFTAKIDPTTAEKGNLGVPLLPGQGCSFYSFKTNTYKLNFMESPSGIKLILITHPRTGDQRDSLKHIYNLYVEYVVKNPLYAPGTPIKCELFNKHLDQYVRTLI

SEQ ID NO: 5071 - protein, 194 aa, Pennisetum glaucum
  Sequence also found in Organisms: Setaria italica, Panicum virgatum
MIGVGKAKQYANVLDKPLSRGRQEVSLSAFAFLFSELVQYNQTQVDNIAELERRLEDAGYAVGARVLELLCHREKGNRRETRLLGILSFIHSTVWKVLFGKVADSLEKGTEHEDEYMISEKELLVNRFISVPKDMGAFNCGAFVAGIVKGVLDNAGFPAVVTAHFVPIEGQQRPRTTILIKFAEEVLHREARLG

SEQ ID NO: 5072 - protein, 194 aa, Sorghum bicolor
MIGVGKAKQYANVLDKPLSRGRQEVSLSAFAFLFSELVQYNQTQVDNITELERRLEDAGYAVGARVLELLCHREKGNRRETRLLGILSFIHSTVWKVLFGKVADSLEKGTEHEDEYMISEKELLVNRFISVPKDMGAFNCGAFVAGIVKGVLENAGFPAVVTAHFVPIEGQQRPRTTILIKFAEEVLHREARLG

SEQ ID NO: 5073 - protein, 194 aa, Saccharum officinarum
MIGVGKAKQYANVLDKPLSRGKQEVSLSAFAFLFSELVQYNQTQVDNITELERRLEDAGYAVGARVLELLCHREKGNRRETRLLGILSFIHSTVWKVLFGKVADSLEKGTEHEDEYMISEKELLVNRFISVPKDMGAFNCGAFVAGIVKGVLDNAGFPAVVTAHFVPIEGQQRPRTTILIKFAEEVLHREARLG

SEQ ID NO: 5074 - protein, 194 aa, Brachypodium distachyon
MIGVGKAKQYANVLDKPLSRGRQEVSLSAFAFLFSELVQYNQTQVDNIAELERRLEDAGYAVGARVLELLCHREKGNRRETRLLGILSFIHSTVWKVLFGKVADSLEKGTEHEDEYMISEKELLVNRFISVPKDMGAFNCGAFVAGIVRGVLDNAGFPAVVTAHFVPIEGQQRPRTTILIKFAEEVLHREARLG

SEQ ID NO: 5075 - protein, 194 aa, Sorghum bicolor
MIGVGKVKQYANVLDKPLSRGRQEVSLSAFAFLFSELVQYNQTQVDNITELERRLEDAGYAVGARVLELLCHREKGNRRETRLLGILSFIHSTVWKVLFGKVADSLEKGTEHEDEYMISEKELLVNRFISVPKDMGAFNCGAFVAGIVKGVLDNAGFPAVVTAHFVPIEGQQRPRTTILIKFSEEVLHREARLG

SEQ ID NO: 5076 - protein, 194 aa, Saccharum officinarum
MIGVGKAKQYANVLDKPLSRGRQEVSLSAFAFLFSEMVQYNQTQVDNITELEQRLEDAGYAVGARVLELLCHREKGNRRETRLLGILSFIHSTVWKVLFGKVADSLEKGTEHEDEYMISEKELLVNRFISVPKDMGAFNCGAFVAGIVKGVLDNAGFPAVVTAHFVPIEGQQRPRTTILIKFAEEVLHREARLG

SEQ ID NO: 5077 - protein, 194 aa, Panicum virgatum
MIGVGKAKQYANVLDKPLSRGRQEVSLSAFAFLFSELVQYNQTQVDNIAELERRLEDAGYAVGARVLELLCHREKGNKRETRLLGILSFIHSTVWKVLFGKVADSLEKGTEHEDEYMISEKELLVNRFISVPKDMGAFNCGAFVAGIVKGVLDNAGFPAVVTAHFVPIEGQQRPRTTILIKFAEEVLHREARLG

SEQ ID NO: 5078 - protein, 194 aa, Festuca arundinacea
  Sequence also found in Organisms: Lolium multiflorum, Avena sativa
MIGVGKAKQYANVLDKPLSRGRQEVSLSAFAFLFSEVVQYNQTQVDNIAELERRLEDAGYAVGARVLELLCHREKGNRRETRLLGILSFIHSTVWKVLFGKVADSLEKGTEHEDEYMISEKELLVNRFISVPKDMGAFNCGAFVAGIVRGVLDNAGFPAVVTAHFVPIEGQQRPRTTILIKFAEEVLHREARLG

SEQ ID NO: 5079 - protein, 194 aa, Ananas comosus
MIGVGKAKQYANVLDKPLSRGRQEVSLSAFAFLFSELVQYNQTQVDNIAELERRLEDAGYAVGARVLELLCHREKGNRRETRLLGILSFIHSTVWKVLFGKVADSLEKGTEHEDEYMISEKELLVNRFISVPKDMGAFNCGAFVAGIVRGVLDSAGFPAVVTAHFVPIEGQQRPRTTILIKFAEEVLRREARLG

SEQ ID NO: 5080 - protein, 194 aa, Cynodon dactylon
MIGVGKAKQYASVLDKPLSRGRQEVSLSAFAFLFSELVQYNQTQVDNIAELERRLEDAGYAVGARVLELLCHREKGNRRETRLLGILSFIHSTVWKVLFGKVADSLEKGTEHEDEYMISEKELLVNRFISVPKDMGAFNCGAFVAGIVKGVLDNSGFPAVVTAHFVPIEGQHRPRTTILIKFAEEVLHREARLG

SEQ ID NO: 5081 - protein, 194 aa, Avena sativa
MIGVGKAKQYANVLDKPLSRGKQEVSLSAFAFLFSEVVQYNQTQVDNIAELERRLEDAGYAVGARVLELLCHREKGNRRETRLLGILSFIHSTVWKVLFGKVADSLEKGTEHEDEYMISEKELLVNRFISVPKDMGAFNCGAFVAGIVRGVLDNAGFPAVVTAHFVPIEGQQRPRTTILIKFAEEVLHREARLG

SEQ ID NO: 5082 - protein, 168 aa, Secale cereale
MIGVGKAKQYANVLDKPLGRGRQEVSLSAFAFLFSELVQYNQTQVDNIAELERRLEDAGYAVGARVLELLCHREKGNRRETRLLGILSFIHSTVWKVLFGKVADSLEKGTEHEDEYMISEKELLVNRFISVPKDMGAFNCGAFVAGSCKGRTGQCWLSRGGDGAFCAN

SEQ ID NO: 5083 - protein, 194 aa, Hordeum vulgare
  Sequence also found in Organisms: Secale cereale
MIGVGKAKQYANVLDKPLGRGRQEVSLSAFAFLFSEVVQYNQTQVDNIAELERRLEDAGYAVGARVLELLCHREKGNRRETRLLGILSFIHSTVWKVLFGKVADSLEKGTEHEDEYMISEKELLVNRFISVPKDMGAFNCGAFVAGIVRGVLDNAGFPAVVTAHFVPIEGQQRPRTTILIKFAEEVIHREARLG

SEQ ID NO: 5084 - protein, 194 aa, Pseudoroegneria spicata
MISVGKAKQYANVLDKPLSRGRQEVSLSAFAFLFSELVQYNQTQVDNIAELERRLEDAGYAVGARVLELLCHREKGNRRETRLLGILSFIHSTVWKVLFGKVADSLEKGTEHEDEYMISDKELLVNRFISVPKDMGAFNCGAFVAGIVRGVLDNAGFPAVVTAHFVPIEGQQRPRTTILIKFAEEVIHREARLG

SEQ ID NO: 5085 - protein, 194 aa, Oryza sativa
MIGVGKAKQYANVLDKPLSRGRQEVSLSAFAFLFSELVQYNQTQVDNIAELERRLEDAGYAVGARVLELLCHREKGNRRETRLLGILSFIHSTVWKVLFGKVADSLEKGTEHEDEYMISEKELLVNRFISVPKDMGAFNCGAFVAGIVRGVLENAGFPAVVTAHFVPIEGQQRPRTTILIKFAEEVLQREARFG

SEQ ID NO: 5086 - protein, 194 aa, Secale cereale
MIGVGKAKQYANVLDKPLGRGRQEVSLSAFAFLFSELVQYNQTQVDNIAELERRLEDAGYAVGARVLELLCHREKGNRRETRLLGILSFIHSTVWKVLFGKVADSLEKGTEHEDEYMISEKELLVNRFISVPKDMGAFNCGAFVAGIVRGVLDNAGFPAVVTSHFVPIEGQQRPRTTILIKFAEEVIHREARLG

SEQ ID NO: 5087 - protein, 194 aa, Triticum aestivum
MISVGKTKQYANVLDKPLSRGRQEVSLSAFAFLFSELVQYNQTQVDNIAELERRLEDAGYAVGARVLELLCHREKGNRRETRLLGILSFIHSTVWKVLFGKVADSLEKGTEHEDEYMISEKELLVNRFISVPKDMGAFNCGAFVAGIVRGVLDNAGFPAVVTAHFVPIEGQQRPRTTILIKFAEEVLRRESRLG

SEQ ID NO: 5088 - protein, 194 aa, Musa acuminata
MIGVGKIKQYANVLEKPLSRGRQEVSLSAFAFLFSELVQYNQTQVDNIAELERRLEDAGYAVGARVLELLCHREKGNRRETRLLGILSFVHSTVWKVLFGKVADSLEKGTEHEDEYMISEKELLVNRFISIPKDMGAFNCGAFVAGIVKGVLDNAGFPAVVTAHFVPMEGQQRPRTTILIKFAEEVLRREARLG

SEQ ID NO: 5089 - protein, 194 aa, Secale cereale
MISVGKTKQYANVLDKPLSRGRQEVSLSAFAFLFSELVQYNQTQVDNIADLERRLEDAGYAVGARVLELLCHREKGNRRETRLLGILSFIHSTVWKVLFGKVADSLEKGTEHEDEYMISEKELLVNRFISVPKDMGAFNCGAFVAGIVRGVLDNAGFPAVVTAHFVPIEGQQRPRTTILIKFAEEVLRRESRLG

SEQ ID NO: 5090 - protein, 194 aa, Triticum aestivum
MIGVGKAKQYANVLDKPLGRGRQEVSLSAFAFLFSEVVQYNQTQVDNIADLERRLEDAGYAVGARVLELLCHREKGNRRETRLLGILSFIHSTVWKVLFGKVADSLEKGTEHEDEYMISEKELLVNRFISVPKDMGAFNCGAFVAGIVRGVLDNAGFPAVVTAHFVPIEGQQRPRTTILIKFAQEVIHREARLG

SEQ ID NO: 5091 - protein, 194 aa, Triticum aestivum
MISVGKTKQYANVLDKPLSRGRQEVSLSAFAFLFSEVVQYNQTQVDNIADLERRLEDAGYAVGARVLELLCHREKGNRRETRLLGILSFIHSNVWKVLFGKVADSLEKGTEHEDEYMISEKELLVNRFISVPKDMGAFNCGAFVAGIVRGVLDNAGFPAVVTAHFVPIEGQQRPRTTILIKFAEEVLRRESRLG

SEQ ID NO: 5092 - protein, 194 aa, Lippia dulcis
MIGVGKVKQYANVLDRPLSKGKQEVSLSAFAFLFSELVQYNQTQVDNIAELERRLEDAGYAVGARVLELLCHREKGNRRETRLLGILSFIHSTVWKVLFGKVADSLEKGTEHEDEYMISEKELLVNRFISIPKDMGAFNCGAFVAGIVRGVLDNAGFPAVVTAHFVPVDGQQRPRTTILIKFAEEVLQREARLG

SEQ ID NO: 5093 - protein, 78 aa, Centaurea maculosa
MISEKELLVNRFISVPKDMGTFNCGAFGAGIVRGVLDNAGFPAVVTAHFVPVEGQQRPRTTILIKFAEEVLRREARLG

SEQ ID NO: 5094 - protein, 194 aa, Cocos nucifera
  Sequence also found in Organisms: Elaeis guineensis
MIGAGKIKQYANVLDKPLSRGRQEVSLSAFAFLFSELVQYNQTRVDNIAELERRLEDAGYAVGARVLELLCHREKGNRRETRLLGILSFVHSTVWKVLFGKVADSLEKGTEHEDEYMISEKELLVNRFISIPKDMGTFNCGAFVAGIVKGVLDGAGFPAVVTAHFVPVEGQHRPRTTILIKFAEEVLQREARLG

SEQ ID NO: 5095 - protein, 194 aa, Manihot esculenta
MIGVGKVKQYSNVLDKPLSKGKQEVSLSAFAFLFSELVQYNQTQVDNIAELERRLEDAGYAVGARVLELLCHREKGNRRETRLLGILSFVHSTVWKVLFGKVADSLEKGTEHEDEYMISEKELLVNRFISIPKDMGTFNCGAFVAGIVRGVLDGAGFPAVVTAHFVPIEGQQRPRTTILIKFAEEVLRREARLG

SEQ ID NO: 5096 - protein, 194 aa, Centaurea maculosa
  Sequence also found in Organisms: Cirsium arvense
MIGAGKMKQYANVLDKPLSKGRQEVSLSAFAYLFSELVQYNQTQVDNIGDLERRLEDAGYAVGARVLELLCHREKGNRRETRLLGILSFIHSTVWKVLFGKVADSLEKGTEHEDEYMISEKELLVNRFISVPKDMGTFNCGAFGAGIVRGVLDNAGFPAVVTAHFVPVEGQQRPRTTILIKFAEEVLRREARLG

SEQ ID NO: 5097 - protein, 194 aa, Cynara scolymus
MIGAGKMKQYANVLDKPLSKGRQEVSLSAFAYLFSELVQYNQTQVDNIGDLERRLEDAGYAVGARVLELLCHREKGNRRETRLLGILSFIHSTVWKVLFGKVADSLEKGTEHEDEYMISEKELLVNRFISVPKDMGTFNCGAFAAGIVRGVLDNAGFPAVVTAHFVPVEGQQRPRTTILIKFAEEVLRREARLG

SEQ ID NO: 5098 - protein, 194 aa, Sesamum indicum
MIGVGKIKPYTNVLDRPLSKGKQEVSLSAFAFLFSELVQYNQTQVDNIAELERRLEDAGYAVGARVLELLCHREKGNRRETRLLGILSFIHSTVWKVLFGKVADSLEKGTEHEDEYMISEKELLVNRFISIPKDMGAFNCGAFVAGIVKGVLDNAGFPAVVTAHFVPVDGQQRPRTTILIKFAEEVLQREARLG

SEQ ID NO: 5099 - protein, 194 aa, Cichorium intybus
MIGVGKIKQYTNVLDKPLSKGRQEVSLSGFAYLFSELVQYNQTQVDNIGELERRLEDAGYAVGVRVLELLCHREKGNRRETRLLGILSFVHSTVWKVLFGKVADSLEKGTEHEDEYMISEKELLVNRFISVPKDMGSFNCGAFVAGIVKGVLDNAGFPAVVTAHFVPVDGQQRPRTTILIKFAEEVLRREARLG

SEQ ID NO: 5100 - protein, 184 aa, Echinochloa colona
MIGVGKAKQYANVLDKPLSRGRQEVSLSAFAFLFSELVQYNQTQVDNIAELERRLEDAGYAVGARVLELLCHREKGNRRETRLLGILSFIHSTVWKVLFGKVADSLEKGTEHEDEYMISEKELLVNRFISVPKDMGAFNCGAFVAGVVKGVLDNAGFPAVVTAHFVPIEGQQRPRTTILIKFAE

SEQ ID NO: 5101 - protein, 194 aa, Aristolochia fimbriata
MIGVGKIKQYTNVLDKPLSRGKQEVSLSAFAFLFSELVQYNQTQVDNIAELERRLEDAGYAVGARVLELLCHRDKGNRRETRLLGILSFVHSTVWKVLFGKVADSLEKGTEHEDEYMISEKELLVNRFISIPKDMGTFNCGAFVAGIVRGVLDSAGFPAVVTAHFVPMEGQQRPRTTILIKFAEEVLRREARLG

SEQ ID NO: 5102 - protein, 194 aa, Manihot esculenta
MIGVGKVKQYSNVLDKPLSKGKQEVSLSAFAFLFSELVQYNQTQVDNISELERRLEDAGYAVGARVLELLCHREKGNRRETRLLGILSFVHSTVWKVLFGKVADSLEKGTEHEDEYMISEKELLVNRFISIPKDMGTFNCGAFVAGIVRGVLDGAGFPAVVTAHFVPMEGQQRPRTTILIKFAEEVLRREARLG

SEQ ID NO: 5103 - protein, 194 aa, Euonymus alatus
MIGVGKIKQYSNVLDKPLSKGKQEVSLSAFAFLFSELVQYNQTQVDNISELERRLEDAGYAVGARVLELLCHRDKGNRRETRLLGILSFVHSTVWKVLFGKVADSLEKGTEHEDEYMISEKELLVNRFISIPKDMGTFNCGAFVAGIVKGVLDSAGFPAVVTAHFVPVEGQQRPRTTILIKFAEEVLVREARLG

SEQ ID NO: 5104 - protein, 195 aa, Euphorbia peplus
MIGVGKAKQYSNVLDKPLSKGKQEVSLSAFAFLFSELVQYNQTQVDNIAELERRLEDAGYAVGARVLELLCHREKGNRRETRLLGILSFVHSTVWKVLFGKVADSLEKGTEHEDEYMISEKELLVNRFISIPKDMGTFNCGAFVAGIVRGVLDGAGFPAVVTAHFVPMEGQQRPRTTILIKFAEEVLRREARLGG

SEQ ID NO: 5105 - protein, 194 aa, Zingiber officinale
MIGAGKIKHYANLLEKPLSRGRQEVSLSAFAFLFSELVQYNQTQVDNIAELERRLEDAGYAVGARVLELLCHREKGNRRETRLLGILSFVHSTVWKVLFGKVADSLEKGTEHEDEYMISEKELLVNRFISIPKDMGAFNCGAFVAGIVKGVLDSAGFPAVVTAHFVPMEGQQRPRTTILIKFAEEVLRREAKLG

SEQ ID NO: 5106 - protein, 194 aa, Humulus lupulus
MIGVGKAKQYSNVLDKPLSKGKQEVSLSAFAFLFSELVQYNQTQVDNIAELERRLEDAGYSVGARVLELLCHRDKGNRRETRLLGILSFVHSTVWKVLFGKVADSLEKGTEHEDEYMISEKELLVNRFISIPKDMGTFNCGAFVAGIVRGVLDSAGFPAVVTAHFVPIEGQQRPRTTILIKFAEEVLRREARLG

SEQ ID NO: 5107 - protein, 194 aa, Scabiosa columbaria
MIGVGKNKQYTNILDKPLSKGKQEVSLSAFAFLFSELVQYNQTQVDNIADLERRLEDAGYAVGARVLELLCHREKGNRRETRLLGILSFVHSTVWKVLFGKVADSLEKGTEHEDEYMISEKELLVNRFISIPKDMGTFNCGAFVAGIVRGVLDNAGFPAVVTAHFVPIEGQQRPRTTILIKFAEEVLRREARLG

SEQ ID NO: 5108 - protein, 194 aa, Daucus carota
MIGVGKTKQYANVLDRPISKGKQEVSLSAFAFLFSELVQYNQTQVDNIAELERRLEDAGYAVGARVLELLCHREKGNRRETRLLGILSFVHSTVWKVLFGKVADSLEKGTEHEDEYMISEKELLVNRFISVPKDMGTFNCGAFVAGIVRGVLDGAGFPAVVTAHFVPVDGQQRPRTTILIKFAEEVLVREARLG

SEQ ID NO: 5109 - protein, 194 aa, Ricinus communis
MIGVGKIKQYSNVLDKPLSKGKQEVSLSAFAFLFSELVQYNQTQVDNIAELERRLEDAGYAVGARVLELLCHREKGNRRETRLLGILSFVHTTVWKVLFGKVADSLEKGTEHEDEYMISEKELLVNRFISIPKDMGTFNCGAFVAGIVRGVLDSAGFPAVVTAHFVPMEGQQRPRTTILIKFAEEVLRREARLG

SEQ ID NO: 5110 - protein, 194 aa, Cichorium intybus
MIGVGKIKQYTNVLDKPLSKGRQEVSLSGFAYLFSELVQYNQTQVDNIGELERRLEDAGYAVGVRVLELLCHREKGNRRETRLLGILSFVHSTVWKVLFGKVADSLEKGTEHEDEYMISEKELLVNRFISVPKDMGSFNCGAFVAGIVRGVLDNAGFPAVVTAHFVPVDGQQRPRTTILIKFAEEVLRREARLG

SEQ ID NO: 5111 - protein, 194 aa, Petroselinum crispum
MIGVGKNKQYANILDRPISKGKQEVSLSAFAFLFSELVQYNQTQVDNIAELERRLEDAGYAVGARVLELLCHREKGNRRETRLLGILSFVHSTVWKVLFGKVADSLEKGTEHEDEYMISEKELLVNRFISVPKDMGTFNCGAFVAGIVRGVLDGAGFPAVVTAHFVPVEGQQRPRTTILIKFAEEVLVREARLG

SEQ ID NO: 5112 - protein, 194 aa, Ambrosia trifida
MIGAGKMKQYTNVLDKPLSKGRQEVSLSGFAYLFSELVQYNQTQVDNIGELERRLEDAGYAVGVRVLELLCHREKGNRRETRLLGILSFVHSTVWKVLFGKVADSLEKGTEHEDEYMISEKELLVNRFISVPKDMGSFNCGAFVAGIVKGVLDNAGFPAVVTAHFVPVDGQQRPRTTILIKFAEEVLRREARLG

SEQ ID NO: 5113 - protein, 195 aa, Brassica juncea
MIGVGKMKQYSNVLDKPLSKGKQEVSLSAFAFLFSELVQYNQTQVDNIAELERRLEDAGYAVGARVLELLCNREKGNRRETRLLGILSFVHSTVWKVLFGKVADSLEKGTEHEDEYMISEKELLVNRFISIPKDMGTFNCGAFVAGIVKGVLDNAGFPAVVTAHFVPIEGQQRPRTTILIKFADEVLKREARLSQ

SEQ ID NO: 5114 - protein, 194 aa, Fagus grandifolia
MIGVGKVKQYSNVLDKPLSKGKQEVSLSAFAFLFSELVQYNQTQVDNIAELERRLEDAGYAVGARVLELLCHRDKGNRRETRLLGILSFVHSTVWKVLFGKVADSLEKGTEHEDEYMISEKELLVNRFISIPKDMGTFNCGAFVAGIVRGVLDSAGFPAVVTAHFVPMEGQQRPRTTILIKFAEEVLRREARLG

SEQ ID NO: 5115 - protein, 194 aa, Citrus clementina
  Sequence also found in Organisms: Citrus sinensis
MIGVGKIKQYSNVLDKPLSKGKQEVSLSAFAFLFSELVQYNQTQVDNIAELERRLEDAGYAVGARVLELLCHRDKGNRRETRLLGILSFVHSTVWKVLFGKVADSLEKGTEHEDEYMISEKELLVNRFISIPKDMGTFNCGAFVAGIVRGVLDSAGFPAVVTAHFVPVEGQQRPRTTILIKFAEEVLRREARLG

SEQ ID NO: 5116 - protein, 194 aa, Vigna unguiculata
MIGVGKAKQYGNVLDKPLTRGKQEVSLSAFAFLFSELVQYNQTQVDNIGELERRLEDAGYAVGARVLELLCHRDKGNRRETRLLGILSFVHSTVWKVLFGKVADSLEKGTEHEDEYMISEKELLVNKFISIPKDMGTFNCGAFVAGIVRGVLDGAGFPAVVTAHFVPMEGQQRPRTTILIKFAEEVLQREARLG

SEQ ID NO: 5117 - protein, 194 aa, Cucumis sativus
MIGVGKIKQYSNVLEKPLSKGKQEVSLSAFAFLFSELVQYNQTQVDNIAELERRLEDAGYAVGARVLELFCHREKGNRRETRLLGILSFVHSTIWKVLFGKVADSLEKGTEHEDEYMISEKELLVNRFISIPKDMGAFNCGAFVAGIVRGVLDNAGFPAVVTAHFVPVEGQQRPRTTILIKFAEEVLAREARLG

SEQ ID NO: 5118 - protein, 194 aa, Cucurbita pepo
MIGVGKVKQYSNVLDRPLSKGKQEVSLSAFAFLFSELVQYNQTQVDNIAELERRLEDAGYAVGARVLELFCHREKGNRRETRLLGILSFVHSTIWKILFGKVADSLEKGTEHEDEYMISEKELLVNRFISIPKDMGAFNCGAFVAGIVKGVLDNAGFPAVVTAHFVPVEGQQRPRTTILIKFAEEVLAREARLG

SEQ ID NO: 5119 - protein, 194 aa, Eucalyptus grandis
MIGVGKAKQYSNVLDKPLSKGKQEVSLSAFSFLFSELVQYNQTQVDNIAELERRLEDAGYSVGARVLELLCHREKGNRRETRLLGILSFVHSTVWKVLFGKVADSLEKGTEHEDEYMISEKELLVNRFISIPKDMGTFNCGAFVAGIVRGVLDGAGFPAVVTAHFVPVEGQQRPRTTILIKFAEEVLRREARLG

SEQ ID NO: 5120 - protein, 194 aa, Flaveria ramosissima
MIGVGKMKQYTNVLDKPLSKGRQEVSLSGFAYLFSELVQYNQTQVDNIGELERRLEDAGYAVGVRVLELLCHREKGNRRETRLLGILSFVHSTVWKVLFGKVADSLEKGTEHEDEYMISEKELLVNRFISVPKDMGSFNCGAFVAGIVRGVLDNAGFPAVVTAHFVPVDGQQRPRTTILIKFAEEVLRREARLG

SEQ ID NO: 5121 - protein, 194 aa, Panax ginseng
MIGVGKIKQYTNVLDKPVSKGKQEVSLSAFAFLFSELVQYNQTQVDNIAELERRLEDAGYAVGARVLELLCHREKGNRRETRLLGILSFVHSTVWKVLFGKVADSLEKGTEHEDEYMISEKELLVNRFISIPKDMGTFNCGAFVAGIVRGVLDGAGFPAVVTAHFVPVEGQQRPRTTILIKFAEEVLRREARLG

SEQ ID NO: 5122 - protein, 194 aa, Ipomoea nil
MIGVGKIKQYTNVLDRPLSKGKQEVSLSAFAFLFSELVQYNQTQVDNIAELERRLEDAGYAVGARVLELLCHREKGNRRETRLLGILSFVHSTVWKVLFGKVADSLEKGTEHEDEYMISEKELLVNRFISIPKDMGAFNCGAFVAGIVRGVLDNAGFPAVVTAHFVPVEGQQRPRTTILIKFSDEVLRREARLG

SEQ ID NO: 5123 - protein, 194 aa, Mimulus guttatus
MIGVGKIKQYSNVLDRPISKGKQEVSLSAFAFLFSELVQYNQTQVDNIGELERRLEDAGYAVGARVLELLCHREKGNRRETRLLGILSFIHSTVWKVLFGKVADSLEKGTEHEDEYMISEKELLVNRFISIPKDMGAFNCGAFVAGIVRGVLYNAGFPAVVTAHFVPVDGQQRPRTTILIKFAEEVLQREARLG

SEQ ID NO: 5124 - protein, 194 aa, Quercus alba
MIGVGKIKQYSNVLDKPLSKGKQEVSLSAFAFLFSELVQYNQTQVDNIAELERRLEDAGYAVGARVLELLCHRDKGNRRETRLLGILSFVHSTVWKVLFGKVADSLEKGTEHEDEYMISEKELLVNRFISIPKDMGTFNCGAFVAGIVRGVLDSAGFPAVVTAHFVPMEGQQRPRTTILIKFAEEVLRREARLG

SEQ ID NO: 5125 - protein, 194 aa, Carica papaya
MIGVGKIKQYSNVLDKPLSKGKQEVSLSAFAFLFSELVQYNQTQVDNIAELERRLEDAGYAVGARVLELLCHREKGNRRETRLLGILSFVHSTVWKVLFGKAADSLEKGTEHEDEYMISEKELLVNRFISIPKDMGTFNCGAFVAGIVRGVLDGAGFPAVVTAHFVPMEGQQRPRTTILIKFAEEVLRREARLG

SEQ ID NO: 5126 - protein, 194 aa, Papaver somniferum
MIGVGKMKQYTNVLDKPLSKGKQEVSLSAFAFLFSELVQYNQTQVDNIAELERRLEDAGYAVGARVLELLCHRDKGNRRETRLLGILSFVHSTVWKVLFGKVADSLEKGTEHEDEYMISEKELLVNRFISVPKDMGTFNCGAFVAGIVRGVLDSAGFPAVVTAHFVPMEGQQRPRTTILIKFTEEVLRREARLG

SEQ ID NO: 5127 - protein, 194 aa, Prunus persica
  Sequence also found in Organisms: Prunus mume
MIGVGKIKQYSNVLDKPLSKGKQEVSLSAFAFLFSELVQYNQTQVDNIAELERRLEDAGYAVGARVLELLCHRDKGNRRETRLLGILSFVHSTVWKVLFGKVADSLEKGTEHEDEYMISEKELLVNRFISIPKDMGTFNCGAFVAGIVRGVLDGAGFPAVVTAHFVPVEGQQRPRTTILIKFAEEVLRREARLG

SEQ ID NO: 5128 - protein, 194 aa, Carthamus tinctorius
MIGAGKMKQYANVLDKPLSKGRQEVGLSAFAYLFSELVQYNQTQVDNIGDLERRLEDAGYAVGARVLELLCHREKGNRRETRLLGILSFIHSTVWKVLFGKVADSLETGTEHEDEYMISEKELLVNRFISVPKDMGTFNCGAFGAGIVRGVLDNAGFPAVVTAHFVPVEGQQRPRTTILIKFAEEVLRREARLG

SEQ ID NO: 5129 - protein, 194 aa, Sarracenia psittacina
MIGVGKIKQYPNVLDKPLSKGKQEVSLSAFAFLFSELVQYNQTQVDNIAELERRLEDAGYAVGARVLELLCHREKGNRKETRLLGILSFVHSTVWKVLFGKVADSLEKGTEHEDEYMISEKELLVNRFISIPKDMGTFNCGAFVAGIVRGVLDSAGFPAVVTAHFVPVEGQQRPRTTILIKFAEEVLRREARLG

SEQ ID NO: 5130 - protein, 194 aa, Triphysaria pusilla
MIGVGKMKQYSNVLDRPLGKGKQEVSLSAFAFLFSELVQYNQTQVDNIAELERRLEDAGYSVGARVLELLCHREKGNRRETRLLGILSFIHSTVWKVLFGKVADSLEKGTEHEDEYMISEKELLVNRFISIPKDMGAFNCGAFVAGVVKGVLDNAGFPAVVTAHFVPVDGQQRPRTTILIKFAEEVLQREARLG

SEQ ID NO: 5131 - protein, 194 aa, Tripterygium wilfordii
MIGVGKIKQYSNVLDKPLSKGKQEVSLSAFAFLFSELVQYNQTQVDNIAELERRLEDAGYAVGARVLELLCHRDKGNRRETRLLGILSFVHSTVWKVLFGKVADSLEKGTEHEDEYMISEKELLVNRFISIPKDMGTFNCGAFVAGIVRGVLDSAGFPAVVTAHFVPVEGQQRPRTTILIKFAEEVLVREARLG

SEQ ID NO: 5132 - protein, 194 aa, Valeriana officinalis
MIGVGKAKQYANILDKPLSKGKQEVSLSAFAFLFSELVQYNQTQVDNIAELERRLEDAGYAVGTRVLELLCHREKGNRRETRLLGILSFVHSTVWKVLFGKVADSLEKGTEHEDEYMISEKELLVNRFISIPKDMGTFNCGAFVAGVVRGVLDNAGFPAVVTAHFVPVDGQQRPRTTILIKFAEEVLRREARLG

SEQ ID NO: 5133 - protein, 194 aa, Citrullus lanatus
MIGVGKIKQYSNVLDRPLSKGKQEVSLSAFAFLFSELVQYNQTQVDNIAELERRLEDAGYAVGARVLELFCHREKGNRRETRLLGILSFVHSTIWKVLFGKVADSLEKGTEHEDEYMISEKELLVNRFISIPKDMGAFNCGAFVAGIVRGVLDNAGFPAVVTAHFVPVEGQQRPRTTILIKFAEEVLAREARLG

SEQ ID NO: 5134 - protein, 195 aa, Brassica napus
  Sequence also found in Organisms: Brassica oleracea, Brassica rapa, Raphanus sativus
MIGVGKMKQYSNVLDKPLSKGKQEVSLSAFAFLFSELVQYNQTQVDNIAELERRLEDAGYAVGSRVLELLCNREKGNRRETRLLGILSFVHSTVWKVLFGKVADSLEKGTEHEDEYMISEKELLVNRFISIPKDMGTFNCGAFVAGIVKGVLDNAGFPAVVTAHFVPIEGQQRPRTTILIKFADEVLKREARLSQ

SEQ ID NO: 5135 - protein, 195 aa, Brassica napus
  Sequence also found in Organisms: Brassica juncea, Brassica oleracea
MIGVGKMKLYSNVLDKPLSKGKQEVSLSAFAFLFSELVQYNQTQVDNIAELERRLEDAGYAVGARVLELLCNREKGNRRETRLLGILSFVHSTVWKVLFGKVADSLEKGTEHEDEYMISEKELLVNRFISIPKDMGTFNCGAFVAGIVKGVLDNAGFPAVVTAHFVPIEGQQRPRTTILIKFADEVLKREARLSQ

SEQ ID NO: 5136 - protein, 194 aa, Chrysanthemum coronarium
MIGAGKMKQYSNVVDKPLSKGRQEVSLSGFAFLFSELVQYNQTQVDNIGELERRLEDAGYAVGVRVLELLCHREKGNRRETRLLGILSFVHSTVWKVLFGKVADSLEKGTEHEDEYMISEKELLVNRFISVPKDMGSFNCGAFVAGIVRGVLDNAGFPAVVTAHFVPVDGQQRPRTTILIKFAEEVLRREARLG

SEQ ID NO: 5137 - protein, 194 aa, Chrysanthemum coronarium
MIGAGKMKQYSNVLDKPLSKGRQEVSLSGFAYLFSELVQYNQTQVDNIGELERRLEDAGYAVGVRVLELLCHREKGNRRETRLLGILSFVHSTVWKVLFGKVADSLEKGTEHEDEYMISEKELLVNRFISVPKDMGSFNCGAFVAGIVRGVLDNAGFPAVVTAHFVPVDGQQRPRTTILIKFAEEVLRREARLG

SEQ ID NO: 5138 - protein, 182 aa, Echinochloa colona
MIGVGKAKQYANVLDKPLSRGRQEVSLSAFAFLFSELVQYNQTQVDNIAELERRLEDAGYAVGARVLELLCHREKGNRRETRLLGILSFIHSTVWKVLFGKVADSLEKGTEHEDEYMISEKELLVNRFISVPKDMGAFNCGAFVAGVVKGVLDNAGFPAVVTAHFVPIEGQQRPRTTILIKF

SEQ ID NO: 5139 - protein, 195 aa, Allium cepa
MIGVGGKVKQYSNVLDKPLSKGRQEVSLSAFAFLFSEIVQYNQTQVDNISELERRLEDAGYAVGARVLELLCHRDKGNRRETRLLGILSFIHSTVWKVLFGKIADSLEKGTEHEDEYMISEKELLVNRFISIPKDMGTFNCGAFVAGIVKGVLDSAGFPAVVTAHFVPMEGQQRPRTTILIKFAEEVLVREARFG

SEQ ID NO: 5140 - protein, 194 aa, Malus domestica
MIGAGKIKQYSNVLDKPLSKGKQEVSLSAFAFLFSELVQFNQTQVDNIAELERRLEDAGYAVGARVLELLCHREKGNRRETRLLGILSFVHSTVWKVLFGKVADSLEKGTEHEDEYMISEKELLVNRFISIPKDMGTFNCGAFVAGIVRGVLDGAGFPAVVTAHFVPVEGQQRPRTTILIKFAEEVLRREARLG

SEQ ID NO: 5141 - protein, 195 aa, Arabidopsis lyrata
MIGVGKMKQYSNVLDKPLSKGKQEVSLTAFAFLFSELVQYNQTQVDNIAELERRLEDAGYAVGSRVLELLCNREKGNRRETRLLGILSFVHSTVWKVLFGKVADSLEKGTEHEDEYMISEKELLVNRFISIPKDMGTFNCGAFVAGIVKGVLDNAGFPAVVTAHFVPIEGQQRPRTTILIKFAEEVLKREARLSQ

SEQ ID NO: 5142 - protein, 195 aa, Brassica rapa
MIGVGKMKLYSNVLDKPLSKGKQEVSLSAFAFLFSELVQYNQTQVDNIAELERRLEDAGYAVGARVLELLCNREKGNRRETRLLGILSFVHSTVWKVLFGKVADSLEKGTEHEDEYMISEKELLVNRFISSPKDMGTFNCGAFVAGIVKGVLDNAGFPAVVTAHFVPIEGQQRPRTTILIKFADEVLKREARLSQ

SEQ ID NO: 5143 - protein, 194 aa, Vaccinium corymbosum
MIGVGKIKQYSNVLDKPLSKGKQEVSLSAFSFLFSELVQYNQTQVDNITELERRLEDAGYSVGARVLELLCHREKGNRRETRLLGILSFVHSTVWKVLFGKVADSLEKGTEHEDEYMISEKELLVNRFISIPKDMGTFNCGAFVAGIVRGVLDSAGFPAVVSAHFVPVEGQQRPRTTILIKFAEEVLRREARLG

SEQ ID NO: 5144 - protein, 194 aa, Theobroma cacao
MIGVGKIKQYSNVLDKPLSKGKQEVSLSAFAFLFSELVQYNQTQVDNIAELERRLEDAGYAVGARVLELLCHRDKGNRRETRLLGILSFVHSTVWKVLFGKVADSLEKGTEHEDEYMISEKELLVNKFISIPKDMGTFNCGAFVAGIVRGVLDSAGFPAVVTAHFVPMEGQQRPRTTILIKFAEEVLQREARLG

SEQ ID NO: 5145 - protein, 194 aa, Centaurea maculosa
MIGAGKMKQYTNVLDKPLSKGRQEVSLSGFAHLFSELVQYNQTQVDNIGELERRLEDAGYAVGVRVLELLCHREKGNRRETRLLGILSFVHSTVWKVLFGKVADSLEKGTEHEDEYMISEKELLVNRFISVPKDMGSFNCGAFVAGIVRGVLDNAGFPAVVTAHFVPVDGQQRPRTTILIKFAEEVLRREARLG

SEQ ID NO: 5146 - protein, 194 aa, Cichorium intybus
MIGVGKIKQYTNVLDKPLSKGRQEVSLSGFAYLFSELVQYNQTQVDNIGDLERRLEDAGYAVGVRVLELLCHREKGNRRETRLLGILSFVHSTVWKVLFGKVADSLEKGTEHEDEYMISEKELLVNRFISVPKDMGSFNCGAFVAGIVRGVLDNAGFPAVVTAHFVPVDGQQRPRTTILIKFAEEVLRREARLG

SEQ ID NO: 5147 - protein, 194 aa, Cirsium arvense
  Sequence also found in Organisms: Echinacea purpurea, Helianthus annuus
MIGAGKMKQYTNVLDKPLSKGRQEVSLSGFAYLFSELVQYNQTQVDNIGELERRLEDAGYAVGVRVLELLCHREKGNRRETRLLGILSFVHSTVWKVLFGKVADSLEKGTEHEDEYMISEKELLVNRFISVPKDMGSFNCGAFVAGIVRGVLDNAGFPAVVTAHFVPVDGQQRPRTTILIKFAEEVLRREARLG

SEQ ID NO: 5148 - protein, 194 aa, Solanum melongena
MIGVGKIKQYTNVLERPLSKGKQEVSLSAFAFLFSELVQYNQTQVDNITELERRLEDAGYAVGARILELLCHREKGNRRETRLLGILSFVHSTVWKVLFGKVADSLEKGTEHEDEYMISEKELLVNRFISIPKDMGAFNCGAFVAGIVRGVLDNAGFPAVVTAHFVPVEGQHRPRTTILIKFAEEVLRREATLG

SEQ ID NO: 5149 - protein, 194 aa, Panax ginseng
MIGVGKIKQYTNVLDKPVSKGKQEVSLSAFAFLFSELVQYNQTQVDNIAELERRLEDAGYAVGARVLELLCHREKGNRRETRLLGILSFVHSTVWKVLFGKVADSLEKGTEHEDEYMISEKELLVNRFISIPKDMGTFNCGAFAAGIVRGVLDGAGFPAVVTAHFVPVEGQQRPRTTILIKFAEEVLRREARLG

SEQ ID NO: 5150 - protein, 194 aa, Vitis vinifera
MIGVGKIKQYSNVLDKPLSKGKQEVSLSAFAFLFSELVQYNQAQVDNIAELERRLEDAGYAVGARVLELLCHRDKGNRRETRLLGILSFVHSTVWKVLFGKVADSLEKGTEHEDEYMISEKELLVNRFISIPKDMGTFNCGAFVAGIVRGVLDSAGFPAVVTAHFVPMEGQQRPRTTILIKFAEEVLRREARLG

SEQ ID NO: 5151 - protein, 194 aa, Carpinus betulus
MIGVGKIKQYTNVLDKPLSKGKQEVSLSAFAFLFSELVQYNQTQVDNIAELERRLEDAGYSVGARVLELLCHRDKGNRRETRLLGILSFVHSTVWKVLFGKVADSLEKGTEHEDEYMISEKELLVNRFISIPKDMGTFNCGAFVAGIVRGVLDSAGFPAVVTAHFVPMEGQQRPRTTILIKFAEEVLQREARLG

SEQ ID NO: 5152 - protein, 194 aa, Lippia dulcis
MIGVGKAKQYANVLDRPIGKGKQEVSLSAFAFLFSELVQYNQIQVDNIAELERRLEDAGYAVGARVLELLCHREKGNRREIRLLGILSFIHSTVWKVLFGKVADSLEKGTEHEDEYMISEKELLVNRFISIPKDMGAFNCGAFVAGIVRGVLDNAGFPAVVTAHFVPVDGQHRPRTTILIKFAEEVLQREARLG

SEQ ID NO: 5153 - protein, 194 aa, Plantago ovata
MIGVGKMKQYSNVLDKPMTKGKQEVSLSAFASLFSELVQYNQTQVDNIGELERRLEDAGYAVGVRVLELLCHREKGNRRETRLLGILSFIHSTVWKVLFGKVADSLEKGTEHEDEYMISEKELLVNRFISVPKDMGAFNCGAFVAGIVRGVLDNAGFPAVVTAHFVPVDGQHRPRTTILIKFAEEVLRREARLG

SEQ ID NO: 5154 - protein, 193 aa, Platanus occidentalis
IGVGKIKQYSNVLDKPLSKGKQEVSLSAFAFLFSELVQYNQTQVDNISELERRLEDAGYAVGARVLELLCHRDKGNRRETRLLGILSFVHSTVWKVLFGKVADSLEKGTEHEDEYMISEKELLVNRFISIPKDMGSFNCGAFVAGIVRGVLDSAGFPAVVTAHFVPMEGQQRPRTTILIKFAEEVLRREARLG

SEQ ID NO: 5155 - protein, 194 aa, Populus trichocarpa
MIGVGKIKQYSNVLEKPLSKGKQEVSLSAFAFLFSELVQYNQTQVDNIAELERRLEDAGYAVGARVLELLCHRDKGNRRETRLLGILSFVHSTVWKVLFGKVADSLEKGTEHEDEYMISEKELLVNRFISIPKDMGTFNCGAFVAGIVRGVLDSAGFPAVVTAHFVPMEGQQRPRTTILIKFAEEVLRREARLG

SEQ ID NO: 5156 - protein, 194 aa, Rosa hybrid cultivar
MIGVGKMKQYSNVLDRPLSKGKQEVSLSAFAFLFSELVQYNQTQVDNIAELERRLEDAGYAVGARVLELLCHRDKGNRRETRLLGILSFVHSTVWKVLFGKVADSLEKGTEHEDEYMISEKELLVNRFISIPKDMGTFNCGAFVAGIVRGVLDGAGFPAVVTAHFVPVEGQQRPRTTILIKFAEEVLRREARLG

SEQ ID NO: 5157 - protein, 194 aa, Tabernaemontana elegans
MIGVGKIKQYSNVLERPLSKGKQEVSLSAFAFLFSELVQYNQTQVDNIAELERRLEDAGYAVGARVLELLCHREKGNRRETRLLGILSFVHSTVWKVLFGKVADSLEKGTEHEDEYMISEKELLVNRFISIPKDMGTFNCGAFVAGIVRGVLDNAGFPAVVTAHFVPVDGQQRPRTTILIKFAEEVLRREARLG

SEQ ID NO: 5158 - protein, 195 aa, Eutrema halophilum
  Sequence also found in Organisms: Eutrema parvulum
MIGVGKMKQYSNVLDKPLSKGKQEVSLTAFAFLFSELVQYNQTQVDNIAELERRLEDAGYAVGARVLELLCNREKGNRRETRLLGILSFVHSTVWKVLFGKVADSLEKGTEHEDEYMISEKELLVNRFISIPKDMGTFNCGAFVAGIVKGVLDNAGFPAVVTAHFVPIEGQQRPRTTILIKFADEVLKREARLSQ

SEQ ID NO: 5159 - protein, 194 aa, Tripterygium wilfordii
MIGVGKIKQYSNVLDKPLSKGKQEVSLSAFAFLFSELVQYNQTQVDNISELERRLEDAGYAVGARVLELLCHRDKGNRREMRLLGILSFVHSTVWKVLFGKVADSLEKGTEHEDEYMISEKELLVNRFISIPKDMGTFNCGAFVAGIVRGVLDSAGFPAVVTAHFVPVEGQQRPRTTILIKFAEEVLVREARLG

SEQ ID NO: 5160 - protein, 194 aa, Vinca minor
MIGVGKIKQYSNVLEKPLSKGKQEVSLSAFAFLFSEMVQYNQTQVDNIAELERRLEDAGYAVGARVLELLCHREKGNRRETRLLGILSFVHSTVWKVLFGKVADSLEKGTEHEDEYMISEKELLVNRFISIPKDMGTFNCGAFVAGIVRGVLDNAGFPAVVTAHFVPVDGQQRPRTTILIKFAEEVLRREARLG

SEQ ID NO: 5161 - protein, 194 aa, Juglans hindsii x Juglans regia
MIGVGKIKQYSNVLDKPLAKGKQEVSLSAFAFLFSELVQYNQTQVDNIAELERRLEDAGYAVGARVLELLCHRDKGNRRETRLLGILSFVHSTVWKVLFGKVADSLEKGTEHEDEYMISEKELLVNRFISIPKDMGTFNCGAFVAGIVRGVLDSAGFPAVVTAHFVPMEGQQRPRTTILIKFAEEVLRREARLG

SEQ ID NO: 5162 - protein, 194 aa, Zostera marina
MIGAGRTKQYANVLDKPLSKGRQEVSLSAFSFLFSEIVQYNQTQVDNIAELERRLEDAGYAVGARVLELLCHREKGNRRETRLLGILSFVHSTVWKVLFGKVADSLEKGTEHEDEYMISENELLVNRFISVPKDMGAFNCGAFVAGIVKGVLDGAGFPAVVTAHFVPMEQQQRPRTTILIKFAEEVLRREAKLG

SEQ ID NO: 5163 - protein, 101 aa, Taraxacum officinale
MIGVGKIKQYTNVLDKPLSKGRQEVSLSGFAYLFSELVQYNQTQVDNIGELERRLEDAGYAVGVRVLELLCHREKGNRRETRLLGILSFYIAQCGRCYLEK

SEQ ID NO: 5164 - protein, 194 aa, Chrysanthemum coronarium
MIGAGKMKQYSNVLDKPLSKGRQEVSLSGFAYLFSELVQYNQTQVDNIGELERRLEDAGYAVGVRVLELLCHREKGNRRETRLLGILSFVHSTVWKVLFGKVADSLEKGTEHEDEYMISEKELLVNRFISVPKDMGSFNCGAFVAGIVRGVLDNAGFPAVVTAHFVPVDGQQRPRTTILIKFAEEVLRREARIG

SEQ ID NO: 5165 - protein, 194 aa, Chrysanthemum coronarium
MIGAGKMKQYSNVVDKPLSKGRQEVSLSGFAFLFSELVQYNQTQVDNIGELERRLEDAGYAVGVRVLELLCHREKGNRRETRLLGILSFVHSTVWKVLFGKVADSLEKGTEHEDEYMISEKELLVNRFISVPKDMGSFNCGAFVAGIVRGVLDNAGFPAVVTAHFVPVDGQQRPRTTILIKFAEEVLRREARIG

SEQ ID NO: 5166 - protein, 194 aa, Chrysanthemum coronarium
MIGAGKMKQYSNVVDKPLSKGRQEVSLSGFAYLFSELVQYNQTQVDNIGELERRLEDAGYAVGVRVLELLCHREKGNRRETRLLGILSFVHSTVWKVLFGKVADSLEKGTEHEDEYMISEKELLVNRFISVPKDMGSFNCGAFVAGIVRGVLDNAGFPAVVTAHFVPVDGQQRPRTTILIKFAEEVLRREARLG

SEQ ID NO: 5167 - protein, 194 aa, Amsonia hubrichtii
MIGVGKIKQYSNVLERPLSKGKQEVSLSAFAFLFSELVQYNQTQVDNIAELERRLEDAGYAVGARVLELLCHREKGNRRETRLLGILSFVHSTVWKVLFGKVADSLEKGTEHEDEYMISEKELLVNRFISIPKDMGTFNCGAFVAGIVRGVLDNAGFPAVVTAHFVPVDGQLRPRTTILIKFAEEVLRREARLG

SEQ ID NO: 5168 - protein, 195 aa, Arabidopsis thaliana
MIGVGKMKQYSNVLDKPLSKGKQEVSLTAFAFLFSELVQYNQTQVDNIAELERRLEDAGYAVGSRVLELLCNREKGNRRETRLLGILSFVHSTVWKVLFGKVADSLEKGTEHEDEYMISEKELLVNRFISIPKDMGTFNCGAFVAGIVKGVLDNAGFPAVVTAHFVPIEGQQRPRTTILIKFADEVLKREARLSQ

SEQ ID NO: 5169 - protein, 194 aa, Artemisia annua
MIGAGKMKQYSNVLDKPLSKGRQEVSFSGFAYLFSELVQYNQTQVDNIGELERRLEDAGYAVGVRVLELLCHREKGNRRETRLLGILSFVHSTVWKVLFGKVADSLEKGTEHEDEYMISEKELLVNRFISVPKDMGSFNCGAFVAGIVRGVLDNAGFPAVVTAHFVPVDGQQRPRTTILIKFAEEVLRREARLG

SEQ ID NO: 5170 - protein, 191 aa, Musa acuminata
MIGVGKIKQYTNVLDKPLSRGRQEVSLSAFAFLFSELVQYNQTQVDNIAELERRLEDAGYAVGARVLELLCHREKGNRRETRLLGILSFVHSTVWKVLFGKVADSLEKGTEHEDEYMISEKELLVNRFISVPKDMGAFNCGAFVAGIVKGVLDGAGFPAVVTAHFVPVDGQQRPRTTILIKFAEEVSNTLF

SEQ ID NO: 5171 - protein, 194 aa, Phaseolus vulgaris
MIGVGKVKQYGNVLDKPLNKGKQEVSLSAFAFLFSELVQYNQTQVDNIGELERRLEDAGYAVGARVLELLCHRDKGNRRETRLLGILSFVHSTVWKVLFGKVADSLEKGTEHEDEYMISEKELLVNKFISIPKDMGTFNCGAFVAGIVRGVLDGAGFPAVVTAHFVPMEGQQRPRTTILIKFAEEVLQREARLG

SEQ ID NO: 5172 - protein, 194 aa, Catharanthus roseus
MIGVGKIKQYSNVLERPLSKGKQEVSLSAFAFLFSELVQYNQTQVDNIAELERRLEDAGYAVGTRVLELLCHREKGNRRETRLLGILSFVHSTVWKVLFGKVADSLEKGTEHEDEYMISEKELLVNRFISIPKDMGTFNCGAFVAGIVRGVLDNAGFPAVVTAHFVPVDGQQRPRTTILIKFAEEVLRREARLG

SEQ ID NO: 5173 - protein, 194 aa, Cicer arietinum
MIGVGKIKQYGNVLDKPLAKGKQEVSLSAFAFLFSELVQYNQTQVDNIGELERRLEDAGYAVGARVLELLCHRDKGNRRETRLLGILSFVHSTVWKVLFGKVADSLEKGTEHEDEYMISEKELLVNKFISIPKDMGTFNCGAFVAGIVRGVLDGAGFPAVVTAHFVPMEGQQRPRTTILIKFAEEVLRREARLG

SEQ ID NO: 5174 - protein, 194 aa, Gossypium hirsutum
  Sequence also found in Organisms: Gossypium raimondii
MIGTGKIKQYANVLDKPLGKGKQEVSLSAFAFLFSELVQYNQTQVDNISELETRLEDAGYAVGARVLELLCHRDKGNRRETRLLGILSFVHSTVWKVLFGKVADSLEKGTEHEDEYMISEKELLVNRFISIPKDMGTFHCGAFVAGIVKGVLENAGFPAVVTAHFVPVEGQQRPRTTILIKFAEEVLRREARLG

SEQ ID NO: 5175 - protein, 194 aa, Linum usitatissimum
MIGASKIKQYSNVLDKPLSKGKQEVSLSAFAFLFSELVQYNQTQVDNIAELERRLEDAGYAVGARVLELLCHREKGNRRETRLLGILSFVHSTVWKVLFGKVADSLEKGTEHEDEYMISEKELLVNRFISIPKDMGTFNCGAFVAGIVRGVLDGAGFPAVVTAHFVPMEGQQRPRTTILIKFAEEVLRREARLV

SEQ ID NO: 5176 - protein, 194 aa, Fraxinus spp
MIGVGKMKQYTNVLDRPLSKGKQEVSLSGFAFLFSELVQYNQTQVDNIAELERRLEDAGYAVGTRILELLCHREKGNRRETRLLGILSFVHSTVWKVLFGKVADSLEKGTEHEDEYMISEKELLVNRFISIPKDMGAFNCGAFVAGIVRGVLDNAGFPAVVSAHFVPMEGQQRPRTTILIKFAEEVLQREARLG

SEQ ID NO: 5177 - protein, 194 aa, Mesembryanthemum crystallinum
MIGVGKIKQYSNVLEKPLSRGKQEVSLSAFAFLFSELVQYNQTQVDNIAELERRLEDAGYAVGARVLELLCHRDKGNRRETRLLGILSFVHSTLWKVLFGKVADSLEKGTEHEDEYMISEKELLVNRFISIPKDMGTFNCGAFVAGIVRGVLDSAGFPAVVTAHFVPVEGQLRPRTTILIKFAEEVLKREARLG

SEQ ID NO: 5178 - protein, 194 aa, Nicotiana benthamiana
MIGVGKMKQYTNVLERPLSKGKQEVSLSGFAFLFSELVQYNQTQVDNITELERRLEDAGYAVGARILELLCHREKGNRRETRLLGILSFVHSTVWKVLFGKVADSLEKGTEHEDEYMISEKELLVNRFISIPKDMGAFNCGAFVAGIVRGVLENAGFPAVVTAHFVPVEGQQRPRTTILIKFAEEVLRREAGLG

SEQ ID NO: 5179 - protein, 194 aa, Cajanus cajan
MIGVGKIKQYGNVLDKPLTKGKQEVSLSAFAFLFSELVQYNQTQVDNIGELERRLEDAGYAVGARVLELLCHRDKGNRRETRLLGILSFVHSTVWKVLFGKVADSLEKGTEHEDEYMISEKELLVNKFISIPKDMGTFNCGAFVAGIVRGVLDGAGFPAVVTAHFVPMEGQQRPRTTILIKFAEEVLRREARLG

SEQ ID NO: 5180 - protein, 194 aa, Chenopodium quinoa
MIGVGKIKQYSNVLDKPLSKGKQEVSLSAFAFLFSELVQYNQTQVDNIAELERRLEDAGYSVGARVLELLCHRDKGNRRETRLLGILSFVHSTVWKVLFGKVADSLEKGTEHEDEYMISEKELLVNRFISIPKDMGTFNCGAFVAGIVRGVLDSAGFPAVVTAHFVPVEGQLRPRTTILIKFAEEVLRREARLG

SEQ ID NO: 5181 - protein, 194 aa, Carthamus tinctorius
MTGAGKMKQYTNVLDKPLSKGRQEVSLSGFAYLFSELVQYNQTQVDNIGELERRLEDAGYAVGVRVLELLCHREKGNRRETRLLGILSFVHSTVWKVLFGKVADSLEKGTEHEDEYMISEKELLVNRFISVPKDMGSFNCGAFVAGIVRGVLDNAGFPAVVTAHFVPVDGQQRPRTTILIKFAEEVLRREARLG

SEQ ID NO: 5182 - protein, 194 aa, Glycine max
MIGVGKIKQYSNVLDKPLTKGKQEVSLSAFAFLFSELVQYNQTQVDNIGELERRLEDAGYAVGARVLELLCHRDKGNRRETRLLGILSFVHSTVWKVLFGKVADSLEKGTEHEDEYMISEKELLVNKFISIPKDMGTFNCGAFVAGIVRGVLDGAGFPAVVTAHFVPMEGQQRPRTTILIKFAEEVLQREARLG

SEQ ID NO: 5183 - protein, 194 aa, Nicotiana tabacum
MIGVGKIKQYTNVLERPLSKGKQEVSLSGFAFLFSELVQYNQTQVDNITELERRLEDAGFAVGARILELLCHREKGNRRETRLLGILSFVHSTVWKVLFGKVADSLEKGTEHEDEYMISEKELLVNRFISIPKDMGAFNCGAFVAGIVRGVLENAGFPAVVTAHFVPVEGQQRPRTTILIKFAEEVLRREARLG

SEQ ID NO: 5184 - protein, 194 aa, Trigonella foenum-graecum
MIGVGKVKQYGNVLDKPLNKGKTEVSLSAFAFLFSELVQYNQTQVDNIGELERRLEDAGYAVGARVLELLCHREKGNRRETRLLGILSFVHSTVWKVLFGKVADSLEKGTEHEDEYMISEKELLVNKFISIPKDMGTFNCGAFVAGIVRGVLDGAGFPAVVTAHFVPMEGQQRPRTTILIKFAEEVLLREARLG

SEQ ID NO: 5185 - protein, 116 aa, Cucumis melo
MIGVGKIKQYSNVLERPLSKGKQEVSLSAFAFLFSELVQYNQTQVDNIAELERRLEDAGYAVGARVLELFCHREKGNRRETRLLGILSFVHSTIWKVCLERLLTHLRKALNMKMST

SEQ ID NO: 5186 - protein, 146 aa, Tragopogon dubius
MIGAGKIKQYTNVLDKPLSKGRQEVSLSGFAYLFSELVQYNQTQVDNIGELERRLEDAGYAVGVRVLELLCHREKGNRRETRLLGILSFVHSTVWKVLFGKVADSLEKGTEHEDEYMISEKELLVNRFISVPKDMGSFNCGAFVAG

SEQ ID NO: 5187 - protein, 194 aa, Amaranthus tuberculatus
MIGAGKMKQYTNILDKPLSKGKQEVSLSAFAFLFSEIVQYNQTQVDNIAELERRLEDAGYAVGARVLELLCHREKGNRRETRLLGILSFVHSTVWKVLFGKVADSLEKGTEHEDEYMISEKELLVNRFISIPKDMGTFNCGAFVAGIVRGVLDGAGFPAVVTAHFVPMEGQMRPRTTILIKFAEEVLKREARLG

SEQ ID NO: 5188 - protein, 194 aa, Chrysanthemum coronarium
MIGAGKMKQYSNVVDKPLSKGRQEVSLSGFAYLFSELVQYNQTQVDNIGELERRLEDAGYAVGVRVLELLCHREKGNRRETRLLGILSFVHSTVWKVLFGKVADSLEKGTEHEDEYMISEKELLVNRFISVPKDMGSFNCGAFVAGIVRGVLDNAGFPAVVTAHFVPVDGQQRPRTTILIKFAEEVLRREARIG

SEQ ID NO: 5189 - protein, 194 aa, Chrysanthemum coronarium
MIGAGKMKQYSNVLDKPLSKGRQEVSLSGFAYLFSELVQYNQTQVDNIGELERRLEDAGYAVGVRVLELLCHREKGNKKETRLLGILSFVHSTVWKVLFGKVADSLEKGTEHEDEYMISEKELLVNRFISVPKDMGSFNCGAFVAGIVRGVLDNAGFPAVVTAHFVPVDGQQRPRTTILIKFAEEVLRREARLG

SEQ ID NO: 5190 - protein, 194 aa, Trifolium pratense
  Sequence also found in Organisms: Vicia sativa
MIGVGKIKQYGNVLDKPLNKGKTEVSLSAFAFLFSELVQYNQTQVDNIGELERRLEDAGYAVGARVLELLCHRDKGNRRETRLLGILSFVHSTVWKVLFGKVADSLEKGTEHEDEYMISEKELLVNKFISIPKDMGTFNCGAFVAGIVRGVLDGAGFPAVVTAHFVPMEGQQRPRTTILIKFAEEVLRREARLG

SEQ ID NO: 5191 - protein, 194 aa, Beta vulgaris
MIGVGKMKQYTNVLDKPVSKGKQEVSLSAFAFLFSEIVQYNQTQVDNIAELERRLEDAGYAVGARVLELLCHREKGNRRETRLLGILSFVHSTVWKVLFGKVADSLEKGTEHEDEYMISEKELLVNRFISIPKDMGTFNCGAFVAGIVRGVLDSAGFPAVVTAHFVPVEGLLRPRTTILIKFAEEVLKREARLG

SEQ ID NO: 5192 - protein, 194 aa, Lotus japonicus
MIGVGKMKQYSNVLDKPLTKGKQEVSLSAFAFLFSELVQYNQTQVDNIGELERRVEDAGYAVGARVLELLCHREKGNRRETRLLGILSFVHSTVWKVLFGKVADSLEKGTEHEDEYMISEKELLVNKFISIPKDMGTFNCGAFVAGIVRGVLDSAGFPAVVTAHFVPMEGQQRPRTTILIKFAEGVLRREARLG

SEQ ID NO: 5193 - protein, 194 aa, Lupinus angustifolius
MIGVGKMKQYGNVLDKPLNKGKQEVSLSAFAFLFSEMVQYNQTQVDNIGELERRLEDAGYAVGARVLELLCHRDKGNRRETRLLGILSFVHSTVWKVLFGKVADSLEKGTEHEDEYMISEKELLVNRFISIPKDMGTFNCGAFVAGIVRGVLDGAGFPAVVTAHFVPMEGQQRPRTTILIKFAEEVLLRETRLG

SEQ ID NO: 5194 - protein, 194 aa, Medicago truncatula
MIGVGKVKQYGNVLDKPLNKGKTEVSLSAFAFLFSELVQYNQTQVDNIGELERRLEDAGYAVGARVLELLCHRDKGNRRETRLLGILSFVHSTVWKVLFGKVADSLEKGTEHEDEYMISEKELLVNKFISIPKDMGTFNCGAFVAGIVRGVLDGAGFPAVVTAHFVPMEGQQRPRTTILIKFAEEVLLREARLG

SEQ ID NO: 5195 - protein, 194 aa, Olea europaea
MIGAGKMKQYTNVLDRPLSKGKQEVSLSGFAFLFSELVQYNQTQVDNIAELERRLEDAGYAVGTRILELLCHREKGNRRETRLLGILSFVHSTVWKVLFGKVADSLEKGTEHEDEYMISEKELLVNRFISIPKDMGAFNCGAFVAGIVRGVLDNAGFPAVVSAHFVPVEGQQRPRTTILIKFAEEVLQREARLG

SEQ ID NO: 5196 - protein, 194 aa, Orobanche aegyptiaca
MIGVGKIKQYTNVLDRPLGKGKQEVSLSAFAFLFSELVQYNQTQVDNIIELERRLEDAGYAVGARVLELLCHREKGNRRETRLLGILSFIHSTVWKALFGKVADSLEKGTEHEDEYMISEKELLVNRFISIPKDMGAFNCGAFVAGIVRGVLDNAGFPAVVTAHFVPVDGQHRSRTTILIKFADEVLQREARLG

SEQ ID NO: 5197 - protein, 195 aa, Phalaenopsis aphrodite
MIGVGGKIKQYSSVLDKPLSKGRQEVSLSAFAFLFSELVQYNQTQVDNIAELERRLEDAGYAVGARVLELFCHREKGNRRETRLLGILSFVHTTVWKVLFGKVADSLEKGTEHEDEYMISEKELLVNRFISIPKDMGAFNCGAFVAGIVRGVLDNAGFPAVVTAHFVPMEGQQRPRTTILIKFADEVLRREAKLV

SEQ ID NO: 5198 - protein, 194 aa, Populus trichocarpa
MIGVGKIKQYSNVLDKPLSKGKQEVSSSAFAFLFSELVQYNQTQVDNIAELERRLEDAGYAVGARVLELLCHRDKGNRRETRLLGILSFVHSTVWKVLFGKVADSLEKGTEHEDEYMISEKELLVNRFISIPKDMGTFNCGAFVAGIVRGVLDGAGFPAVVTAHFVPMEGQHRPRTTILIKFGEEVLRREARLG

SEQ ID NO: 5199 - protein, 194 aa, Solanum tuberosum
MISVGKIKQYSNVLERPLSKGKQEVSLSAFAFLFSELVQYNQTQVDNITELERRLEDAGYAVGARILELLCHREKGNRRETRLLGILSFVHSTVWKVLFGKVADSLEKGTEHEDEYMISEKELLVNRFISIPKDMGAFNCGAFVAGIVRGVLENAGFPAVVTAHFVPVEGQHRPRTTILIKFAEEVLRREATLG

SEQ ID NO: 5200 - protein, 194 aa, Glycine max
MIGVGKIKQYSNVLDKPLTKGKQEVSLSAFAFLFSELVQYNQTQVDNIGELERRLEDAGYAVGARVLELLCHRDKGNRRETRLLNILSFVHSTVWKVLFGKVADSLEKGTEHEDEYMISEKELLVNKFISIPKDMGTFNCGAFVAGIVRGVLDGAGFPAVVTAHFVPMEGQQRPRTTILIKFAEEVLRREARLG

SEQ ID NO: 5201 - protein, 190 aa, Castanea mollissima
GKIKQYSNVLDKPLSKGKQEVSLSAFAFLFSELVQYNQTQVDNIAELERRLEDAGYAVGARVLELLCHRDKGNRRETRLLGILSFVHSTVWKVLFGKVADSLEKGTEHEDEYMISEKELLVNRFISIPKDMGTFNCGAFVAGIVRGVLDSAGFPAVVTAHFVPMEGQQRPRTTILIKFAEEVLRREARLG

SEQ ID NO: 5202 - protein, 194 aa, Chrysanthemum coronarium
MIGAGKMKQYSNVVDKPLSKGRQEVSLSGFAYLFSELVQYNQTQVDNIGELERRLEDAGYAVGVRVLELLCHREKGNKKETRLLGILSFVHSTVWKVLFGKVADSLEKGTEHEDEYMISEKELLVNRFISVPKDMGSFNCGAFVAGIVRGVLDNAGFPAVVTAHFVPVDGQQRPRTTILIKFAEEVLRREARLG

SEQ ID NO: 5203 - protein, 194 aa, Cichorium intybus
MIGAGKIKQYTNVLDKPLNKGRHEVSLGAFAYLFSELVQYNQTQVDNIGELERRLEDAGYAVGTRVLELLCNREKGNRRETRLLGILSFIHSTVWKVLFGKVADSLEKGTEHEDEYMISEKELLVNRFISVPKDMGSFNCGAFVAGVVRGVLDNSGFPAVVTAHFVPVEGQQRPRTTILIKFAEEVLRREARLG

SEQ ID NO: 5204 - protein, 194 aa, Amborella trichopoda
MIGVGKVKQYTNVLDKPLSKGKQEVSLSAFAFLFSELVQYNQTQVDNIAELERRLEDAGYGVGVRVLELLCHRDKGNRRETRLLGILSFVHSTVWKVLFGKVADSLEKGTEHEDEYMISEKELLVNRFISIPKDMGTFNCGAFVAGIVRGVLDSAGFPATVSAHFVPMEGQQRPRTTILIKFAEEVLTREARLG

SEQ ID NO: 5205 - protein, 194 aa, Aquilegia formosa
MIGAGKAKQYANVVEKPLSKGKQEVSLSAFALLFSELVQYNQTQVDNIAELERRLEDAGYAVGARVLELLCHRDKGNRRETRLLGILSFVHSTVWKVLFGKVADSLEKGTEHEDEYMISEKELLVNRFISVPKDMGTFNCGAFAAGIVRGVLDGAGFPAVVTAHFVPVEGQLRPRTTILIKFAEEVLRREAKLG

SEQ ID NO: 5206 - protein, 192 aa, Centaurea maculosa
MIGKMKQYTNVLDKPLSKGRQEVSLSGFAYLFSELVQYNQTQVDNIGELERRLEDAGYAVGVRVLELLCHREKGNRRETRLLGILSFVHSTVWKVLFGKVADSLEKGTEHEDEYMISEKELLVNRFISVPKDMGSFNCGAFVAGIVRGVLDNAGFPAVVTAHFVPVDGQQRPRTTILIKFAEEVLRREARLG

SEQ ID NO: 5207 - protein, 189 aa, Chelidonium majus
KIKQYTNVLDKPLSKGKQEVSLSAFAFLFSELVQYNQTQVDNIAELERRLEDAGYAVGARVLELLCHRDKGNRRETRLLGILSFVHSTVWKVLFGKVADSLEKGTEHEDEYMISEKELLVNRFISVPKDMGTFNCGAFVAGIVRGVLDGAGFPAVVTAHFVPMEGQQRPRTTILIKFAEEVLRREARLG

SEQ ID NO: 5208 - protein, 191 aa, Guizotia abyssinica
MIGAGKMKQYANVLDKPLSKGRQEVSLSGFAYLFSELVQYNQTQVDNIGELERRLEDAGYAVGVRVLELLCHREKGNRRETRLLDILSFVHSTVWKVLFGKVADSLEKGTEHEDEYMISEKELLVNRFISVPKDMGSFNCGAFVAGIVRGVLDNAGFPAVVTAHFVPVDGQQRPRTTILIKFAEEVLRREA

SEQ ID NO: 5209 - protein, 194 aa, Heritiera littoralis
MIGVGKIKQYSNILDKPLSKGKQEVSLSAFAFLFSELVQYNQTQVDNIAELERRLEDAGYAVGARVLELLCHRDKGNRRETRLLGILSFVHSTVWKVLFGKVADSLEKGTEHEDEYMISEKELLVNKFISIPKDMGTFNCGAFVAGIVRGVLDNAGFPAVVTAHFVPMEGQQRPRAAILIKFAEEVLRREARIG

SEQ ID NO: 5210 - protein, 194 aa, Lactuca sativa
MIGAGKIKQYTNVLDKPLSKGKQEVSLGAFAYLFSELVQYNQTQVDNIGELEKRLEDAGYAVGTRVLELLCNREKGNRRETRLLGILSFIHSTVWKVLFGKVADSLEKGTEHEDEYMISEKELLVNRFISVPKDMGSFNCGAFVAGVVRGVLDNAGFPAVVTAHFVPVDGQQRPRTTILIKFAEEVLRREARLG

SEQ ID NO: 5211 - protein, 194 aa, Nicotiana benthamiana
MIGVGKMKQCTNVLERPLSKGKQEVSLSGFAFLFSELAQYNQTQVDNITELERRLEDAGYAVGARILELLCHREKGNRRETRLLGILSFVHSTVWKVLFGKVADSLEKGTEHEDEYMISEKELLVNRFISIPKDMGAFNCGSFVAGIVRGVLENAGFPAVVTAHFVPVEGQQRPRTTILIKFAEEVLRREARLG

SEQ ID NO: 5212 - protein, 194 aa, Solanum phureja
MISVGKIKQYSNVLERPLSKGKQEVSLSAFAFLFSELVQYNQTQVDNITELERRLEDAGYAVGARILELLCHREKGNRRETRLLGILSFVHSTVWKVLFGKVADSLEKGTEHEDEYMISEKELLVNRFISIPKDMGAFNCGAFVAGIVRGVLENAGFPAVVTAHFVPVEGQHRPRTTILIKFAEEVLRREATLV

SEQ ID NO: 5213 - protein, 194 aa, Solanum lycopersicum
MISVGKIKQYSNVLERPLSKGKQEVSLSAFAFLFSELVQYNQTQVDNITELERRLEDAGYAVGARILELLCHREKGNRRETRLLGILSFVHSTVWKVLFGKVADSLEKGTEHEDEYMISEKELLVNRFISIPKDMGAFNCGAFVAGIVRGVLENAGFPAVVTAHFVPVEGQHRPRTTILIKFAEEVLRREATLS

SEQ ID NO: 5214 - protein, 178 aa, Fagopyrum esculentum
MIGAGKMKQYSNILDKPLSKGKQEVSLSAFAFLFSELVQYNQTQVDNIAELERRLEDAGYAVGARVLELLCHRERGNRRETRLLGILSFVHSTVWKVLFGKVADSLEKGTEHEDEYMISEKELLVNKFISIPKDMGTFNCGAFVAGIVRGCWMVRDFLLLLQPILFLWMVNCDQGQPF

SEQ ID NO: 5215 - protein, 186 aa, Cirsium arvense
MIGAGKMKQYANVLDKPLSKGRQEVSLSAFAYLFSELVQYNQTQVDNIGDLERRLEDAGYAVGARVLELLCHREKGNRRETRLLGILSFIHSTVWKVLFGKVADSLEKGTEHEDEYMISEKELLVNRFISVPKDMGTFNCGAFAAGIVRGVLDNAGFPAVVTAHFVPVEGQQRPRTTILIKFAEEV

SEQ ID NO: 5216 - protein, 195 aa, Brassica oleracea
MIGVGKMKLYSNVLDKPLSKGKQEVSLSAFAFLFSELVQYNQTQVDNIADLERRLEDAGYAVGPRVLELLCNREKGNRRETRLLGILSFVHSTVWKVLFGKVADSLEKGTEHEDEYMISDKELLVNRFISIPKDMGTFNCGAFVAGIVKGLLDNAGFPAVVTAHFVPIEGQHRPRTTILIKFADEVLKREARLSQ

SEQ ID NO: 5217 - protein, 78 aa, Fagopyrum esculentum
MISEKEPLVNKFISIPKDMGTFNCGAFVAGIVRGVLDGAGFPAVVTAHFVPVDGQLRPRTTILIKFAEEVLIREARLG

SEQ ID NO: 5218 - protein, 188 aa, Centaurea maculosa
MKQYTNVLDKPLSKGRQEVSLSGFAYLFSELVQYNQTQVDNIGELERRLEDAGYAVGVRVLELLCHREKGNRRETRLLGILSFVHSTVWKVLFGKVADSLEKGTEHEDEYMISEKELLVNRFISVPKDMGSFNCGAFVAGIVRGVLDNAGFPAVVTAHFVPVDGQQRPRTTILIKFAEEVLRREARLG

SEQ ID NO: 5219 - protein, 194 aa, Tropaeolum majus
MIGVGKMKQYSNVLDKPVSKGKQEVSLSGFAFLFSELVQYNQTQVDNIAELERRLEDAGYSVGARVLELLCHREKGNRRETRLLGILSFVHSTVWKILFGKVADSLEKGTEHEDEYMISEKELLVNRFISIPKDMGTFNCGAFVAGIVRGVLESAGFPAIVTAHFVPMEGLQRPRTTILIKFAEEVLQREARLG

SEQ ID NO: 5220 - protein, 186 aa, Centaurea maculosa
QYTNVLDKPLSKGRQEVSLSGFAHLFSELVQYNQTQVDNIGELERRLEDAGYAVGVRVLELLCHREKGNRRETRLLGILSFVHSTVWKVLFGKVADSLEKGTEHEDEYMISEKELLVNRFISVPKDMGSFNCGAFVAGIVRGVLDNAGFPAVVTAHFVPVDGQQRPRTTILIKFAEEVLRREARLG

SEQ ID NO: 5221 - protein, 186 aa, Castanea mollissima
MIGVGKIKQYSNVLDKPLSKGKQEVSLSAFAFLFSELVQYNQTQVDNIAELERRLEDAGYAVGARVLELLCHRDKGNRRETRLLGILSFVHSTVWKVLFGKVADSLEKGTEHEDEYMISEKELLVNRFISIPKDMGTFNCGAFVAGIVRGVLDSAGFPAVVTAHFVPMEGQQRPRTTILIKFAEEV

SEQ ID NO: 5222 - protein, 188 aa, Cleome spinosa
MKQYSNVLDKPVSKGKQEVSLSAFAFLFSELVQYNQTQVDNIAELERRLEDAGYAVGARVLELLCHREKGNRRETRLLGILSFVHSTVWKVLFGKVADSLEKGTEHEDEYMISEKELLVNRFISIPKDMGTFNCGAFAAGIVKGVLDGAGFPAVVTAHFVPIEGQQRPRTTILIKFSEEVLKREAGLG

SEQ ID NO: 5223 - protein, 194 aa, Gossypium hirsutum
  Sequence also found in Organisms: Gossypium raimondii
MIGVGKIKQYSNILEKPLSKGKQEVSLSAFAFLFSELVQYNQTRVDNIAELERRLEDAGYAVGARVLELLCHRDKGNRRETRLLGILSFVHSTVWKVLFGKVADSLEKGTEHEDEYMISEKDLLVNKYISIPKDMGTFNCGAFVAGIVRGVLDGAGFPAVVTAHFVPMEGLQRPRTTILIKFAEEVLQREARLG

SEQ ID NO: 5224 - protein, 186 aa, Arnica chamissonis
QYTNVLDKPLSKGRQEVSLSGFAYLFSELVQYNQTQVDNIGELERRLEDAGYAVGVRVLELLCHREKGNRRETRLLGILSFVHSTVWKVLFGKVADSLEKGTEHEDEYMISEKELLVNRFISVPKDMGSFNCGAFVAGVVRGVLDNAGFPAVVTAHFVPVDGQQRPRTTILIKFAEEVLRREARLG

SEQ ID NO: 5225 - protein, 194 aa, Gossypium hirsutum
MIGVGKIKQYSNILEKPLSKGKQEVSLSAFTFLFSELVQYNQTRVDNIAELERRLEDAGYAVGARVLELLCHRDKGNRRETRLLGILSFVHSTVWKVLFGKVADSLEKGTEHEDEYMISEKDLLVNKFISIPRDMGTFNCGAFVAGIVRGVLDGAGFPAVVTAHFVPMEGLQRPRTTILIKFAEEVLQREARLG

SEQ ID NO: 5226 - protein, 192 aa, Silene vulgaris
MMTKMKQYSNVLEKPLSKGKHEVSLSAFAFLFSELVQFNQTQVDNITELERRLEDAGYAVGARVLELLCHREKGNRRETRLLGILSFVHSTVWKVLFGKVADSLEKGTEHEDEYMISEKELLVNRFISIPKDMGTFNCGAFVAGIVRGVLDGAGFPAVVTAHFVPVEGQLRPRTTILIKFAEEVLRREARLV

SEQ ID NO: 5227 - protein, 188 aa, Utricularia gibba
TWQYSNVLDRPLGKGKQEVSLSAFAFLFSELVQYNQTQVDNITELERRLEDAGYAVGVRVLELLCHREKGNRRETRLLGILSFIHSTMWKVLFGKVADSLEKGTEHEDEYMISEKELLVNRFISIPKDMGAFNCGAFVAGIVRGVLDNSGFPAVVTAHFVPVDGQQRPRTTILIKFAEEVLQREARLG

SEQ ID NO: 5228 - protein, 193 aa, Cephalotaxus harringtonia
MIGVGRNKQYANVLDKPLGKGKQVSLNAFSFLFSELVQYNQTCVDNIAELERRLEDAGYGVGLRVLELLCHREKGNRRETRLLGILSFVHSTVWKSLFGKVADSLEKGTEHDDEYMISERELLVNRFISVPKDMGNFNCGAFVAGIVKGVLDGAGFPAVVTAHFVPVEGQPRPRTTILIKFAEEVLLREARLS

SEQ ID NO: 5229 - protein, 194 aa, Cryptomeria japonica
MIGVGRPKQYGNVLDKPLGKGKQEVSLNAFSFLFSELVQYNQTRVDNIAELERRLEDAGYGVGLRVLELLCHREKGNRRETRLLGILSFVHSTVWKSLFGKVADSLEKGTEHEDEYMISERELLVNRFISVPKDMGNFNCGAFVAGIVKGVLDGAGFPAVVTAHFVPVEGQPRPRTTILIKFADEVLQREARLS

SEQ ID NO: 5230 - protein, 194 aa, Taxus baccata
MIGVGRTKQYANVLDKPLGKGKQEVSLNAFSFLFSELVQYNQTRVDNIAELERRLEDAGYGVGLRVLELLCHREKGNRRETRLLGILSFVHSTVWKSLFGKVADSLEKGTEHEDEYMISERELLVNRFISVPKDMGNFNCGAFVAGVVKGVLDGAGFPAIVTAHFVPVEGQPRPRTTILIKFAEEVLQREARLS

SEQ ID NO: 5231 - protein, 78 aa, Amaranthus tuberculatus
MISEKELLVNRFISIPKDMGTFNCGAFVAGIVRGVLDNAGFPAVVTAHFVPVEGQLRPRTTILIKFADEVLKREARLG

SEQ ID NO: 5232 - protein, 201 aa, Eschscholzia californica
MIGVGKIKQYTNVLDKPISKGKQEVSLSAFAFLFSELVQYNQTQVDNIAELERRLEDAGYAVGARVLELLCHRDKGNRRETRLLGILSFVHSTVWKVLFGKVADSLEKGTEHEDEYMISEKELLVNRFISVPKDMGTFNCGAFVAGIVRGVLDSAGFPAVVTAHFVPMEGQQRPRTTILIKFAEEVLRREASIRLKVQQEN

SEQ ID NO: 5233 - protein, 228 aa, Pinus pinaster
MAVGGHFMEKLKQKWTAQEDEKWGASMERKERRDLIGVGRTKQYANALEKSLGKGKQEVSLNAFAFLFSELVQYNQTQVDNIAELERRLEDAGYGVGLRVLELLCHREKGNRRETRLLGILSFVHSTVWKSLFGKVADSLEKGTEHEDEYMISERELLVNRFISVPKDMGNFNCGAFVAGIVKGVLDGAGFPAVVSAHFVPVEGQPRPRTTILIKFSEEVLQREARLG

SEQ ID NO: 5234 - protein, 139 aa, Platanus occidentalis
QYTNVLDKPLSKGKQEVSLSAFSFLFSELVQYNQTQVDNISELERRLEDAGYAVGARVLELLCHRDKGNRRETRLLGILSFIHSTVWKVLFGKVADSLEKGTENEDEYMISEKSSWLIDLFPYQKTWEHLIAGHLLLEL

SEQ ID NO: 5235 - protein, 183 aa, Actinidia deliciosa
MIGVGKIKQYTNVLDKPLSKGNQEVSLSAFAFLFSELVQYNQTQVDNIPELERRLEDAGYAVGARVLELLCHREKGNRRETRLLGILSFVHSTVWKVLFGKVADSLEKGTEHEDEYMISEKELLVNRFISIPKDMGTFNCGAFVAGIVRGVLDGAGFPAVLTAHFVPAEGQQRPRTTILIKFA

SEQ ID NO: 5236 - protein, 193 aa, Podocarpus macrophillus
IRVGRTKQYANVLDKPLGKGKQEVSLNAFSFLFSELVQYNQTRVDNIAELERRLEDAGYGVGLRVLELLCYREKGNRRETRLLGILSFVHSTVWKSLFGKVADSLEKGTEHEDEYMISEKELLVNRFISVPKDMGNFNCGAFVAGIVKGVLDGAGFPAVVTAHFVPMEGQPRPRTTILIKFSEEVLQREARLS

SEQ ID NO: 5237 - protein, 194 aa, Picea glauca
MIGVGRTKQYANALEKSLGKGKQEVSLNAFAFLFSELVQYNQTRVDNIAELERRLEDAGYGVGLRVLELLCHREKGNRRETRLLGILSFVHSTVWKSLFGKVADSLEKGTEHEDEYMISERELLVNRFISVPKDMGNFNCGAFVAGIVKGVLDGAGFPAVVSAHFVPVEGQPRPRTTILIKFSEEVLQREARLG

SEQ ID NO: 5238 - protein, 200 aa, Lotus japonicus
MIGVGKMKQYSNILDKPLTKGKQEVSLSAFAFLFSELVQYNQTQVDNIGELERRLEDAGYAVGARVLELLCHREKGNRRETRLLGILSFVHSTVWKVLFGKGSSFIKISDSLEKGTEHEDEYMISEKELLVNKFISIPKDMGTFNCGAFVAGIVRGVLDSAGFPAVVTAHFVPMEGQQRPRMTILIKFAEEVLRREARLG

SEQ ID NO: 5239 - protein, 228 aa, Pinus taeda
MAVGGHFMEKLKQKWTAQEDEKWGASMERKERRDLIGVGRTKPYANALEKSLGKGKQEVSLNAFAFLFSELVQYNQTQVDNIAELERRLEDAGYGVGLRVLELLCHREKGNRRETRLLGILSFVHSTVWKSLFGKVADSLEKGTEHEDEYMISERELLVNRFISVPKDMGNFNCGAFVAGIVKGVLDGAGFPAVVSAHFVPVEGQPRPRTTILIKFSEEVLQREARLG

SEQ ID NO: 5240 - protein, 194 aa, Cedrus atlantica
MIGVGRTKQYANALEKSLSKGKQEVSLNAFSFLFSELVQYNQTRVDNIAELERRLEDAGYGVGLRVLELLCHREKGNRRETRLLGILSFVHSTVWKSLFGKVADSLEKGTEHEDEYMISERELLVNRFISVPKDMGNFNCGAFVAGIVKGVLDGAGFPAVVSAHFVPVEGQPRPRTTILIKFSEEVLKREARMG

SEQ ID NO: 5241 - protein, 183 aa, Parthenium argentatum
MIGAGKMKQYTNVLDKPLSKGRQEVSLSGFAYLFSELVQYNQTQVDNIGELERRLEDAGYAVGVRVLELLCHREKGNRRETRLLGILSFVHSTVWKVLFGKVADSLEKGTEHEDEYMISEKELLVNRFISVPKDMGSFNCGAFVAGIVRGVLDNAGFPAVVTAHFVPVDGQQRPRTTILIKFA

SEQ ID NO: 5242 - protein, 181 aa, Ocimum basilicum
MIGVGKMKQYPNVLDRPVGKGKQEVSLSAFAFLFSELVQYNQTQVDNIAELERRLEDAGYAVGARVLELLCHREKGNRRETRLLGILSFIHSTVWKVLFGKVADSLEKGTEHEDEYMISEKELLVNRFISIPKDMGAFNCGAFVAGIVRGVLDNAGFPAVVTAHFVPVDGQQRARTTILIK

SEQ ID NO: 5243 - protein, 194 aa, Gnetum gnemon
MIGVGRTKQYVHVLDRPLGKGKQEVSLNAFAFLFSELVQYSQTKVDNIAELEHRLEDAGYGVGLRVLELLCHREKGNRRETRLLGILSFVHSTVWKSLFGKVADSLEKGTENEDEYMISEKELLVNRFISVPKDMGNFNCGAFVAGIVKGVLDGAGFPAAVSAHFVPVEGQPRPRTTILIKFSEEVLQREARLG

SEQ ID NO: 5244 - protein, 116 aa, Abies balsamea
MIGVGRTKQYGNALEKSLGKGKQEVSLNAFAFLFSEIVQYNQTRVDNIAELERRLEDAGYGVGLRVLELLCHREKGNRRETRLLGILSFVHSTVWKSLFGKVADSLEKGRNMKMSI

SEQ ID NO: 5245 - protein, 193 aa, Nicotiana benthamiana
GKMKQYTNVLDRPLSKGKQEVSLSGFAFLFSELVQYNQTQVDNITQLETRLEDAGYAVGARILELLCHREKGNRRETRLLGILSFVHSTVWKVLFGKVADSLEKGTEHEDEYMISEKELLVNRFISIPKDMGAFNCGAFVAGIVRGVLENAGFQAVVTAHFVPVEGQQRPRTTILIKFAEEVVTFYTHIFTHY

SEQ ID NO: 5246 - protein, 78 aa, Phalaenopsis aphrodite
MISEKELLVNRFISIPKDMGAFNCGAFVAGIVRGVLDNAGFPAVVTAHFVPMEGQQRPRTTILIKFADEVLRREAKLV

SEQ ID NO: 5247 - protein, 201 aa, Pseudotsuga menziesii
ERKERRDTIGVGRTKQYANALEKSLGKGKQEVSLNAFAFLFSELVQYNQTRVDNIAELERRLEDAGYGVGLRVLELLCHREKGNRRETRLLGILSFVHSTVWKSLFGKVADSLEKGTEHEDEYMISERELLVNRFISVPKDMGNFNCGAFVAGIVKGVLDGAGFPAVVSAHFVPVEGQPRPRTTILIKFSEEVLQREARLS

SEQ ID NO: 5248 - protein, 173 aa, Flaveria ramosissima
RQEVSLSGFAYLFSELVQYNQTQVDNIGELERRLEDAGYAVGVRVLELLCHREKGNRRETRLLGILSFVHSTVWKVLFGKVADSLEKGTEHEDEYMISEKELLVNRFISVPKDMGSFNCGAFAAGIVRGVLDNAGFPAVVTAHFVPVDGQQRPRTTILIKFAEEVLRREARLG

SEQ ID NO: 5249 - protein, 176 aa, Pisum sativum
NKGKTEVSLSAFAFLFSELVQYNQTQVDNIGELERRLEDAGYAVGARVLELLCHRDKGNRRETRLLGILSFVHSTVWKVLFGKVADSLEKGTEHEDEYMISEKELLVNKFISIPKDMGTFNCGAFVAGIVRGVLDGAGFPAVVTAHFVPMEGQQRPRTTILIKFAEEVLRREARLG

SEQ ID NO: 5250 - protein, 166 aa, Sequoia sempervirens
MLFILFSELVQYNQTRVDNIAELERRLEDAGYGVGLRVLELLCHREKGNRRETRLLGILSFVHSTVWKSLFGKVADSLEKGTEHEDEYMISERELLVNRFISVPKDMGNFNCGAFVAGIVKGVLDGAGFPAVVTAHFVPVEGQPRPRTTILIKFADEVLQREARLS

SEQ ID NO: 5251 - protein, 224 aa, Musa acuminata
MIGVGKIKQYTNVLDKPLSRGRQEVFVDLFLKWSLAIPDLHPVVKKSCIFARSHVSLSAFAFLFSELVQYNQTQVDNIAELERRLEDAGYAVGARVLELLCHREKGNRRETRLLGILSFVHSTVWKVLFGKVADSLEKGTEHEDEYMISEKELLVNRFISVPKDMGAFNCGAFVAGIVKGVLDGAGFPAVVTAHFVPVDGQQRPRTTILIKFAEEVLRRESRLG

SEQ ID NO: 5252 - protein, 165 aa, Amorphophallus konjac
FAFLFSELVQYNQTQVDNIAELERRLEDAGYAVGARVLELLCHREKGNRRETRLLGILSFVHSTVWKVLFGKVADSLEKGTEHEDEYMISEKELLVNRFISVPKDMGAFNCGAFVAGIVRGVLDNAGFPAVVTAHFVPMEGQQRPRTTILIKFAEEVLRREARLG

SEQ ID NO: 5253 - protein, 192 aa, Adiantum capillus-veneris
MIGRSKQYVNVVDKPLGKGKLEVSLNAFAFLFSEMVQYNQTRVDNIAELEHRLEDAGYGVGLRMLELLCHREKGNRREVRLLGILSFVHSTLWKSLFGKVADSLEKGTENEDEYMISEKELLVNRFISVPKDMGAFNCGAYVAGIVKGVLDGSGFPARVTAHFVPVEGQPRPRTTILIKFTEEVLQREARLS

SEQ ID NO: 5254 - protein, 174 aa, Glycyrrhiza uralensis
MIGVGKIKQYSNVLDKPLTKGKQEVSLSAFAFLFSELVQYNQTQVDNIGELERRLEDAGYAVGARVLELLCHRDKGNRRETRLLGILSFVHSTVWKVLFGKVADSLEKGTEHEDEYMISEKELLVNKFISIPKDMGTFNCGAFVAGIVRGVLDGAGFPAVVTAHFVPMEGQQRP

SEQ ID NO: 5255 - protein, 78 aa, Fragaria vesca
MISEKELLVNRFISIPKDMGTFNCGAFVAGIVRGVLEGAGFPAVVTAHFVPVEGQQRPRTTILIKFAEEVLRREARLG

SEQ ID NO: 5256 - protein, 192 aa, Pteridium aquilinum
MIGRSKQYVNVVDRPLGKGKLEVSLNAFAFLFSEMVQYNQTRVDNIAELEHRLEDAGYGVGLRMLELLCHREKGNKREVRLLGILSFVHSTLWKSLFGKVADSLEKGTENEDEYMISEKDLLVNRFISVPKDMGTFNCGAYVAGIVKGVLDGSGFPARVTAHFVPVEGQQRPRTTILIKFAEEVLQREARLG

SEQ ID NO: 5257 - protein, 194 aa, Ceratodon purpureus
MIGVGRAKQNLNVVDRPLGKGKAEVSLSAFAFLFSELVQYNQGKVENISDLEHRLEEAGYAVGIRMLELLCHREKANRRETRVLGILSFVHSTVWKSLFGKVADSLEKGTEHEDEYMISEKELIVNRFVSVPQGMGGFNCGTFVAGIVKGVLDGAGFPARVTAHFVAVEGQARPRTTILIKFAEEVVQRDARLG

SEQ ID NO: 5258 - protein, 194 aa, Physcomitrella patens
MIGVGRAKQNLNVVDRPLGKGKSEVSLSAFAFLFSELVQYNQGKVENIAELEHRLEEAGFGVGIRMLELLCHRDKANRRETRVLGILSFVHSTVWKSLFGKVADSLEKGTEHEDEYMISEKELLVNRFVSVPGGMGGFNCGTFVAGIVKGVLDGAGFPARVTAHFVAVEGQARPRTTILIKFAEEVVQRDARLA

SEQ ID NO: 5259 - protein, 430 aa, Zea mays
MSAAASSATACFLSPLPPPRRPRHFLRHLARAAVTKPEPASASSLALPSPWLWARRLCELVPAEAGGRLLSSAAGSLIVALASASLVLGDTGAASAFVVSTPRKLQADELATVRLFQENTPSVVYITNLAVRQDAFTLDVLEVPQGSGSGFVWDKSGHIVTNFHVIRGASDLRVTLADQSVYEAQVVGFDQDKDVAVLGIKAPKNKLRPIPVGVSADLLVGQKVYAIGNPFGLDHTLTTGVISGLRREISSAATGRPIQDVIQTDAAINPGNSGGPLLDSSGNLIGVNTAIYSPSGASSGVGFSIPVDTVGGIVDQLIKFGRVTRPILGIKFAPDQSVEQLGLSGVLVLDAPPNGPAGKAGLQATKRDPYGRLILGDIITSVNGTKVTNGSDLYRILDQCKVGDTVTVEVLRGDHKEKIPVVLEPKADES

SEQ ID NO: 5260 - protein, 423 aa, Sorghum bicolor
MAAAAAAASSSAAACFLSPLPPPRRPRHFLRHLARAAATKPAPAPAPASASSPWPWARRLGSLVPGETAGRLLSSAAGSLIVALASASLVLGDAGAASAFVVSTPRKLQADELATVRLFQENTPSVDAFTLDVLEVPQGSGSGFVWDKSGHIVTNFHVIRGASDLRVTLADQSVYEAQVVGFDQDKDVAVLRIKAPKDKLRPIPVGVSADLLVGQKVYAIGNPFGLDHTLTTGVISGLRREISSAATGRPIQDVIQTDAAINPGNSGGPLLDSSGNLIGVNTAIYSPSGASSGVGFSIPVDTVGGIVDQLIKFGKVTRPILGIKFAPDQSVEQLGLSGVLVLDAPPNGPAGKAGLQSTKRDPYGRLILGDIITSVNGTKVTNGSDLYRILDQCKVGETVTVEVLRGDHKEKIPVVLEPKADES

SEQ ID NO: 5261 - protein, 436 aa, Panicum virgatum
MAAAPSSSAAACFLSSPCPLPRRPRHFPRHLACAAASKHAPAASSSRSLALPSPAPWPRPRRLAELVPAEAAGRLLSSAAGSLIVALASAALILGDAGAASAFVVATPRKLQADELATVRLFQENTPSVVYITNLAVRQDAFTLDVLEVPQGSGSGFVWDKSGHIVTNFHVIRGASDLRVTLADQSVYEAQVVGFDQDKDVAVLRIKAPMDKLRPIPVGVSADLLVGQKVYAIGNPFGLDHTLTTGVISGLRREISSAATGRPIQDVIQTDAAINPGNSGGPLLDSSGNLIGVNTAIYSPSGASSGVGFSIPVDTVGGIVDQLIKFGKVTRPILGIKFAPDQSVEQLGLSGVLVLDAPPNGPAGKAGLQSTKRDAYGRLVLGDIITSVNGAKVTNGSDLYRILDQCKVGETVTVEVLRGDHKEKIPVVLEPKPDES

SEQ ID NO: 5262 - protein, 438 aa, Panicum virgatum
MAAAPSSSAAAAACFLSSPCPLPSRQRHYPRHLACAAASKHAPAASSSRSLALPSPAPWPWPRRLAELVPAEVAGRLLSSAAGSFIVALASAALILGDAGAASAFVVATPRKLQADELATVRLFQENTPSVVYITNLAVRQDAFTLDVLEVPQGSGSGFVWDKSGHIVTNFHVIRGASDLRVTLADQSVYEAQVVGFDQDKDVAVLRIKAPMDKLRPIPVGVSADLLVGQKVYAIGNPFGLDHTLTTGVISGLRREISSAATGRPIQDVIQTDAAINPGNSGGPLLDSSGNLIGVNTAIYSPSGASSGVGFSIPVDTVGGIVDQLIKFGKVTRPILGIKFAPDQSVEQLGLSGVLVLDAPPNGPAGKAGLQSTKRDAYGRLVLGDIITSVNGTKVTNGSDLYRILDQCKVGETVTVEVLRGDHKEKIPVVLEPKPDES

SEQ ID NO: 5263 - protein, 444 aa, Setaria italica
MAAASSSSSPTACFLSPPCPPPRRPRHFLKHLACAAATKPAPAASSNTSSSRSLALPLPAPTPWPWPPRWLGELVPAEAAGRLLSSAAGSLIVALASAALILGDAGAASAFVVATPRKLQADELATVRLFQENTPSVVYITNLAVRQDAFTLDVLEVPQGSGSGFVWDKSGHIVTNFHVIRGASDLRVTLADQSVYEAQVVGFDQDKDVAVLRIKAPKDKLRPIPVGVSADLLVGQKVYAIGNPFGLDHTLTTGVISGLRREISSAATGRPIQDVIQTDAAINPGNSGGPLLDSSGNLIGVNTAIYSPSGASSGVGFSIPVDTVGGIVDQLIKFGKVTRPILGIKFAPDQSVEQLGLSGVLVLDAPSNGPAGKAGLQSTKRDAYGRLILGDIITSVNGTKVTNGSDLYRILDQCKVGETVTVEVLRGDHKEKIPVILEPKPDES

SEQ ID NO: 5264 - protein, 423 aa, Avena sativa
ASSSAATACFLSPPPRPRARHFLCHLPRAAATRTSPARPLTLPASPPLLRDLVDPAEAARRLLASAAGSLVVALASAALILGDPGSASAFVVATPRKLQADELATVRLFKDNTPSVVYITNLAVRQDAFTLDVLEVPQGSGSGFVWDKIGHIVTNFHVIRGASDLRVTLADQSVYEAQVVGFDQDKDVAVLSIQAPKDKLRPLPVGVSADLLVGQKVYAIGNPFGLDHTLTTGVISGLRREISSAATGRPIQDVIQTDAAINPGNSGGPLLDSSGNLIGVNTAIYSPSGASSGVGFSIPVDTVGGIVDQLIQFGKVTRPILGIKFAPDQSVEQLGLSGVLVLDAPPNGPAGKAGLQSTKRDAYGRLILGDIITSVNGTKVGNGSDLYRILDQCKVGETVMVEVLRGDHKEKIAVVLEPKPDET

SEQ ID NO: 5265 - protein, 437 aa, Oryza sativa
MAAASSSAAACFLSPSPPPPPRHHSIKHLACAASRSPSPGPSSSRSLALPSPSASASPSPWPRRLRDLLPDETGRILSSATGSLIVALASAALILGDAGSASAFVVATPRKLQADELATVRLFQENTPSVVYITNLAVRQDAFTLDVLEVPQGSGSGFVWDKSGHIVTNFHVIRGASDLRVTLADQTVYEAQVVGFDQDKDVAVLRIKAPTDKLRPIPVGVSADLLVGQKVFAIGNPFGLDHTLTTGVISGLRREISSAATGRPIQDVIQTDAAINPGNSGGPLLDSSGNLIGVNTAIYSPSGASSGVGFSIPVDTVGGIVDQLIKFGKVTRPILGIKFAPDQSVEQLGLSGVLVLDAPPNGPAGKAGLQSTKRDSYGRLILGDIITSVNGTKVTNGSDLYRILDQCKVGEKVTVEVLRGDQKEKIPVILEPKPDES

SEQ ID NO: 5266 - protein, 427 aa, Avena sativa
MASSSSSSAATACFLSPPPRPRARNFLRYLARAAATRTSPARPLTLPASPPLLRDLVDPAEAARRLLASAAGSLVVALASAALILGDPGSASAFVVATPRKLQADELATVRLFKDNTPSVVYITNLAVRQDAFTLDVLEVPQGSGSGFVWDKIGHIVTNFHVIRGASDLRVTLADQSVYEAQVVGFDQDKDVAVLSIQAPKDKLRPLPVGVSADLLVGQKVYAIGNPFGLDHTLTTGVISGLRREISSAATGRPIQDVIQTDAAINPGNSGGPLLDSSGNLIGVNTAIYSPSGASSGVGFSIPVDTVGGIVDQLIQFGKVTRPILGIKFAPDQSVEQLGLSGVLVLDAPPNGPAGKAGLQSTKRDAYGRLILGDIITSVNGTKVGNGSDLYRILDQCKVGETVMVEVLRGDHKEKIAVVLEPKPDET

SEQ ID NO: 5267 - protein, 871 aa, Brachypodium distachyon
MCSLDWQGHGGGGGEQESCVDAHLLCFRKEELSGTKVADLRKVLVGSLDDMVLMDATHIFDDPTESTVNHKENNKHMRCLLVVLAATETNTVENDKGLLQVVALPEQNRALSLLDVAQDIDSMRPTSLFRYLVMNDVFGKLRMSLFGYFVGDAATAKAIPFCRALVCLAVDSKDARLRAFWSDRNSCNAETSFEVWLRCQKENFRAKAYSATAKEVPLGNPWHWELEYECERYLSAYIDMLRVLDETDHFAEGSDRAYDVVSHLKRTSEIPPELSKYVAQSVEATSPSFCIIFLGAYISSHDTSGQHGKTLDVVDGLMAREECLEPVAPLIRDFPLHLQPYAHALIKSKLEESKYYVAVNQIRLHEQFDEFLASSKLDCDVYRFMFSKVTLPVQIDEDCMEVVVNKVPSKFWELEPALRKLSFERRADIVQVETEIYTYLECAGAATTACCFLAPSPSLPPQRPRHFLKHLARAAASTTRPDATSRSLAPPASPPPLLAAPAEAARRTLKSAAGTLVVALASAALILGDAGGGAASAFVVATPRKLPADELATVRLFKDNTPSVVYITNLAVRQDAFTLDVLEVPQGSGSGFVWDKMGHVVTNFHVIRGASDLRVTLADQSVYEAQVVGFDQDKDVAVLSIQAPKDKLRPLPVGVSADLLVGQKVYAIGNPFGLDHTLTTGVISGLRREISSAATGRPIQDVIQTDAAINPGNSGGPLLDSSGNLIGVNTAIYSPSGASSGVGFSIPVDTVGGIVDQLIKFGKVTRPILGIKFAPDQSVEQLGLSGVLVLDAPPNGPAGKAGLQSTKRDSYGRLILGDIITSVNGTKVANGSDLYRILDQCKVGETVTVEVLRGDQKEKIAVILEPKPDES

SEQ ID NO: 5268 - protein, 436 aa, Brachypodium distachyon
MAAAGAGAGAATTACCFLAPSPSLPPQRPRHFLKHLARAAASTTRPDATSRSLAPPASPPPLLAAPAEAARRTLKSAAGTLVVALASAALILGDAGGGAASAFVVATPRKLPADELATVRLFKDNTPSVVYITNLAVRQDAFTLDVLEVPQGSGSGFVWDKMGHVVTNFHVIRGASDLRVTLADQSVYEAQVVGFDQDKDVAVLSIQAPKDKLRPLPVGVSADLLVGQKVYAIGNPFGLDHTLTTGVISGLRREISSAATGRPIQDVIQTDAAINPGNSGGPLLDSSGNLIGVNTAIYSPSGASSGVGFSIPVDTVGGIVDQLIKFGKVTRPILGIKFAPDQSVEQLGLSGVLVLDAPPNGPAGKAGLQSTKRDSYGRLILGDIITSVNGTKVANGSDLYRILDQCKVGETVTVEVLRGDQKEKIAVILEPKPDES

SEQ ID NO: 5269 - protein, 385 aa, Echinochloa colona
PAPSPGPWPRRLSELVPAEAAGRLLSSAAGSLVVALASAALILGDAGAASAFVVATPRKLQADELATVRLFQENTPSVVYITNLAVRQDAFTLDVLEVPQGSGSGFVWDKSGHIVTNFHVIRGASDLRVTLADQSVYEAQIVGYDQDKDVAVLRIKAPKDKLRPIPVGVSADLLVGQKVYAIGNPFGLDHTLTTGVISGLRREISSAATGRPIQDVIQTDAAINPGNSGGPLLDSSGNLIGVNTAIYSPSGASSGVGFSIPVDTVGGIVDQLIKFGKVTRPILGIKFAPDQSVEQLGLSGVLVLDAPPNGPAGKAGLQSTKRDAYGRLILGDIITSVNGTKVTNGSDLYRILDQCKVGETVTVEVLRGDQKEKIPVILEPKPDES

SEQ ID NO: 5270 - protein, 392 aa, Triticum aestivum
PPAGPLALPASPRRPLRDLVPGPVAEAARRALAAAAGPLVVALASAALVLGDAGAASAFVVATPRKLQADELATVRLFKDNTPSVVYITNLAVRQDAFTLDVLEVPQGSGSGFVWDKLGHIVTNFHVIRGASDLRVTLADQSVYEAQVVGFDQDKDVAVLSIEAPKDKLRPLPVGVSADLLVGQKVYAIGNPFGLDHTLTTGVISGLRREISSAATGRPIQDVIQTDAAINPGNSGGPLLDSSGNLIGVNTAIYSPSGASSGVGFSIPVDTVGGIVDQLIQFGKVTRPILGIKFAPDQSVEQLGLSGVLVLDAPPNGPAGKAGLQSTKRDAYGRLILGDIITSVNGTKVANGSDLYRILDQCKVGETVTVEVLRGDKKEKIAVVLEPKLDET

SEQ ID NO: 5271 - protein, 371 aa, Avena sativa
VDPAEAARRLLASAAGSLVVALASAALILGDPGSASAFVVATPRKLQADELATVRLFKDNTPSVVYITNLAVRQDAFTLDVLEVPQGSGSGFVWDKIGHIVTNFHVIRGASDLRVTLADQSVYEAQVVGFDQDKDVAVLSIQAPKDKLRPLPVGVSADLLVGQKVYAIGNPFGLDHTLTTGVISGLRREISSAATGRPIQDVIQTDAAINPGNSGGPLLDSSGNLIGVNTAIYSPSGASSGVGFSIPVDTVGGIVDQLIQFGKVTRPILGIKFAPDQSVEQLGLSGVLVLDAPPNGPAGKAGLQSTKRDAYGRLILGDIITSVNGTKVGNGSDLYRILDQCKVGETVTVEVLRGDHKEKIGVVLEPKPDET

SEQ ID NO: 5272 - protein, 371 aa, Avena sativa
VDPAEAARRLLASAAGSLVVALASAALILGDPGSASAFVVATPRKLQADELATVRLFKDNTPSVVYITNLAVRQDAFTLDVLEVPQGSGSGFVWDKIGHIVTNFHVIRGASDLRVTLADQSVYEAQVVGFDQDKDVAVLSIQAPKDKLRPLPVGVSADLLVGQKVYAIGNPFGLDHTLTTGVISGLRREISSAATGRPIQDVIQTDAAINPGNSGGPLLDSSGNLIGVNTAIYSPSGASSGVGFSIPVDTVGGIVDQLIQFGKVTRPILGIKFAPDQSVEQLGLSGVLVLDAPPNGPAGKAGLQSTKRDAYGRLILGDIITSVNGTKVGNGSDLYRILDQCKVGETVTVEVLRGDQKEKIAVVLEPKPDET

SEQ ID NO: 5273 - protein, 561 aa, Echinochloa colona
MAARGLGLSTSFLAGHDTLLRRRRGRPVGPAAASFRPVTAELGGVATELGRQLVEAVGVGLPCTVMQCGDVIYRSTLPHNDGLTITAPGVALALAAVSYLWSTPGVAPGFFDMFVLAFAERLFRPTFRKDDLVLGKKLGEGAFGVVCKASLANPEAAEKQGDVVVKKATEYGAVEIWMNERVRRACASSCADFLYGFRESKAKGKGAEEYWLIWRFEGEDTLYDLMQSKEFPYNVETKILGGVQDLPKGIARENKIIQTVMRQLLFALDGLHSTGIVHRDVKPQNVIFSEGSRTFKIIDLGAAADLRVGINYIPKEFLLDPRYAAPEQYIMSTQTPSAPSVPVATTLSPVLWQLNLPDRFDIYSLGLIFLQMAFPSLRTDSNLIQFNRQLKRCDYDLEAWRDLVEPRATAELRRGFNIMDLDDGIGWELLTSMVRYKARQRISAKAALAHPYFNREGLLGLSVMQNVQLQLFRATQKDYSEAARWVIGLMARSGTEDVGGFTEAQLQELREIKPKKDNAQRNVLASVLRLQRKIVRTIKESMDELTSQRKSIWWSRWIPRE

SEQ ID NO: 5274 - protein, 559 aa, Echinochloa colona
MAASGLGLATSFLPGHVTLLRRRRPVGPAAASFRPVTAELGGVATELGRQLVEAVGVGLPCTVMQCGDVIYRSTLPHNDGLTITAPGVALALAAVSYLWSTPGVAPGFFDMFVLAFAERLFRPTFRKDDLVLGKKLGEGAFGVVCKASLANPEAAEKQGDVVVKKATEYGAVEIWMNERVRRACASSCADFLYGFRESKAKGKGAEEYWLIWRFEGEDTLYDLMQSKEFPYNVETKILGGVQDLPKGIARENKIIQTVMRQLLFALDGLHSTGIVHRDVKPQNVIFSEGSRTFKIIDLGAAADLRVGINYIPKEFLLDPRYAAPEQYIMSTQTPSAPSVPVATTLSPVLWQLNLPDRFDIYSLGLIFLQMAFPSLRTDSSLIQFNRQLKRCDYNLEAWRNLVEPRATAELRRGFDIMDLDDGIGWELLTSMVRYKARQRISAEAALAHPYFNREGLLGLSVMQNVQMQLFRATQKDYSEAARWVVGLMARSGTEDVGGFTEAQLQELREIKPKKDNAQRNVLASVLRLQRKIVRTIKESMDELTSQRKSIWWSRWIPRE

SEQ ID NO: 5275 - protein, 562 aa, Sorghum bicolor
MAASGLGLSTSFLPGHDTLLRRRRRRPASPSTASFRPVTAELGGVAAGLGRQLVEAVGVGLPCTVMQCGDVIYRSTLPQNDGLTITAPGVALALAAVSYLWATPGVAPGFFDMFVLAFAERLFRPTFRKDDFVLGKKLGEGAFGVVYKASLANPEAAKKQGDVVVKKATEYGAVEIWMNERVRRACASSCADFLYGFRETKTKGKGAEEYWIIWRFEGEDTLYDLMQSKEFPYNVETKILGNVQDLPKGIARENKIIQTVMRQLLFALDGLHSTGIVHRDIKPQNVIFSEGSRTFKIIDLGAAADLRVGINYIPKEFLLDPRYAAPEQYIMSTQTPSAPSVPVATTLSPVLWQLNLPDRFDIYSLGLIFLQMAFPSLRTDSSLIQFNRQLKRCDYDLQAWRNLVEPRATAELRRGFDIMDLDNGIGWELLTSMVRYKARQRTSAEGALAHPYFNREGLLGLSVMQNARLQLFRATQKDYSEAARWVIGLMARSGTEEVGGFTEAQLQELREIKPKKGNAQRNVLASVLRLQKKIVKTINESMDELASQRKSIWWSRWIPREE

SEQ ID NO: 5276 - protein, 562 aa, Setaria italica
MAASGLGLATSFLPGHDTLLRRRRRRPASPAAASFRPVTAELGGVATELGRQLVEAVGVGLPCTVMQCGDVIYRSTLPRNDGLTITAPGVALALAAASYLWATPGVAPGFFDMFVLAFAERLFRPTFRKDDFVLGKKLGEGAFGVVYKASLANPEAAEKQGDVVVKKATEYGAVEIWMNERVRRACASSCADFLYGFRESKVKGKGAEEYWIIWRFEGEDTLYDLMQSKEFPYNVETKILGGVQNLPKGIGRENKIIQTVMRQLLFALDGLHSTGIVHRDIKPQNVIFSEGSRTFKIIDLGAAADLRVGINYIPKEFLLDPRYAAPEQYIMSTQTPSAPSVPVATTLSPVLWQLNLPDRFDIYSLGLIFLQMAFPSLRTDSSLIQFNRQLKRCNYDLEAWRNLVEPRATAELRRGFDIMDLDDGIGWELLTSMVRYKARQRISAEAALAHPYFNREGLLGLSVMQNVRLQLFRATQKDYSEAARWVVGLMARSGTEDVGGFTEAQLQELREIKPKKGSAQRNVLASLLRVQRKIVRTINESMDDLTSQRKSIWWSRWIPREE

SEQ ID NO: 5277 - protein, 559 aa, Oryza sativa
MATGSLGLSTSFLPGHDTLLRRRRRRPPATTAASFRPVTAELGGELGRQLVEAVGVGLPCTVMACGDVIYRSTLPRNDGLTITAPGVALALAAASYLWSTPGVAPGFFDMFVLAFAERVFRPTFRKDEFVLGKKLGEGAFGVVYKASLDDPKAAEKQGAVVVKKATEYGAVEIWMNERVRRACASSCADFIYGFRESKAKGKGADEYWLIWRYEGEDTLFDLMQSKEFPYNVETKILGDVQDLPKGIARENKIIQTVMRQLLFALDGLHSTGIVHRDVKPQNVIFSEGSRTFKIIDLGAAADLRVGINYIPSEFLLDPRYAAPEQYIMSTQTPSAPSAPVATALSPVLWQLNLPDRFDIYSLGLIFLQMAFPSLRTDSSLIQFNRQLKRCNYDLEAWRNLVEPRATPELRRGFDILDLDGGIGWELLTSMVRYKARQRTGAKAALAHPYFNREGLLGLSVMQNLRLQLLRATQKDYSEAARWVVGLMARSGTEAEGGFTEAQLQELREIKPKKGSARRNLLASVLRVQRKVVRTINESMDELSSQSKSIWWSRWIPKEE

SEQ ID NO: 5278 - protein, 560 aa, Triticum aestivum
MATSSSLGLSTSFLPGHDTRLRRRRRAAPAAASSFRPVVASAELGAEVGRQLVEAVGVGLPCTVMACGDVIYRSTLPHNDGLTITAPGVALALAAASYLWATPGVAPGFFDMFVLAFAERLFRPTFRKDDFVPGKKLGEGAFGVVYKASLADPKAAEKQGDVVVKKATEYGAVEIWMNERVRRACASSCADFLYGFRESKTKGKGEEYWLIWRYEGEDTLSALMQSKEFPYNVETKILGNVQDLPKGIARENKIVQTVMGQLLFALDGLHSTGIVHRDIKPQNVIFSEESRTFKIIDLGAAADLRVGINYIPKEFLLDPRYAAPEQYIMSTQTPSAPSAPVATALSPVLWQLNLPDRFDIYSLGLIYLQMAFPALRTDSSLIQFNRQLKRCNYDLEAWRNLVEPRATPDLRRGFDILDLDGGIGWELLTSMVRYKARQRTSAKAALAHPYFNSEGLLGLSVMQNLRLQLFRATQKDYSEAARWIIGLMAKSGTEEGGGFTEAQLQELREIKPKKDSAQRNVLASMLRVQRKIVRTISESMDELTSQRKSIWWSRWIPREE

SEQ ID NO: 5279 - protein, 556 aa, Brachypodium distachyon
MATSSLGLSTSFLPGHDTRRRRRPPRGPAASFRPVTAELGAEVGRQLVEAVGVGLPCTVMACGDVIYRSTLPHNDGLTITAPGVALALAAASYLWATPGVAPGFFDMFVLAFAERLFRPTFRKDDFVPGKKLGEGAFGVVYRASLSDPKAAEKQGDVVVKKATEYGAVEIWMNERVRRACASSCADFVYGFCESKPKGKGADDYWLIWRYEGEATLSALMQSKEFPYNAETKILGNVQDLPKGIARENRIIQTVMRQLLFALDGLHSTGIVHRDIKPQNVIFSEESRTFKIIDLGAAADLRVGINYIPKEFLLDPRYAAPEQYIMSTQTPSAPSAPVATALSPVLWQLNLPDRFDIYSLGLIFLQMAFPALRTDSSLIQFNRQLKRCNYDLEAWRDLVEPRAAPDLRRGFDILDLDGGIGWELLTSMVRYKARQRTSAKAALAHPYFNSEGLLGLSVMQNLRLQLFRATQKDYSEAARWVVGLMAKSGTEAGGGFTEAQLQELREIKPKKDSAERNVLASMLRVQRKIVRTINESMDELTSQRKSIWWSRWIPREE

SEQ ID NO: 5280 - protein, 558 aa, Avena sativa
MATSSSLGLSTSFLPGHDTRLRRRRRLPAGIPAASFRPVAELGVEVGRQLVEAVGVGLPCTVMACGDVIYRSTLPHNDGLTITAGGTALALAVASYLWATPGVAPGFFDMFVLAFAERLYRPTFRKDDFVPGKKLGEGAFGVVYKASLSDPKMAEKQGDVVVKKATEYGAVEIWMNERVRRACASSCADFLYGFRENKAKGKGDEYWLIWRYEGEDTLSALMQSKEFPYNVETKILGNVQDLPKGIARENKIVQTVMRQLLFALDGLHSTGIVHRDIKPQNVIFSEESRTFKIIDLGAAADLRVGINYIPKEFLLDPRYAAPEQYIMSTQTPSAPSAPVATALSPVLWQLNLPDRFDIYSLGLIYLQMAFPALRTDSSLIQFNRQLKRCNYDLEAWRNLVEPRATPDLRRGFDILDLDGGIGWELLTSMVRYKARQRTSAKAALAHPYFNREGLLGLSVMQNLRLQVFRATQKDYSEAARWVVSLMARSGTEAAGGFTEAQLQDLREIKPKKDSAQRNVLASMLRVQRKVIRTINESIGELAGESKSIWWSRWIPREE

SEQ ID NO: 5281 - protein, 496 aa, Avena sativa
MACGDVIYRSTLPHNDGLTITAGGTALALAVASYLWATPGVAPGFFDMFVLAFAERLYRPTFRKDDFVPGKKLGEGAFGVVYKASLSDPKMAEKQGDVVVKKATEYGAVEIWMNERVRRACASSCADFLYGFRENKAKGKGDEYWLIWRYEGEDTLSALMQSKEFPYNVETKILGNVQDLPKGIARENKIVQTVMRQLLFALDGLHSTGIVHRDIKPQNVIFSEESRTFKIIDLGAAADLRVGINYIPKEFLLDPRYAAPEQYIMSTQTPSAPSAPVATALSPVLWQLNLPDRFDIYSLGLIYLQMAFPALRTDSSLIQFNRQLKRCNYDLEAWRNLVEPRATPDLRRGFDILDLDGGIGWELLTSMVRYKARQRTSAKAALAHPYFNREGLLGLSVMQNLRLQVFRATQKDYSEAARWVVSLMARSGTEAAGGFTEAQLQDLREIKPKKDSAQRNVLASMLRVQRKVIRTINESIGELAGESKSIWWSRWIPREE

SEQ ID NO: 5282 - protein, 496 aa, Avena sativa
MACGDVIYRSTLPHNDGLTITAGGTALALAVASYLWATPGVAPGFFDMFVLAFAERLYRPTFRKDDFVPGKKLGEGAFGVVYKASLSDPKMAEKQGDVVVKKATEYGAVEIWMNERVRRACASSCADFLYGFRENKAKGKGDEYWLIWRYEGEDTLSALMQSKEFPYNVETKILGNVQDLPKGIARENKIVQTVMRQLLFALDGLHSTGIVHRDIKPQNVIFSEESRTFKIIDLGAAADLRVGINYIPKEFLLDPRYAAPEQYIMSTQTPSAPSAPVATALSPVLWQLNLPDRFDIYSLGLIYLQMAFPALRTDSSLIQFNRQLKRCNYDLEAWRNLVEPRATPDLRRGFDILDLDGGIGWELLTSMVRYKARQRTSAKAALAHPYFNSEGLLGLSVMQNLSLQVFRATQKDYSEAARWVVSLMARSGTEAAGGFTEAQLQDLREIKPKKDSAQRNVLASMLRVQRKVIRTINESIGELAGESKSIWWSRWIPREE

SEQ ID NO: 5283 - protein, 496 aa, Lolium multiflorum
MACGDVIYRSTLPHNDGLTITAGGTALALAAASYLWATPGVAPGFFDMFVLAFAERLYRPTFRKDDFVPGKKLGEGAFGVVYKASLTDPKAAEKQGAVVVKKATEYGAVEIWMNERVRRACASSCADFLYGFREKKAKGKGDEYWLIWRYEGEDTLSALMQSKEFPYNVETKILGNVQDLPKGIARENKIVQTVMRQLLFALDGLHSTGIVHRDIKPQNVIFSEDSRTFKIIDLGAAADLRVGINYIPKEFLLDPRYAAPEQYIMSTQTPSAPSAPVATALSPVLWQLNLPDRFDIYSLGIIYLQMAFPALRTDSSLIQFNRQLKRCNYDLEAWRNLVEPRATPDLRRGFDILDLDGGIGWELLTSMVRYKARQRTSAKAALAHPYFNSEGLLGLSVMQNLSLQLFRATQKDYSEAARWVVSLMARSGTEAAGGFTEAQLQDLREIKPKKDSAQRNVLASMLRVQRKVVRTINESMGELTSQSKSIWWSRWIPREE

SEQ ID NO: 5284 - protein, 558 aa, Panicum virgatum
MATATVTPPQCWRGLPASARARPPLSSPLRVHPLAAPFRPPRPRTASTAASGRGRRSALACSPRCTLGTAGPAGFDPLGLYKEGPSGSEASSRSPLSTFFGILAPVFGSSSGGGARREKASYGRGAAAAIEDSSIDIGDFFKGPLPGKFLKLLGFLALSRLGVYIPLGGVNREAFAGNLDQNSLLSTLDSFSGGGIGRLGICSLGIVPFINAQIVFQLLAQLYPKLQDLQRKEGEAGRKKVLQYTRYASVGFAVVQAIGQVLYLRPYVNDFSTEWVLTSVTLLTLGSVFTTFIGERISDLKLGNGTSLLIFTSIISYLPASFGRTVAQAFQDGNYVGLITIILSFFLLVLGIVYVQEAERKIPLNYASRYSSRTGGLQRSAYLPFKVNSSGVMPIIFSTSSLALPGTLARFTGLEFLKKAAVALNPGGSLYLPTNVLLIAFFNYYYTFLQLDPDDLSEQLKRQGASIPLVRPGKSTAAYIKTVLSRISVLGSAFLAVLAAGPSVVEQISHLTAFRGFAGTSVLILVGCATDTARKVQAEIISQKYKNIEFYDVNRFDQ

SEQ ID NO: 5285 - protein, 556 aa, Oryza sativa
MAAMATPQQCWLPTRARAPPPPPPRAPSSASPVSGAPASLRFRGRRAASASASAARRRRGASLPCSPRCALETAGPGFDPLGLYNDGPSRNDTQSPLSNFFGVLSPVFGSSSGGRKEKSYGRGAAAAIEDSSIDIGDFFKGPLPGKFLKLLGYLALSRLGIYIPLGGVNRDAFAGNLDQNSLLGTLDSFSGGGIGRLGICSLGIVPFINAQIVFQLLAQLYPKLQDLQKKEGEAGRKKVLQYTRYASVGFAIVQAIGQVLFLRPYVNDFSTEWVLTSVTLLTLGSVFTTFIGERISDLKLGNGTSLLIFTSIISYLPASFGRTVAQAFQDGNYVGLLTIILSFLFLVLGIVYVQEAERKIPLNYASRYSSRSGGLQRSAYLPFKVNSSGVMPIIFSTSSLALPGTLARFTGLDFLKKAAISLNPGGALYIPTNVLLIAFFNYYYTFLQLDPDDLSEQLKRQGASIPLVRPGKSTAAFIKTVLSNISVLGSAFLAVLAAGPSVVEQITHLTAFRGFAGTSVLILVGCATDTARKVQAEIISQKYKNIEFYDVNRFDQ

SEQ ID NO: 5286 - protein, 548 aa, Brachypodium distachyon
MATATPQQCWLPAPGCPPTISSVLCLGSLTRAAASSHFPGRRTASVRRRGRTAFACSPRCTLETAGPAFDPLGLYKDDPSGSDYQSPLSTFFGILLPVFGSSSGSRNEKSSYGRGAAAAMEDSSIDIGDFFKGPLPGKFLKLLGFLVLSRIGVYVPLGGVNREAFAGNLDQNSLLGTLDSFSGGGIGRLGICSLGIVPFINAQIVFQLLAQLYPKLQDLQKKEGEAGRKKILQYTRYASVGFAIVQAIGQVLFLRPYVNDFSTEWVLTSVTLLTLGSVFTTFLGETISELKLGNGTSLLIFTSIISYLPASFGRTVAEGFQAGNYVGLLTIILSFFFLVLGIVYVQEAERKIPLNYASRYSSRTGGPQRSAYLPFKVNSSGVMPIIFSTSSLALPATLARFTGLDFLKKAAIALTPGGSFYLPTNVLLIAFFNYYYTFLQLDPDDLSEQLKRQGASIPLVRPGKSTAAFIKTVLSRISVLGSGFLAVLAAGPSVVEQISHLTAFRGFAGTSVLILVGCATDTARKVQAEIISQKYKNIEFYDVKSSDK

SEQ ID NO: 5287 - protein, 548 aa, Leymus cinereus x Leymus triticoides
MATATPQQCCLPARARPPPTSAPLRLRYLTRAASSFHFPGRRTATARRRGSAAFAFSPRCTLETGGPAFDPLGLYREDPSSSDYQSPFSTFFGVLSPVFGSSSGSRKEKSSYGRGAAAAMEDSTIDFGDFFKGPLPGKFLKLLGFLALSRLGVYIPLGGVNQAAFAGNLDQNSLLGTLDSFSGGGIGRLGICSLGIVPFINAQIAFQLLTQLYPKLQDLQKKEGEAGRKKILQYTRYASVGFAIAQAIGQVLFLRPYVNDFSTEWVLTSVTLLTLGSVFTTFLGETISELKLGNGTSLLIFTSIISYLPASFGRTVAEGFQAGNYVGLLTIILSFFFLVLGIVYVQEAERKIPLNYASRYGSRTGGPQRSAYLPFKVNSSGVMPIIFSTSSLALPATLARFTGLDFLKKAAIALTPGGSFYLPTNVLLIAFFNYYYTFLQLDPDDLSEQLKRPGASIPLVRPGKSTAAFIKTVLSRISVLGSAFLAVLAAGPSVVEQISHLTAFRGFAGTSVLILVGCATDTARKVQTEIISQKYKDIEFYDVKSSDK

SEQ ID NO: 5288 - protein, 548 aa, Triticum aestivum
MATATPQQCCLPARARPPPTSTPLRLRYLTRAASSFHFPGRRTVTARRRGRAALAFSPRCTLETGGPAFDPLGLYREDPSSSDYQSPFSTFFGVLSPVFGSSSGSRKEKSSYGRGAAAAMEDSTIDFGDFFKGPLPGKFLKLLGFLALSRLGVYIPLGGVNQAAFAGNLDQNSLLGTLDSFSGGGIGRLGICSLGIVPFINAQIVFQLLTQLYPKLQELQKKEGEAGRKKILQYTRYASVGFAIAQAIGQVLFLRPYVNDFSTEWVLTSVTLLTLGSVFTTFLGETISELKLGNGTSLLIFTSIISYLPASFGRTVAEGFQAGNYVGLLTIILSFFFLVLGIVYVQEAERKIPLNYASRYGSRTGGPQRSAYLPFKVNSSGVMPIIFSTSSLALPATLARFTGLDFLKKAAIALTPGGSFYLPTNVLLIAFFNYYYTFLQLDPDDLSEQLKRTGASIPLVRPGKNTAAFIKTVLSRISVLGSAFLAVLAAGPSVVEQISHLTAFRGFAGTSVLILVGCATDTARKVQTEIISQKYKDIEFYDVKSSDK

SEQ ID NO: 5289 - protein, 547 aa, Avena sativa
MATATPQKCCLPAPASPPPISARLRLPYLARGASSCHFPGRRTVTARRGRTAVAFSSRCTLEMAGPAFDPLGLYKEDPSSSDYQSPLSTFFGILSPVFGSTSGSRKEKSSYGRGAAAAMEDSTIDIGDFFKGPLPGKFLKLLGFLALSRLGVYIPLGGVNREAFAGNLDQNSLLGTLDSFSGGGIGRLGICSLGIVPFINAQIVFQLLAQLYPKLQDLQKKEGEAGRKKILQYTRYASVGFAIVQAIGQVLFLRPYVNDFSTEWVLTSVTLLTLGSVFTTFLGETISELKLGNGTSLLIFTSIISYLPASFGRTVAEGFQAGNYVGLLTIILSFFFLVLGIVYVQEAERKIPLNYASRYSSRAGGPQRSAYLPFKVNSSGVMPIIFSTSSLALPATLARFTGLDILKKAAIALTPGGSFYLPTNVMLIAFFNYYYTFLQLDPDDLSEQLKRQGASIPLMRPGKNTAAFIKTVLSRISVLGSAFLAVLAAGPSVVEQISHLTAFRGFAGTSVLILVGCATDTARKVQAEIISQKYKNIEFYDIKNSEQ

SEQ ID NO: 5290 - protein, 166 aa, Avena sativa
MPIIFSTSSLALPATLARFTGLDILKKAAIALTPGGSFYLPTNVMLIAFFNYYYTFLQLDPDDLSEQLKRQGASIPLMRPGKNTAAFIKTVLSRISVLGSAFLAVLAAGPSVVEQISHLTAFRGFAGTSVLILVGCATDTARKVQAEIISQKYKNIEFYDIKNSEQ

SEQ ID NO: 5291 - protein, 480 aa, Pennisetum glaucum
DPLGLYKDGPSGSDSSSSRSPLSTFFGILAPVFGSSSGGGTRRENRGAAAAIEDSSIDIGDFFKGPLPGKFLKLLGFLALSRLGVYIPLGGVNREAFAGNLDQNSLLGTLDSFSGGGIGRLGICSLGIVPFINAQIVFQLLAQLYPKLQDLQRKEGEAGRKKVLQYTRYASVGFAIVQAIGQVLYLRPYVNDFSTEWVLTSVTLLTLGSVFTTFIGERISDLKLGNGTSLLIFTSIISYLPASFGRTVSQAFQDGNYVGLLTIILSFFLLVLGIVYVQEAERKIPLNYASRYSSRTGGLQRSAYLPFKVNSSGVMPIIFSTSSLALPGTLARFTGLEFLKKAAVALVPGGSLYLPTNVLLIAFFNYYYTFLQLDPDDLSEQLKRQGASIPLVRPGKSTAAYIKTVLSRISVLGSVFLAVLAAGPSVVEQISHLTAFRGFAGTSVLILVGCATDTARKVQAEIISQKYKNIEFYDVNRFDQ

SEQ ID NO: 5292 - protein, 144 aa, Saccharum officinarum
MSAANQLAALIANMFATGLLDDQFQQLQLLQDPSAPNFVSEVVTLFCQDGERIIGELAKQLDKPSVDFDRVDAFVHQLKGSSASVGALKVKNTCIQFREFCQQKSKDGCLKTLETVRINFYELRGKFQTMLQLERQVNGFPPNN

SEQ ID NO: 5293 - protein, 144 aa, Zea mays
MSAANQLAALVSNMYATGLLDDQFQQLQLLQDPSAPDFVSEVVTLFCQDGERIIEELAKLLEKPNVDFDRVDAFVHQLKGSSANIGAQKVKNTCIQFREFCQQKSRDGCLKVLETMRINFYELRGKFQTMLQLERQVNGFPPNK

SEQ ID NO: 5294 - protein, 144 aa, Zea mays
MSAANQLAALVSNMYATGLLDDQFQQLQMLQNASTPDFVSEVVTLFCQDGERIIGELAKLLEKPNVDFDRVDAFVHQLKGSSASIGAQKVKNTCIQFRESCQQKSKDGCLKTLETVKINFYDLRDKFQTMLQLQRQVNGCPPSK

SEQ ID NO: 5295 - protein, 141 aa, Setaria italica
MDAANQLTALLNNMFATGLLDEQFQQLQMLQDPSAPDFVSEVVTLFCQDGERIIGELAKLLEKPTVDFDRVDAFVHQLKGSSASVGAQKVKNTCVQFREVCQLKSRDGCLKTLDLVRTEFYDLRGKFQTMLQLEKHIQGFK

SEQ ID NO: 5296 - protein, 145 aa, Festuca arundinacea
  Sequence also found in Organisms: Lolium multiflorum
MAAAMQLNTLMSNMFATGLLDDQFQQLQMLQDPSAPDFVAEVVTLFCEDGERIIGELAKLLDKPAVDFDKVDAFVHQLKGSSASVGAQRVKNTCIQFREFCQGKSRDGCLKTLDAVRNDFYDLRSKFQTMLQLEQQVQASFYPKQ

SEQ ID NO: 5297 - protein, 857 aa, Zea mays
MASISPEDIGGDVNLSKIPVEEVFKTLKCDRKGLSSTEGENRLRTFGPNKLEEKKENNLLKFLGFMWNPLSWVMEMAAIMAIALANGGGRAPDWQDFVGIVSLLFINSTISYIEEANAGNAAAALMAGLAPKTKLLRDGRWEEQDASILVPGDIISIKLGDIIPADARLLEGDPLKIDQSALTGESLPVNKHPGQEVFSGSTVKQGEIEAVVIATGVRTFFGKAAHLVDSTNNVGHFQQVLTAIGNFCIISIAAGMLVEVIVMYPIQHRAYRDGIDNLLVLLIGGIPIAMPTVLSVTMAIGSHRLSQQGAITKRMTAIEEMAGMDMLCSDKTGTLTLNKLTVDKSLIEVYSKGVDRDMVLLYAARASRVENQDAIDTCIVNMLADPKEARAGIQEVHFLPFNPVEKRTAITYIDGNGDWHRVSKGAPEQIIELCNMGAEAEKKVHALIDGYADRGLRSLGVSYQQVPEKSKESAGDPWQFIGLLPLFDPPRHDSAETIRRALHLGVNVKMITGDQLAIGKETGRRLGMGTNMYPSTTLLGDKNTTVNGMHIDELIEKADGFAGVFPEHKYEIVKRLQDRNHICGMTGDGVNDAPALKKADIGIAVDDATDAARSASDIVLTEPGLSVIVSAVLTSRSIFQRMKNYTIYAVSITIRIVLGFLLIALIWKFDFAPFMVLIIAILNDGTIMTISKDRVKPSPTPDSWKLNEIFATGIVLGTYMAIITAVFFYLAHDTDFFTDVFGVNSIKENDRELMAALYLQVSIISQALIFVTRSRSWSFVERPGFLLLFAFFAAQLVATCIAVYADWDFCRIQGIGWAWGGAIWMFSIVTYIPLDVLKFMIRAALRDKATGNNVHNK

SEQ ID NO: 5298 - protein, 871 aa, Setaria italica
MASISPDDVRDGNVDLSKMPVEEVFKTLKCDRKGLSGAEAEGRLRAFGPNKLEEKKESKLLKFLGFMWNPLSWVMEMAAIMAIVLANGGGKPPDWQDFVGIVTLLIINSTISYIEEANAGDAAAALMAGLAPKTKLLRDGRWEEQDASILVPGDIISIKLGDIIPADARLLEGDPLKIDQSALTGESLPVNKHPGQEVFSGSTVKQGEIEAVVIATGVHTFFGKAAHLVDSTNNVGHFQQVLTAIGNFCIISIAAGMLVEVVVMYSVQHRAYRDGIDNLLVLLIGGIPIAMPTVLSVTMAIGSHRLSQQGAITKRMTAIEEMAGMDILCSDKTGTLTLNKLTVDKSLIEVYSKGVDKDMVLLYAARASRVENQDAIDTCIVNMLADPKEARAGIQEVHFLPFNPVEKRTAITYVDGNGDWHRVSKGAPEQIIELCNMGADAEKKVHALIDGYADRGLRSLGVSYQQVPEKSKESAGEPWQFIGLLPLFDPPRHDSAETIRRALHLGVNVKMITGDQLAIGKETGRRLGMGTNMYPSTTLLGDKNSTVNGMPIDELIEKADGFAGVFPEHKYEIVKRLQERGHICGMTGDGVNDAPALKKADIGIAVDDATDAARSASDIVLTEPGLSVIVSAVLTSRSIFQRMKNYTIYAVSITIRIVLGFLVIALIWKFDFAPFMVLIIAILNDGTIMTISKDRVKPSPKPDSWKLNEIFATGIVLGTYMALVTALFFYLAHDTNFFSDVFGVASIKENDRELMAALYLQVSIISQALIFVTRSRSWSFVERPGYLLLFAFFAAQLVATAIAVYADWEFCRIQGIGWAWGGAIWVFSVVTYIPLDVLKFMIRSALRGQACSKEQNKASLAVLHCYCHQRP

SEQ ID NO: 5299 - protein, 871 aa, Setaria italica
MASISPDDVRDGNVDLSKMPVEEVFKTLKCDRKGLSGAEAEGRLRAFGPNKLEEKKESKVLKFLGFMWNPLSWVMEMAAIMAIVLANGGGKPPDWQDFVGIVTLLIINSTISYIEEANAGDAAAALMAGLAPKTKLLRDGRWEEQDASILVPGDIISIKLGDIIPADARLLEGDPLKIDQSALTGESLPVNKHPGQEVFSGSTVKQGEIEAVVIATGVHTFFGKAAHLVDSTNNVGHFQQVLTAIGNFCIISIAAGMLVEVVVMYSVQHRAYRDGIDNLLVLLIGGIPIAMPTVLSVTMAIGSHRLSQQGAITKRMTAIEEMAGMDILCSDKTGTLTLNKLTVDKSLIEVYSKGVDKDMVLLYAARASRVENQDAIDTCIVNMLADPKEARAGIQEVHFLPFNPVEKRTAITYVDGNGDWHRVSKGAPEQIIELCNMGADAEKKVHALIDGYADRGLRSLGVSYQQVPEKSKESAGEPWQFIGLLPLFDPPRHDSAETIRRALHLGVNVKMITGDQLAIGKETGRRLGMGTNMYPSTTLLGDKNSTVNGMPIDELIEKADGFAGVFPEHKYEIVKRLQERGHICGMTGDGVNDAPALKKADIGIAVDDATDAARSASDIVLTEPGLSVIVSAVLTSRSIFQRMKNYTIYAVSITIRIVLGFLVIALIWKFDFAPFMVLIIAILNDGTIMTISKDRVKPSPKPDSWKLNEIFATGIVLGTYMALVTALFFYLAHDTNFFSDVFGVASIKENDRELMAALYLQVSIISQALIFVTRSRSWSFVERPGYLLLFAFFAAQLVATAIAVYADWEFCRIQGIGWAWGGAIWVFSVVTYIPLDVLKFMIRSALRGQACSKEQNKASLAVLHCYCHQRP

SEQ ID NO: 5300 - protein, 874 aa, Sorghum bicolor
MASISPETIGGDVNLSKIPVEEVFKTLKCDRKGLSSTEGENRLRTFGPNKLEEKKENNLLKFLGFMWNPLSWVMEMAAIMAIALANGGGRPPDWQDFVGIVSLLFINSTISYIEEANAGNAAAALMAGLAPKTKLLRDGRWEEQDAAILVPGDIISIKLGDIIPADARLLEGDPLKIDQSALTGESLPVNKHPGQEVFSGSTVKQGEIEAVVIATGVRTFFGKAAHLVDSTNNVGHFQQVLTAIGNFCIISIAAGMLVEVVVMYPIQHRAYRDGIDNLLVLLIGGIPIAMPTVLSVTMAIGSHRLSQQGAITKRMTAIEEMAGMDMLCSDKTGTLTLNKLTVDKSLIEVYSKGVDKDMVLLYAARASRVENQDAIDTCIVNMLADPKEARAGIQEVHFLPFNPVEKRTAITYIDGNGDWHRVSKGAPEQIIELCNMGAEAEKKVHALIDGYADRGLRSLGVSYQQVPEKSKESAGEPWQFIGLLPLFDPPRHDSAETIRRALHLGVNVKMITGDQLAIGKETGRRLGMGTNMYPSTTLLGDKNSTVNGMHIDELIEKADGFAGVFPEHKYEIVKRLQDRNHICGMTGDGVNDAPALKKADIGIAVDDATDAARSASDIVLTEPGLSVIVSAVLTSRSIFQRMKNYTIYAVSITIRIVLGFLLIALIWKFDFAPFMVLIIAILNDGTIMTISKDRVKPSPTPDSWKLDEIFATGIVLGTYMAIVTAIFFYLAHDTDFFTAVFGVQSIKENDRELMAALYLQVSIISQALIFVTRSRSWSFVERPGFLLLFAFFAAQLVATCIAVYANWDFCRMQGIGWAWGGAIWIFSIVTYIPLDVLKFMIRAALRGKAAGSNVQNKASFLPTLTQQTAPLLLS

SEQ ID NO: 5301 - protein, 951 aa, Zea mays
MASISLEDVRNETVDLETVPVQEVFQHLKCSKEGLSSAEGDNRLKIFGPNKLEEKSESKLLKFLGFMWNPLSWVMEAAAIMAIVLANGGGKPPDWQDFVGIVVLLFINSTISFIEENNAGNAAAALMAGLAPKTKVLRDGKWKEEEASILVPGDIISIKLGDIIPADARLLEGDPLKVDQAALTGESLPVNKHPGQGVFSGSTVKQGEIEAVVIATGVHTFFGKAAHLVDSTNNVGHFQLVLTAIGNFCIISIAVGMVIEIIVMYPIQHRAYRDGIDNLLVLLIGGIPIAMPTVLSVTMAIGSHRLSQQGAITKRMTAIEEMAGMDVLCSDKTGTLTLNKLTVDKTLIEVCGKGVDKDMVLLYAARASRVENQDAIDTCIVGMLADPKEARAGIKEVHFLPFNPVEKRTAITYIDGNGDWHRVSKGAPEQIIELCRMSKDAEKKIHALIDGYADRGLRSLGVSYQLVPEKSKESAGEPWQFIGLLPLFDPPRHDSAETIRRALHLGVNVKMITGDQLAIGKETARRLGMGSNMYPSTTLLGDNKTGEMGGLNIDELIEKADGFAGVFPEHKYEIVKRLQDRKHICGMTGDGVNDAPALKKADIGIAVDDATDAARSASDIVLTEPGLSVIVSAVLTSRAIFQRMKNYTIYAVSITIRIVLGFLLVALVWKFDFAPFMVLIIAILNDGTIMTISKDRVKPSPTPDSWKLKEIFATGIVLGTYMALATALFFYLAHDTDFFTNAFGVRSIKENDKELMAALYLQVSIISQALIFVTRSRSWSFVERPGALLVIAFLAAQLVATCIAVYANWEFCKMQGIGWGWGGAIWAFSVVTYFPLDVLKFAIRYALSGKAWNNINNKTAFTNRTDYGKGEREAQWATAQRTLHGLNQATATSDLFGDNQGYRELSELAEQAAKRAEVARLRELHTLKGHVESVVKLKGLDIDTIQQSYTV

SEQ ID NO: 5302 - protein, 951 aa, Sorghum bicolor
MASISLEDVRNETVDLETVPVQEVFQHLKCSKQGLSSAEGENRLKIFGPNKLEEKSESKLLKFLGFMWNPLSWVMEAAAIMAIVLANGGGKPPDWQDFVGIVVLLFINSTISFIEENNAGNAAAALMAGLAPKTKVLRDGKWKEEDASILVPGDIISIKLGDIIPADARLLEGDPLKVDQAALTGESLPVNKHSGQGVFSGSTVKQGEIEAVVIATGVHTFFGKAAHLVDSTNNVGHFQLVLTAIGNFCIISIAVGMVIEIIVMYPIQHRAYRDGIDNLLVLLIGGIPIAMPTVLSVTMAIGSHRLSQQGAITKRMTAIEEMAGMDVLCSDKTGTLTLNKLTVDKTLIEVCGKGVDKDMVLLYAARASRVENQDAIDTCIVGMLADPKEARAGIKEVHFLPFNPVEKRTAITYIDGNGDWHRVSKGAPEQIIELCRMSKDAEKKIHAVIDGYADRGLRSLGVSYQQVPEKSKESAGEPWQFIGLLPLFDPPRHDSAETIRRALHLGVNVKMITGDQLAIGKETARRLGMGSNMYPSTTLLGDNKGGEMGGLNIDELIEKADGFAGVFPEHKYEIVKRLQDRKHICGMTGDGVNDAPALKKADIGIAVDDATDAARSASDIVLTEPGLSVIVSAVLTSRAIFQRMKNYTIYAVSITIRIVLGFLLVALVWEFDFAPFMVLIIAILNDGTIMTISKDRVKPSPTPDSWKLKEIFATGIVLGTYMALATALFFYLAHDTEFFSETFGVRSIKENDKELMAALYLQVSIISQALIFVTRSRSWSFVERPGALLVIAFLAAQLVATCIAVYANWEFCKMQGIGWGWGGAIWAFSVVTYFPLDVLKFAIRYALSGKAWNNINNKTAFTNRTDYGKGEREAQWATAQRTLHGLNQATATSDLFGDNQGYRELSELADQAAKRAEVARLRELHTLKGHVESVVKLKGLDIDTINQSYTV

SEQ ID NO: 5303 - protein, 950 aa, Oryza sativa
MASISLEDVRNETVDLETIPVEEVFQHLKCSKQGLSAAEGQNRLNIFGPNKLEEKTESKLLKFLGFMWNPLSWVMEAAAIMAIVLANGGGRPPDWQDFVGIVVLLVINSTISFIEENNAGNAAAALMAGLAPKTKVLRDGKWQEQDASILVPGDIISIKLGDIIPADARLLEGDPLKVDQAALTGESMPVNKHAGQGVFSGSTVKQGEIEAVVIATGVHTFFGKAAHLVDSTNNIGHFQLVLTAIGNFCIISIGVGMIIEIIVMYPIQHRAYRDGIDNLLVLLIGGIPIAMPTVLSVTMAIGSHRLSQQGAITKRMTAIEEMAGMDVLCSDKTGTLTLNKLTVDKTLIEVYGRGLDKDSVLLYAARASRVENQDAIDTCIVGMLADPKEARAGIKEVHFLPFNPVEKRTAITYIDGNGEWHRISKGAPEQIIELCKMSKDAEKKVHTLIDQYADRGLRSLGVSYQKVPEKSKESEGEPWQFVGLLPLFDPPRHDSAETIRRALHLGVNVKMITGDQLAIGKETARRLGMGTNMYPSTTLLGDKSSEMSGLPIDELIEKADGFAGVFPEHKYEIVKRLQDRKHICGMTGDGVNDAPALKKADIGIAVDDATDAARSASDIVLTEPGLSVIVSAVLTSRAIFQRMKNYTIYAVSITIRIVLGFMLVALLWKFDFAPFMVLIIAILNDGTIMTISKDRVKPSPTPDSWKLKEIFATGIVLGTYMALITALFFYLAHDTDFFTETFGVRSIKTNEKEMMAALYLQVSIISQALIFVTRSRSWSFVERPGALLVIAFLAAQLVATCIAVYAEWEFCKMQGIGWGWGGAIWAFSVVTYFPLDVLKFIIRYALSGRAWNNINNKTAFVNKNDYGKGEREAQWATAQRTLHGLNQSSTSSDLFNDKTGYRELSEIAEQAAKRAEVARLRELHTLKGHVESVVKLKGLDIDTIQQSYTV

SEQ ID NO: 5304 - protein, 864 aa, Brachypodium distachyon
MASISLEDVRNETVDLETIPVQEVFQHLKCSKQGLSASEAENRLRIFGPNKLEEKTENKLLKFLGFMWNPLSWVMEAAAIMAIVLANGGGKPPDWQDFVGIVVLLFINSTISFIEENNAGNAAAALMAGLAPKTKVLRDGKWLEMDASILVPGDIISIKLGDIIPADARLLEGDPLKVDQAALTGESMPVNKHAGQGVFSGSTVKQGEIEAVVIATGVHTFFGKAAHLVDSTNNVGHFQLVLTAIGNFCIISIAAGMLVEVVVMYPIQHRAYRDGIDNLLVLLIGGIPIAMPTVLSVTMAIGSHRLSQQGAITKRMTAIEEMAGMDVLCSDKTGTLTLNKLTVDKSLIEVCGRGIDKDTVLLYAARASRVENQDAIDTCIVGMLADPKEARAGIQEVHFLPFNPVEKRTAITYIDGNGDWHRISKGAPEQIIELCRMPKEAEKRIHSLIDSYADRGLRSLGVSYQQVPAKNKDSPGEPWQFTGLLPLFDPPRHDSAETIRRALHLGVNVKMITGDQLAIGKETARRLGMGTNMYPSTTLLGDKSTEMSGLPIDELIEKADGFAGVFPEHKYEIVKRLQDRKHICGMTGDGVNDAPALKKADIGIAVDDATDAARSASDIVLTEPGLSVIVSAVLTSRAIFQRMKNYTIYAVSITIRIVLGFMLVALLWKFDFAPFMVLIIAILNDGTIMTISKDRVKPSPTPDSWKLKEIFATGVVLGTYMALVTVLFFYLAHDTDFFTETFGVRSIKENEKELMAALYLQVSIISQALIFVTRSRSWSFVERPGFLLLAAFLAAQLVATCIAVYANWEFCRMQGIGWGWGASIWAFSIVTYIPLDVLKFIIRYALSGRAWNNINNKASRSQPR

SEQ ID NO: 5305 - protein, 951 aa, Setaria italica
MASISLEDVRNETVDLETVPVQEVFQHLKCSKQGLSSAEAENRLKIFGPNKLEEVSESKLLKFLGFMWNPLSWVMESAALMAIVLANGGGKPPDWQDFVGITVLLFINSTISFIEENNAGNAAAALMAGLAPKTKVLRDGKWKEEDASILVPGDIISIKLGDIIPADARLLEGDPLKVDQAALTGESLPVNKHPGQGVFSGSTVKQGEIEAVVIATGVHTFFGKAAHLVDSTNNVGHFQLVLTAIGNFCIISIAVGMVIEIIVMYPIQHRAYRDGIDNLLVLLIGGIPIAMPTVLSVTMAIGSHRLSQQGAITKRMTAIEEMAGMDVLCSDKTGTLTLNKLTVDKTLIEVCGKGVDKDMVLLYAARASRVENQDAIDTCIVSMLADPKEARAGIKEVHFLPFNPVEKRTAITYVDGNGDWHRVSKGAPEQIIELCRMSKDAEKRIHALIDSYADRGLRSLGVSYQQVPEKSKESAGDPWQFIGLLPLFDPPRHDSAETIRRALHLGVNVKMITGDQLAIGKETARRLGMGSNMYPSTTLLGDNKTGEMGGLNIDELIEKADGFAGVFPEHKYEIVKRLQDRKHICGMTGDGVNDAPALKKADIGIAVDDATDAARSASDIVLTEPGLSVIVSAVLTSRAIFQRMKNYTIYAVSITIRIVLGFLLVALVWEFDFAPFMVLIIAILNDGTIMTISKDRVKPSPTPDSWKLKEIFATGIVLGTYMALTTALFFYLAHDTDFFTKTFGVRSIKENDKELMAALYLQVSIISQALIFVTRSRSWSFVERPGALLVIAFLAAQLVATCIAVYANWEFCKMQGIGWGWGAAIWVFSIVTYFPLDVLKFGIRYALSGKAWNNINNKTAFTNRTDYGKGEREAQWATAQRTLHGLNQATTSSDLFGDTNSYRELSELAEQAAKRAEMARLRELHTLKGHVESVVKLKGLDIDTIQQSYTV

SEQ ID NO: 5306 - protein, 780 aa, Panicum virgatum
MASISPEDVRNGNVDLSKMPVEEVFKTLKCSRKGLSSAEGEGRLKAFGPNKLEEKKESKLLKFLGFMWNPLSWVMEMAAIMAIVLANGGGKPPDWQDFVGIVSLLIINSTISYIEEANAGDAAAALMAGLAPKTKLLRDGRWEEQDASILVPGDIISIKLGDIIPADARLLEGDPLKIDQSALTGESLPVNKHPGQEVFSGSTVKQGEIEAVVIATGVHTFFGKAAHLVDSTNNVGHFQQVLTAIGNFCIISIAAGMLVEVVVMYPIQHRAYRDGIDNLLVLLIGGIPIAMPTVLSVTMAIGSHRLSQQGAITKRMTAIEEMAGMDILCSDKTGTLTLNKLTVDKSLIEVYSKGVDKEMVLLYAARASRVENQDAIDTCIVNMLADPKEARAGIQEVHFLPFNPVEKRTAITYIDGNGDWHRVSKGAPEQIIELCNMSAEAEKKVHALIDGYADRGLRSLGVSYQQVPEKSKESAGDPWQFIGLLPLFDPPRHDSAETIRRALHLGVNVKMITGDQLAIGKETGRRLGMGTNMYPSTTLLGDKGSTVNGMPIDELIEKADGFAGVFPEHKYEIVKRLQDRRHICGMTGDGVNDAPALKKADIGIAVDDATDAARSASDIVLTEPGLSVIVSAVLTSRSIFQRMKNYTIYAVSITIRIVLGFLLIALIWKFDFAPFMVLIIAILNDGTIMTISKDRVKPSPKPDSWKLNEIFATGIVLGTYMALVTALFFYLAHDTDFFTDVFGVTSIKENDGELMSALYLQVSIISQALIFVTRSRSWSF

SEQ ID NO: 5307 - protein, 805 aa, Brachypodium distachyon
MWNPLSWVMEIAAIMAIALANGGGRPPDWQDFVGIVSLLFINSTISYIEEANAGDAAAALMAGLAPKTKLLRDGRWEEQDAAILVPGDIVSIKLGDIIPADARLLEGDALKIDQSALTGESMPVNKYAGQEVFSGSTVKQGEIEAVVIATGVHTFFGKAAHLVDSTNNVGHFQQVLTAIGNFCIISIAAGMLVEILVMYPIQHRAYRDGIDNLLVLLIGGIPIAMPTVLSVTMAIGSHRLSQQGAITKRMTAIEEMAGMDVLCSDKTGTLTLNKLTVDKSLIEVCSKSVDKDMVLLYAARASRVENQDAIDTCIVNMLADPKEARAGIQEVHFLPFNPVDKRTAITYIDGNGDWHRVSKGAPEQIIELCNMAPEAEKKVHASIDQYADRGLRSLGVSYQQVPEKNKESAGEPWQFIGLLPLFDPPRHDSAETIRRALHLGVNVKMITGDQLAIGKETGRRLGMGTNMYPSTALLGDKNSPVNGLPIDELIEKADGFAGVFPEHKYEIVKRLQDKKHIVGMTGDGVNDAPALKKADIGIAVDDATDAARSASDIVLTEPGLSVIVSAVLTSRAIFQRMKNYTIYAVSITIRIVLGFLLVALIWKFDFAPFMVLIIAILNDGTIMTISKDRVKPSPTPDSWKLNEIFATGVVLGTYMALVTVLFFYLAHDTDIFTETFGVRPIRDNDRELMAALYLQVSIISQALIFVTRSRSWSFVERPGFLLLFAFFAAQLVATAIAVYADWDFCGMQGIGWSWGGAIWAFSVATYIPLDVLKFIIRYSLSGKGWDNVQNKASTRDHSFHEIDRY

SEQ ID NO: 5308 - protein, 949 aa, Musa acuminata
MATDLEQIKNESVDLESIPVEEVFAQLKCSREGLTSAEGEQRLQIFGLNKLEEKQECKVLKFLGFMWNPLSWVMEIAAIMAIALANGGGEPPDWQDFVGIVVLLIINSTISFIEENNAGNAAAALMAGLAPKTKVLRDGKWSEQEAAILVPGDIISIKLGDIVPADARLLEGDPLKIDQSALTGESLPVTKHPGDEVFSGSTCKQGEIEAIVIATGVHTFFGKAAHLVDSTNNVGHFQKVLTAIGNFCICSIAVGMLIEVIVMYPIQHRRYRDGIDNLLVLLIGGIPIAMPTVLSVTMAIGSHRLSEQGAITKRMTAIEEMAGMDVLCSDKTGTLTLNKLTVDKTLIEVFVSGLDKDSVVLYAAMASRVENQDAIDASIVGMLADPKEARAGIQEVHFLPFNPVDKRTAITYIDSNGKWHRSSKGAPEQIIDLCNMKDDAKKKVHAMIDKFAERGLRALGVARQEVPEANKESAGDPWQFIGLLPLFDPPRHDSAETIRQALHLGVNVKMITGDQLAIGKETGRRLGMGTNMYPSSTLLGDKNDDVTGLPIDELIEKADGFAGVFPEHKYEIVKRLQDRKHICGMTGDGVNDAPALKKADIGIAVADATDAARSASDIVLTEPGLSVIVSAVLTSRAIFQRMKNYTIYAVSITIRIVLGFMLIALIWQFDFSPFMVLIIAILNDGTIMTISKDRVKPSPLPDSWKLREIFATGVVLGAYLAIMTVVFFWLAHATDFFPEKFGVRPIKDNQEELTAALYLQVSIISQALIFVTRSRSWSFVERPGFLLVAAFVAAQLVATVIAVYASWSFARIQGIGWGWAGIIWLFSLITYFPLDILKFIIRYALSGKAWDNLLQNKTAFTTKKDYGRGEREAQWALAQRTLHGLQPADTSDLFNDKSSYRELSEIAEQAKRRAEVARLRELHTLKGHVESVVKLKGLDIETIQQHYTV

SEQ ID NO: 5309 - protein, 773 aa, Panicum virgatum
ISPEDVRNGNVDLSKMPVEEVFKTLKCSRKGLSSAEGEGRLRAFGPNKLEEKKESRLLKFLGFMWNPLSWVMEMAAIMAIVLANGGGKPPDWQDFVGIVSLLIINSTISYIEEANAGDAAAALMAGLAPKTKLLRDGRWEEQDASILVPGDIISIKLGDIIPADARLLEGDPLKIDQSALTGESLPVNKHPGQEVFSGSTVKQGEIEAVVIATGVHTFFGKAAHLVDSTNNVGHFQQVLTAIGNFCIISIAAGMLVEVVVMYPIQHRAYRDGIDNLLVLLIGGIPIAMPTVLSVTMAIGSHRLSQQGAITKRMTAIEEMAGMDILCSDKTGTLTLNKLTVDKSLIEVYSKGVDKEMVLLYAARASRVENQDAIDTCIVNMLADPKEARAGIKEVHFLPFNPVEKRTAITYIDGNGDWHRVSKGAPEQIIELCNMGADAEKKVHALIDGYADRGLRSLGVSYQQVPEKSKESAGDPWQFIGLLPLFDPPRHDSAETIRRALHLGVNVKMITGDQLAIGKETGRRLGMGTNMYPSTTLLGDKGSTVNGMPIDELIEKADGFAGVFPEHKYEIVKRLQDRKHICGMTGDGVNDAPALKKADIGIAVDDATDAARSASDIVLTEPGLSVIVSAVLTSRSIFQRMKNYTIYAVSITIRIVLGFLLIALIWEFDFAPFMVLIIAILNDGTIMTISKDRVKPSPKPDSWKLNEIFATGIVLGTYMALVTALFFYLAHDTDLFSDVFGVASIKENDGELMSALYLQVSIISQALIFVTRSR

SEQ ID NO: 5310 - protein, 960 aa, Musa acuminata
MATGYTGVGTKSVSLEDIKNESVDLEKVPVSEVFEHLKCNQEGLTAEEGEDRLQIFGPNKLEEKTESKFLKFLGFMWNPLSWVMEIAAIMAIVLANGGGEPPDWQDFVGIVVLLIINSTISFIEENNAGNAAAALMAGLAPKTKVLRDGKWSEQEAAILVPGDIISIKLGDIIPADARLLEGDPLKIDQSALTGESLPVTKNPGDEIFSGSTCKQGEIEAVVIATGVHTFFGKAAHLVDSTNNVGHFQKVLTAIGNFCICSIAFGMLVEIIVMYPIQHRRYRDGIDNLLVLLIGGIPIAMPTVLSVTMAIGSHRLSEQGAITKRMTAIEEMAGMDVLCSDKTGTLTLNKLTVDKSLIEVFVKDMDKDTVVLYAARASRVENQDAIDACIVGMLADPKEARAGIQELHFLPFNPVEKRTAITYVDSKGKWHRASKGAPEQIIDLCNMKEDARKKVHAMIGKFADRGLRALGVARQEVPEASKESAGAPWQFMGLLPLFDPPRHDSAETIRRALNLGVNVKMITGDQLAIAKETGRRLGMGTNMYPSSTLLGEKNDDTTGLPIDDLIEKADGFAGVFPEHKYEIVRRLQEKKHICGMTGDGVNDAPALKKADIGIAVADATDAARSASDIVLTEPGLSVIVSAVLTSRAIFQRMKNYTIYAVSITIRIVLGFMLVALIWRFDFSPFMVLVIAILNDGTIMTISKDRVKASPLPDSWKLREIFATGIVLGAYLAIMTVVFFYVAHDTDFFSEAFGVRSIKDHSDEMTAALYLQVSIISQALIFVTRSRSWSFVERPGLLLVFAFIAAQLVATVIAVYASWGFARIQGIGWGWAGVIWLYSLITYFPLDVLKFIIRYALSGRAWDNFLQNKTAFTSKKDYGKGEREAQWALAQRTLHGLQLPPDTSGLFDDNNNYRELSEIAEQAKRRAEVARLRELHTLKGHVESVVKLKGLDIEGMPQHYTL

SEQ ID NO: 5311 - protein, 956 aa, Musa acuminata
MATAGGDGSISLEQIKNESVDLERIPVEEVFAQLKCSREGLSSPEGEQRLQIFGPNKLEEKTESKFLKFLGFMWNPLSWVMEIAAIMAIALDNGGGEPPDWQDFIGIVVLLLINSTISFIEENNAGNAAAALMAGLAPKTKVLRDDKWSEQEAAILVPGDIISIKLGDIIPADARLLEGDPLKIDQSALTGESLPVTKHPGDEVFSGSTCKQGEIEAIVIATGVHTFFGKAAHLVDSTNNVGHFQKVLTAIGNFCICSIAIGMIIEIIVMYPIQHRRYRDGIDNLLVLLIGGIPIAMPTVLSVTMAIGSHRLSEQGAITKRMTAIEEMAGMDVLCSDKTGTLTLNKLTVDKSLIEVFVSGLDKDSVVLYAARASRVENQDAIDASIVNMLADPKEARAGIQEVHFLPFNPVDKRTAITYIDSNGKWHRSSKGAPEQIIDLCNLRDDAKKKVHSMIDKFAERGLRALGVARQEVPEANKESAGGPWQFMGLLPLFDPPRHDSAETIRRALDLGVNVKMITGDQLAIGKETGRRLGMGTNMYPSSTLLGEKNDDVSGLPIDELIEKADGFAGVFPEHKYEIVKRLQDRKHICGMTGDGVNDAPALKKADIGIAVADATDAARSASDIVLTEPGLSVIVSAVLTSRAIFQRMKNYTIYAVSITIRIVLGFMLIALIWRFDFSPFMVLIIAILNDGTIMTISKDRVKPSPLPDSWKLREIFATGIVLGTYLALMTVVFFWLAHDTDFFPEKFGVKPIRDNLNELTAALYLQVSIISQALIFVTRSRSWSFVERPGLLLVTAFIAAQLVATVIAAYASWGFARIQGIGWGWAGIIWLFSLVTYFPLDVLKFIIRYTLSGKAWDNLLENKTAFTTKKDYGRGEREAQWALAQRTLHGLQPADTPGLFNDKSSYRELSEIAEQAKKRAEVARLRELHTLKGHVESVVKLKGLDIETIQQHYTV

SEQ ID NO: 5312 - protein, 953 aa, Ananas comosus
AAAAAASASFLEEIRNESVDLERIPIEEVFEQLKCSREGLSSAEGEQRLQLFGPNKLEEKKENKFLKFLGFMWNPLSWVMEIAAIMAIALANGGGRPPDWQDFVGIVVLLVINSTISFIEENNAGNAAAALMAGLAPKTKVLRDGRWSEQEAAILVPGDIISIKLGDIIPADARLLEGDPLKIDQSALTGESLPVTKSPGDEIFSGSTCKQGEIEAVVIATGVHTFFGKAAHLVDSTNNVGHFQKVLTAIGNFCICSIAVGMLIEIVVMYPIQHRRYREGIDNLLVLLIGGIPIAMPTVLSVTMAIGSHRLSEQGAITKRMTAIEEMAGMDVLCSDKTGTLTLNKLTVDKTMIEAFVKDIDRDTVVLYAARASRVENQDAIDASIVGMLADPKEARAGIQEVHFLPFNPVEKRTAITYIDSAGKWHRISKGAPEQIIDLCNLREDARKRVHGIIDKFADRGLRALAVARQEVPEAAKESAGGPWQFVAVLPLFDPPRHDSAETIRRALNLGVNVKMITGDQLAIAKETGRRLGMGTNMYPSSTLLADKKDDLAGGLPVDELIEKADGFAGVFPEHKYEIVRRLQERRHICGMTGDGVNDAPALKKADIGIAVADATDAARGASDIVLTEPGLSVIVSAVLTSRAIFQRMKNYTIYAVSITIRIVLGFLLIALIWRFDFSPFMVLIIAILNDGTIMTISKDRVKPSPLPDSWKLREIFATGVVLGAYMAVMTVVFFWIAHDTDFFPQIFGVRSIREHEDELMSALYLQVSIISQALIFVTRSRSWSFIERPGLLLVTAFIAAQLVATAVAVYATWGFARIQGIGWGWAGVIWVYSLVTYFPLDILKFIIRYALSGKAWDNLIQNKTAFTNKKDYGRGEREAQWALAQRTLHGLQPPDASGFFSDKSYRELSEIAEQAKRRAEVARLRELHTLKGHVESVVKLKGLDIETIQQHY

SEQ ID NO: 5313 - protein, 931 aa, Cocos nucifera
PVEEVFEQLKCSREGLTSAEGEQRLQIFGPNKLEEKKESKLLKFLGFMWNPLSWVMEIAAIMAIVLANGGGQPPDWQDFVGIVVLLIINSTISFIEENNAGNAAAALMAGLAPKTKVLRDGKWSEQEAAMLVPGDIISIKLGDIVPADARLLEGDPLKIDQSALTGESLPVTKNPGDEVFSGSTCKQGEIEAIVIATGVHTFFGKAAHLVDSTNNVGHFQKVLTAIGNFCICSIALGMLIEIIVMYPIQHRRYRDGIDNLLVLLIGGIPIAMPTVLSVTMAIGSHRLSEQGAITKRMTAIEEMAGMDVLCSDKTGTLTLNKLTVDKNLVEVFVKDMDKDTVLLYAGRASRVENQDAIDASIVGMLADPKEARAGIQEVHFLPFNPVDKRTAITYVDSDGRWHRASKGAPEQIIDLCNMKEDAKKEVHEIIDKFADRGLRSLGVARQEVPEANKESAGGPWQFVGLLPLFDPPRHDSAETIRRALHLGVNVKMITGDQLAIGKETGRRLGMGTNMYPSSTLLGDKNTEITGLPIDELIEKADGFAGVFPEHKYEIVKRLQERKHICGMTGDGVNDAPALKKADIGIAVADATDAARSASDIVLTEPGLSVIVSAVLTSRAIFQRMKNYTIYAVSITIRIVLGFMLIALIWRFDFSPFMVLVIAILNDGTIMTISKDRVKPSPVPDSWKLKEIFATGVVLGAYMAVMTVVFFWIAHDTDIVTEKFGLKPIRDNTDELTAALYLQVSIISQALIFVTRSRSWSFIERPGVLLVTAFIAAQLVATVIAVYASWGFARIQGIGWGWAAFVWVYSVITYIPLDILKFITRYVLSGKAWDNLLQNKTAFTSKKDYGRGEREAQWAMAQRTLHGLQSPDTSGLFNDKNGYRELSEIAEQAKRRAEVARLRELHTLKGHVESVVKLKGLDIETIQQHYTV

SEQ ID NO: 5314 - protein, 955 aa, Musa acuminata
MATDGYGSISLEEIRNETVDLESIPVEEVFTQLKCSQEGLTTAEGEQRLHIFGLNKLEEKKESKFLKFLGFMWNPLSWVMEIAAIMAIVLDNGGGEPPDWQDFIGIVVLLIINSTISFIEENNAGNAAAALMAGLAPKTKVLRDGKWSEQEAAILVPGDIISIKLGDIIPADARLLEGDPLKIDQSALTGESLPVTKMPGNEVFSGSTCKQGEIEAIVIATGVHTFFGKAAHLVDSTNNVGHFQKVLTAIGNFCICSIAMGMIIEIIVMYPIQHRRYRDGIDNLLVLLIGGIPIAMPTVLSVTMAIGSHRLSEQGAITKRMTAIEEMAGMDVLCSDKTGTLTLNKLSVDRNLIEVFVNGLDRDTVVLYAARASRVENQDAIDASIVGMLAEPKEARAGIEEVHFLPFNPVDKRTAITYIDSDGKWHRSSKGAPEQIIDLCNLKDDTKKKVHAMIDKFAERGLRALGVARQEVPEATKASAGDPWQFMGLLPLFDPPRHDSAETIRQALHLGVNVKMITGDQLAIAKETGRRLGMGTNMYPSSTLLGEKTDDVTGLPIDDLIEKADGFAGVFPEHKYEIVRRLQERKHICGMTGDGVNDAPALKKADIGIAVADATDAARSASDIVLTEPGLSVIVSAVLTSRAIFQRMKNYTIYAVSITIRIVLGFMLIALIWQFDFSPFMILVIAILNDGTIMTISKDRVKPSPLPDSWKLREIFATGIVLGAYLAIITVVFFWLVHDTDFFPEKFGVKSIRDNNNELTAALYLQVSIISQALIFVTRSRSWSFVERPGFLLVTAFLAAQLVATVIAVYASWGFARIQGIGWGWAAIIWIFSLVTYFPLDVLKFIIRYALSGRAWDNLLQNKTAFTTKKDYGREEREAQWALAQRTLHGLQVPDTSALFNDNNSYRELSEIADQAMRRAEVARLRELNTLKGHVESVVKLKGLDIDTIQQHYTV

SEQ ID NO: 5315 - protein, 949 aa, Cyclamen graecum
MASQSELSLEQIKNELVDLENVPIEEVFVQLKCSREGLTSDEGDRRLELFGPNKLEEKKESKVLKFLGFMWNPLSWVMECAAIMAIALANGGGKAPDWQDFVGIVVLLIINSTISFIEENNAGNAAAALMAGLAPKTKVLRDGKWSEQEAAILVPGDLISVKLGDIIPADARLLEGDPLKIDQSALTGESLPVTKYPGNEVFSGSTCKQGELEAVVIATGVHTFFGKAAHLVDSTNQVGHFQKVLTAIGNFCICSIGIGMLVEILVMYPIQGRAYRQGIDNLLVLLIGGIPIAMPTVLSVTMAIGSHRLSQQGAITKRMTAIEEMAGMDVLCSDKTGTLTLNKLTVDKTLIEVFAKDLDKDSVVLLAARASRIENQDAIDASIVGMLGDPKEARAGLTEVHFLPFNPVDKRTAITYIDNDGNWHRCSKGAPEQIIELCNLKGNAKNKSLAIIDNYANRGLRSLGVARQTVSEKSKESAGDPWEFVGLLPLFDPPRHDSAETIRRALDLGVNVKMITGDQLAIGKETGRRLGMGTNMYPSSSLLGQCKDESITGIPIDELIEKADGFAGVFPEHKYEIVKKLQERKHICGMTGDGVNDAPALKKADIGIAVADATDAARGASDIVLTEPGLSVIVSAVLTSRAIFQRMKNYTIYAVSITIRIVMGFMLIALIWKFDFSPFMVLIIAILNDGTIMTISKDRVKPSPLPDSWKLKEIFATGVVLGTYLAIMTVVFFWLAADTDFFSNTFGVRSLRGNVDELTAALYLQVSIVSQALIFVTRSRGWSFVERPGVLLVTAFFLAQLVATLIAVYAHWDFARIHGCGWGWAGVIWLFSLITYFPLDVLKFIIRYALSGKAWDTMIEHKTAFTTKKDYGRGAREAQWAMAQRTLHGLQSAEGYNDEHHNESELADQAKKRAEVARLRELHTLKGHVESVVKQKGLDIDTIQQHYTV

SEQ ID NO: 5316 - protein, 952 aa, Vitis vinifera
MASTMSLEEIKNESVDLERIPIEEVFEQLKCTKDGLTSEEGEHRLQIFGHNKLEEKKESKILKFLGFMWNPLSWVMECAAIMAIVLANGGGKPPDWQDFVGITVLLIINSTISFIEENNAGNAAAALMAGLAPKTKVLRDGKWSEQEAAILVPGDVISIKLGDIVPADARLLEGDPLKIDQSALTGESLPVTKNPGDEVFSGSTCKQGEIEAVVIATGVHTFFGKAAHLVDSTNQVGHFQKVLTAIGNFCICSIAVGMLVEIVVMYPIQQRKYREGIDNLLVLLIGGIPIAMPTVLSVTMAIGSHRLSEQGAITKRMTAIEEMAGMDVLCSDKTGTLTLNKLTVDKTLIEVFPKDMDKDSVVLLAARASRVENQDAIDASIVGMLGDPKEARAGITEVHFLPFNPVDKRTAITYIDANGDWHRCSKGAPEQIIDLCELKGDVKDKAHSIIDNYADRGLRSLAVARQTIPEKTKESAGKPWEFVGLLPLFDPPRHDSAETIRRALNLGVNVKMITGDQLAIGKETGRRLGMGTNMYPSSSLLGQSKDESIATIPVDELIEKADGFAGVFPEHKYEIVKKLQERKHICGMTGDGVNDAPALKKADIGIAVADATDAARSASDIVLTEPGLSVIVSAVLTSRAIFQRMKNYTIYAVSITIRIVLGFMLIALIWKFDFSPFMVLIIAILNDGTIMTISKDRVKPSPMPDSWKLKEIFATGIVLGTYLALITVLFFWLIHDTDFFSDKFGVRSIRHNRDEVTAALYLQVSIVSQALIFVTRSQSWSFVERPGLLLVGAFIAAQLVATCIAVYPSWGFARIEGIGWGWAGAIWLFSIITYFPLDILKFIIRYGLSGKAWDNLLQNKTAFTTKKDYGRGEREAQWALAQRTLHGLQPPETSNLFNDNSSYRELSEIAEQAKRRAEVARLRELHTLKGHVESVVKLKGLDIETIQQHYTV

SEQ ID NO: 5317 - protein, 948 aa, Arabidopsis lyrata
MATDISWDEIKKENVDLERIPVEEVFEQLKCSKEGLSSDEGKKRLEIFGANKLEEKSENKFLKFLGFMWNPLSWVMESAAIMAIVLANGGGKPPDWQDFIGIMVLLIINSTISFIEENNAGNAAAALMANLAPKTKVLRDGKWGEQEASILVPGDLISIKLGDIVPADARLLEGDPLKIDQSALTGESLPVTKHPGDEVFSGSTCKQGEIEAVVIATGVHTFFGKAAHLVDSTNNVGHFQKVLTSIGNFCICSIGLGMLIEILIMYPIQHRTYRDGIDNLLVLLIGGIPIAMPTVLSVTMAIGSHRLSQQGAITKRMTAIEEMAGMDVLCSDKTGTLTLNKLSVDKSLIEVFPKNMDTDSVVLMAARASRIENQDAIDASIVGMLGDPKEARTGITEVHFLPFNPVDKRTAITYIDESGDWHRSSKGAPEQIIELCNLQGETKRKAHEVIDGFAERGLRSLGVAQQTVPEKTKESDGSPWEFVGLLPLFDPPRHDSAETIRRALELGVNVKMITGDQLAIGIETGRRLGMGTNMYPSTSLLGNSKDESLVGIPIDELIEKADGFAGVFPEHKYEIVKKLQERKHICGMTGDGVNDAPALKKADIGIAVADATDAARSASDIVLTEPGLSVIVSAVLTSRAIFQRMKNYTIYAVSITIRIVLGFMLVALIWRFDFAPFMVLIIAILNDGTIMTISKDRVKPSPVPDSWKLNEIFATGVVLGTYMALTTVLFFWLAHDTNFFSKTFGVRSIQGNEEELMAALYLQVSIISQALIFVTRSRSWSFVERPGFLLLIAFVIAQLVATLIAVYANWGFARIVGCGWGWAGVIWVYSIITYIPLDILKFIIRYALTGKAWDNMINQKTAFTTKKDYGKGEREAQWALAQRTLHGLPPPEAMFHDNKNELSEIAEQAKRRAEVARLRELHTLKGHVESVVKLKGLDIDTIQQHYTV

SEQ ID NO: 5318 - protein, 955 aa, Musa acuminata
MATDGYGSISLEEIRNETVDLESIPVEEVFTQLKCSQEGLTTAEGEQRLHIFGLNKLEEKKESKFLKFLGFMWNPLSWVMEIAAIMAIVLDNGGGEPPDWQDFIGIVVLLIINSTISFIEENNAGNAAAALMAGLAPKTKVLRDGKWSEQEAAILVPGDIISIKLGDIIPADARLLEGDPLKIDQSALTGESLPVTKMPGNEVFSGSTCKQGEIEAIVIATGVHTFFGKAAHLVDSTNNVGHFQKVLTAIGNFCICSIAMGMIIEIIVMYPVQHRRYRDGIDNLLVLLIGGIPIAMPTVLSVTMAIGSHRLSEQGAITKRMTAIEEMAGMDVLCSDKTGTLTLNKLSVDRNLIEVFVNGLDRDTVVLYAARASRVENQDAIDASIVGMLAEPKEARAGIEEVHFLPFNPVDKRTAITYIDSDGKWHRSSKGAPEQIIDLCNLKDDTKKKVHAMIDKFAERGLRALGVARQEVPEATKASAGDPWQFMGLLPLFDPPRHDSAETIRQALHLGVNVKMITGDQLAIAKETGRRLGMGTNMYPSSTLLGEKTDDVTGLPIDDLIEKADGFAGVFPEHKYEIVRRLQERKHICGMTGDGVNDAPALKKADIGIAVADATDAARSASDIVLTEPGLSVIVSAVLTSRAIFQRMKNYTIYAVSITIRIVLGFMLIALIWQFDFSPFMILVIAILNDGTIMTISKDRVKPSPLPDSWKLREIFATGIVLGAYLAIITVVFFWLVHDTDFFPEKFGVKSIRDNNNELTAALYLQVSIISQALIFVTRSRSWSFVERPGLLLVTAFLAAQLVATVIAVYASWGFARIEGIGWGWAAIIWIFSLVTYFPLDVLKFIIRYALSGRAWDNLLQNKTAFTTKKDYGREEREAQWALAQRTLHGLQVPDTSALFNDNNSYRELSEIADQAMRRAEVARLRELNTLKGHVESVVKLKGLDIDTIQQHYTV

SEQ ID NO: 5319 - protein, 946 aa, Secale cereale
MASLSLEDVRNETVDLSTVAVDEVFKTLKCDKKGLSEAEGENRLKLFGPNKLEEKKESKLLKFLGFMWNPLSWVMEIAAIMAIALANGGGRPPDWQDFVGIVTLLFINSTISYIEEANAGDAAAALMAGLAPKTKLLRDGSWEERDAAILVPGDIISIKLGDIIPADARLLDGDALKIDQSALTGESMPVNKYAGQEVFSGSTVKQGELEAVVIATGVHTFFGKAAHLVDSTNNVGHFQQVLTAIGNFCIISIAAGMLVEIIVMYPIQHRAYRDGIDNLLVLLIGGIPIAMPTVLSVTMAIGSHRLSQQGAITKRMTAIEEMAGMDVLCSDKTGTLTLNKLTVDKTLIEVCSKGVDKEMVLLYAARASRVENQDAIDTCIVNMLADPKEARAGIQEVHFLPFNPVDKRTAITYVDGNGDWHRVSKGAPEQIIELCKMAPDAEKKVHALIDSYADRGLRSLGVSYQQVPEKNKESGGDPWQFIGLLPLFDPPRHDSAETIRRALHLGVNVKMITGDQLAIGKETGRRLGMGTNMYPSTALLGDKNTAVDGLPIDELIEKADGFAGVFPEHKYEIVKRLQDKKHIVGMTGDGVNDAPALKKADIGIAVDDATDAARSASDIVLTEPGLSVIVSAVLTSRAIFQRMKNYTIYAVSITIRIVLGFMLVALIWKFDFAPFMVLIIAILNDGTIMTISKDRVKPSPKPDSWKLDEIFATGVVLGTYMALVTVVFFYLAHDTDFFTETFGVHPIRGNDRQLMAALYLQVSIISQALIFVTRSRSWSFVERPGFLLLFAFFAAQLVATAIAVYANWDFCDMEGIGWAWGGAIWVFTVVTYVPLDVLKFIIRYSISGKGWDNVQNKTAFTNKKDYGRGEREAMWAKEQRTLHGLSQPATSDLLSSKEELSDIAAEAAKRAEIARLRELHTLKGHVESVVKQKGIDIDAIPQNYTV

SEQ ID NO: 5320 - protein, 947 aa, Cicer arietinum
MASDISFEDLKNENIDLENIPVDEVFQQLKCTKEGLSSEEGEKRLQIFGPNKLEEKTESKFLKFLGFMWNPLSWVMESAAIMAIVLANGGGKPPDWQDFTGIVVLLIINSTISFIEENNAGNAAAALMAGLAPKTKVLRDGKWSEQEAEILVPGDVISIKLGDIVPADARLLEGDPLKIDQSALTGESLPVTRNPGSEVFSGSTCKQGEIEAVVIATGVHTFFGKAAHLVDSTNNVGHFQKVLTSIGNFCICSIAIGMLVEIIVMYPIQNRAYRDGIDNLLVLLIGGIPIAMPTVLSVTMAIGSHRLSQQGAITKRMTAIEEMAGMDVLCSDKTGTLTLNKLTVDKSLIEVFPSGMDKDSVVLYAARASRVENQDAIDASIVGMLSDPKEARAGITEVHFLPFNPVDKRTAITYIDSNGDWHRSSKGAPEQIIELCELKGETLKRAHKTIDGYAERGLRSLAVGFQTVSEKSKESAGEPWVFLGLLPLFDPPRHDSAETIRRALDLGVNVKMITGDQLAIGKETGRRLGMGTNMYPSSSLLGQCKDPAIASMPIDELIEKADGFAGVFPEHKYEIVKRLQDRKHICGMTGDGVNDAPALKKADIGIAVADATDAARSASDIVLTEPGLSVIVSAVLTSRAIFQRMKNYTIYAVSITIRIVLGFLLVALIWKFDFSPFMVLIIAILNDGTIMTISKDRVKPSPVPDSWKLKEIFATGVVLGTYMAIMTAVFFYIVHDTDFFSQTFGVLPISDSEEQLNSALYLQVSIISQALIFVTRSRSWSFLERPGMMLLGAFVAAQLVATAIAVYAHWDFARINGIGWKWAGVIWIFSVVTYIPLDILKFFIRMGLTGSAWDNMLQNKTAFTTKKDYGRGEREAQWAVAQRTLHGLQPHEAHKNTHHEHSEIAEQAKRRAEAARLRELHTLKGHVESVVKLKGLDIETIQQHYTV

SEQ ID NO: 5321 - protein, 957 aa, Musa acuminata
MATDFGGGGRSVSLEDIRNEAVDLEKIPVEEVFQQLKCSTEGLTTAEGEQRLQIFGPNKLEEKKESKLLKFLGFMWNPLSWVMEIAAIMAIALANGGGKPPDWQDFIGIVSLLIINSTISFIEENNAGNAAAALMAGLAPKTKVLRDGKWSEQDASILVPGDIISIKLGDIIPADARLLEGDPLKIDQAALTGESLPVTRHPGDEVFSGSTCKQGEIEAVVIATGVHTFFGKAAHLVDSTNNVGHFQKVLTAIGNFCICSIVVGMLIEIIVMYPIQHRRYRDGIDNLLVLLIGGIPIAMPTVLSVTMAIGSHRLSEQGAITKRMTAIEEMAGMDVLCSDKTGTLTLNKLTVDKTLIEVFVRDLDKDAIVLYAARASRVENQDAIDACIVGMLADPREARAGIQEIHFLPFNPVEKRTAITYIESDGKWHRSSKGAPEQIIELCNMRGDARTKVHGMITKFADRGLRALGVARQEVPEASKESAGGPWQFLGLLPLFDPPRHDSAETIRRALNLGVNVKMITGDQLAIAKETGRRLGMGTNMYPSSTLLGERSDDTTGLPIDELIEKADGFAGVFPEHKYEIVRRLQEKEHICGMTGDGVNDAPALKKADIGIAVADATDAARGASDIVLTEPGLSVIVSAVLTSRAIFQRMKNYTIYAVSITIRIVLGFMLVALIWRFDFSPFMVLIIAILNDGTIMTISKDRVKPSPVPDSWKLQEIFSTGVVLGAYLAIMTVVFFFLVHDTDFFPKAFGVRSINGNNDELTAALYLQVSIVSQALIFVTRSRSWSFIERPGLLLVSAFVAAQLVATLIAVYATWGFARMNGIGWGWAGVIWLYSLITYFPLDILKFIIRYGLSGRAWDNLLQNKTAFTSKKDYGKGEREAQWALAQRTLHGLHPPETTGLFDEKSYRELSEIAEQAKRRAEVARLRELHTLKGHVESVVKLKGLNIENMQQHYTL

SEQ ID NO: 5322 - protein, 948 aa, Arabidopsis thaliana
MATEFSWDEIKKENVDLERIPVEEVFEQLKCSKEGLSSDEGAKRLEIFGANKLEEKSENKFLKFLGFMWNPLSWVMESAAIMAIVLANGGGKAPDWQDFIGIMVLLIINSTISFIEENNAGNAAAALMANLAPKTKVLRDGKWGEQEASILVPGDLISIKLGDIVPADARLLEGDPLKIDQSALTGESLPTTKHPGDEVFSGSTCKQGEIEAVVIATGVHTFFGKAAHLVDSTNNVGHFQKVLTSIGNFCICSIGLGMLIEILIMYPIQHRTYRDGIDNLLVLLIGGIPIAMPTVLSVTMAIGSHRLSQQGAITKRMTAIEEMAGMDVLCSDKTGTLTLNKLSVDKSLIEVFPKNMDSDSVVLMAARASRIENQDAIDASIVGMLGDPKEARAGITEVHFLPFNPVDKRTAITYIDESGDWHRSSKGAPEQIIELCNLQGETKRKAHEVIDGFAERGLRSLGVAQQTVPEKTKESDGSPWEFVGLLPLFDPPRHDSAETIRRALELGVNVKMITGDQLAIGIETGRRLGMGTNMYPSTSLLGNSKDESLVGIPIDELIEKADGFAGVFPEHKYEIVKKLQERKHICGMTGDGVNDAPALKKADIGIAVADATDAARSASDIVLTEPGLSVIISAVLTSRAIFQRMKNYTIYAVSITIRIVLGFMLVALIWRFDFAPFMVLIIAILNDGTIMTISKDRVKPSPVPDSWKLNEIFATGVVLGTYMALTTVLFFWLAHDTDFFSKTFGVRSIQGNEEELMAALYLQVSIISQALIFVTRSRSWSFVERPGFLLLIAFVIAQLVATLIAVYANWGFARIVGCGWGWAGGIWVYSIITYIPLDILKFIIRYALTGKAWDNMINQKTAFTTKKDYGKGEREAQWALAQRTLHGLPPPEAMFNDNKNELSEIAEQAKRRAEVARLRELHTLKGHVESVVKLKGLDIDTIQQHYTV

SEQ ID NO: 5323 - protein, 948 aa, Brassica rapa
MASEISWDEIKNENVDLERIPVEEVFQQLKCTKEGLSSDEGKKRLEIFGANKLEEKSENKFLKFLGFMWNPLSWVMESAAIMAIVLANGGGKPPDWQDFIGIMVLLVINSTISFIEENNAGNAAAALMANLAPKTKVLRDGKWGEQDASILVPGDLISVKLGDIVPADARLLQGDPLKIDQSALTGESLPVTKHPGDEVFSGSTCKQGEIEAVVIATGVHTFFGKAAHLVDSTNNVGHFQKVLTAIGNFCICSIGIGMLIEIVVMYPIQHRTYRDGIDNLLVLLIGGIPIAMPTVLSVTMAIGSHRLSQQGAITKRMTAIEEMAGMDVLCSDKTGTLTLNKLSVDKSLIEVFPSNLDTDAVVLMAARASRIENQDAIDASIVGMLGDPKEAREGIKEVHFLPFNPVDKRTAITYIDENGEWYRSSKGAPEQIIELCNLQGEARRKAHEVIDGFAERGLRSLGVAQQTVPEKSKESDGSPWEFIGLLPLFDPPRHDSAETIRRALELGVNVKMITGDQLAIGIETGRRLGMGTNMYPSTSLLGNSKDESLVGIPVDELIEKADGFAGVFPEHKYEIVKKLQERKHICGMTGDGVNDAPALKKADIGIAVADATDAARSASDIVLTEPGLSVIVSAVLTSRAIFQRMKNYTIYAVSITIRIVLGFMLVALIWRFDFAPFMVLIIAILNDGTIMTISKDRVKPSPVPDSWKLNEIFATGVVLGTYMALTTVLFFWLAHDTNFFSKTFGVRSIQENEEELMAALYLQVSIISQALIFVTRSRSWSFVERPGFLLLIAFVIAQLVATLIAVYANWGFARILGCGWGWAGVIWLYSIITYIPLDILKFTIRYSLTGKAWDNMIQQKTAFTTKKDYGKGEREAQWALAQRTLHGLPPPEAMFHDKNHELSEIAEQAKRRAEVARLRELHTLKGHVESVVKLKGLDIDTIQQHYTV

SEQ ID NO: 5324 - protein, 948 aa, Brassica napus
MASEISWDEIKNENVDLERIPVEEVFKQLKCTKEGLSSDEGKKRLEIFGANKLEEKSENKFLKFLGFMWNPLSWVMESAAIMAIVLANGGGKPPDWQDFIGIMVLLVINSTISFIEENNAGNAAAALMANLAPKTKVLRDGKWGEQDASILVPGDLISVKLGDIVPADARLLQGDPLKIDQSALTGESLPVTKHPGDEVFSGSTCKQGEIEAVVIATGVHTFFGKAAHLVDSTNNVGHFQKVLTAIGNFCICSIGIGMLIEIVVMYPIQHRTYRDGIDNLLVLLIGGIPIAMPTVLSVTMAIGSHRLSQQGAITKRMTAIEEMAGMDVLCSDKTGTLTLNKLSVDKSLIEVFPSNLDTDAVVLMAARASRIENQDAIDASIVGMLGDPKEAREGIKEVHFLPFNPVDKRTAITYIDENGEWHRSSKGAPEQIIELCNLQGEARRKAHEVIDGFAERGLRSLGVAQQTVPEKSKESDGSPWEFIGLLPLFDPPRHDSAETIRRALELGVNVKMITGDQLAIGIETGRRLGMGTNMYPSTSLLGNSKDESLVGIPVDELIEKADGFAGVFPEHKYEIVKKLQERKHICGMTGDGVNDAPALKKADIGIAVADATDAARSASDIVLTEPGLSVIVSAVLTSRAIFQRMKNYTIYAVSITIRIVLGFMLVALIWRFDFAPFMVLIIAILNDGTIMTISKDRVKPSPVPDSWKLNEIFATGVVLGTYMALTTVLFFWLAHDTNFFSKTFGVRSIQENEEELMAALYLQVSIISQALIFVTRSRSWSFVERPGFLLLIAFVIAQLVATLIAVYANWGFARILGCGWGWAGVIWLYSIITYIPLDILKFTIRYSLTGKAWDNMIQQKTAFTTKKDYGKGEREAQWALAQRTLHGLPPPEAMFHDKNHELSEIAEQAKRRAEVARLRELHTLKGHVESVVKLKGLDIDTIQQHYTV

SEQ ID NO: 5325 - protein, 951 aa, Mimulus guttatus
MASDISLEAIKNETIDLEHMPIEEVFAELKCTREGLTSEEGAKRLDIFGPNKLEEKQESKFLKFLGFMWNPLSWVMESAAIMAIVLANGGGKPPDWQDFVGILVLLIINSTISFIEENNAGNAAAALMAGLAPKTKVLRDGKWSEQDASILVPGDLISVKLGDIIPADARLLEGDPLKIDQSALTGESLPVTKHPGAEVFSGSTCKQGEIEAVVIATGVHTFFGKAAHLVDSTNNVGHFQKVLTAIGNFCICSIALGMIIEIVVMYPIQRRKYREGIDNLLVLLIGGIPIAMPTVLSVTMAIGSHRLSQQGAITKRMTAIEEMAGMDVLCSDKTGTLTLNKLTVDKTLIEVFPDNADKDTVILLAARASRVENQDAIDASIVNMLSDPKEARAGITEVHFLPFNPVEKRTAITYYDAQGNWHRSSKGAPEQIIELCQLKGAVLKKAHDIIDNFANRGLRSLGIARQTVPEKTKEGSGGPWEFVGLLPLFDPPRHDSAETIRKALELGVNVKMITGDQLAIGKETGRRLGMGTNMYPSSSLLGQCKDESIASMPIDELIEKADGFAGVFPEHKYEIVKRLQERKHICGMTGDGVNDAPALKKADIGIAVADATDAARGASDIVLTEPGLSVIVSAVLTSRAIFQRMKNYTIYAVSITIRIVMGFMLIALLWKFDFSPFMVLIIAILNDGTIMTISKDRVKPSPLPDSWKLKEIFATGVVLGSYMALMTVVFFYLAADTDFFSEKFKVRSLRNSPDELTAALYLQVSIISQALIFVTRSRSWSFVERPGFLLMSAFLIAQLVATIIAVYANWGFARIQGIGWGWAGIIWIYSIVTYFPLDVLKFIIRYALTGKAWDSMIQNRVAFTTKKDYGRGEREAQWAVAQRTLHGLSAGETPALLHDKNYGELSEIAEQAKRRAEVARLRELHTLKGHVESVVKLKGLDIETIQQHYTV

SEQ ID NO: 5326 - protein, 946 aa, Cajanus cajan
MASDISFDDLKNENVDLEHIPVEEVFKQLKCTREGLTSAEGEKRLQVFGPNKLEEKKESKFLKFLGFMWNPLSWVMEAAAIMAIALANGGGKPPDWQDFVGIVVLLIINSTISFIEENNAGNAAAALMAGLAPKTKVLRDGRWSEEDAALLVPGDLISIKLGDIVPADARLLEGDPLKIDQSALTGESLPVTKNPGDEVFSGSTCKQGEIEAVVIATGVHTFFGKAAHLVDSTNNVGHFQKVLTAIGNFCICSIAVGMVIEIIVMYPIQQRAYRDGIDNLLVLLIGGIPIAMPTVLSVTMAIGSHRLSEQGAITKRMTAIEEMAGMDVLCSDKTGTLTLNKLTVDKTLIEVFPTGMDKETLLLYAARASRTENQDAIDASIVGMLSDPKEARAGIKEVHFLPFNPVDKRTAITYIDDQGDWHRSSKGAPEQIIELCGLKGEPLKKAHDVIDSYANRGLRSLGVSRQTVSEKSKESAGDSWEFLGLLPLFDPPRHDSAETIRRALDLGVNVKMITGDQLAIGKETGRRLGMGTNMYPSSSLLGDSKDPAIASIPVDDLIEKADGFAGVFPEHKYEIVKRLQDRKHICGMTGDGVNDAPALKKADIGIAVADATDAARSASDIVLTEPGLSVIVSAVLTSRAIFQRMKNYTIYAVSITIRIVFGFMLVALIWKFDFSPFMVLIIAILNDGTIMTISKDRVVPSPLPDSWKLREIFATGVVLGAYMAIITVVFFFLVHDTDFFPRTFGVKPIADSEEHLNSALYLQVSIISQALIFVTRSRSWSYVERPGLLLILAFFAAQLVATVIAVYAHWDFARINGVGWGWAGVIWVFSIITYIPLDILKFLIRFGLSGRAWDNMLEKKTAFTTKKDYGKGEREAQWAVAQRTLHGLQTGEPKSNQHEQSELAEQAKRRAEAARLRELHTLKGHVESVVKLKGIDIDTIQQHYTL

SEQ ID NO: 5327 - protein, 952 aa, Ricinus communis
MAAKSFSLEEIKNETVDLERIPVEEVFQQLNCTREGLSSDEGQKRLQIFGPNKLEEKKESKFLKFLGFMWNPLSWVMEIAAIMAIALANGGGKPPDWQDFVGIVVLLFINSTISFIEENNAGNAAAALMAGLAPKTKVLRDGRWTEQEAAILVPGDVISIKLGDIIPADARLLEGDPLKIDQSALTGESLPVTKHPGDEVFSGSTCKQGEIEAIVIATGVHTFFGKAAHLVDSTNQEGHFQKVLTAIGNFCICSIALGMIIEIVVMYPIQHREYRSGIDNLLVLLIGGIPIAMPTVLSVTMAIGSHRLSQQGAITKRMTAIEEMAGMDVLCSDKTGTLTLNKLTVDKSLIEIFAKDVDKDTVILYGAMASRVENQDAIDACIVGMLGDPKEARAGITEVHFLPFNPVGKRTAITYIDSDGNWHRISKGAPEQIIELCNLRDDAKKKAHAIIDKFADRGLRSLAVSKQAVPEKTKESPGGPWQFVGLLPLFDPPRHDSAETINRALNLGVNVKMITGDQLAIGKETGRRLGMGTNMYPSSALLGQNKDESIAGLPVDELIEKADGFAGVFPEHKYEIVKRLQERKHICGMTGDGVNDAPALKKADIGIAVADATDAARGASDIVLTEPGLSVIVSAVLTSRAIFQRMKNYTIYAVSITIRIVMGFMLLALIWKFDFSPFMVLIIAILNDGTIMTISKDRVKPSPLPDSWKLKEIFATGVVLGTYLAIMTVVFFWAANSSDFFSDHFGVRSIRENHNELTAAIYLQVSIVSQALIFVTRSRSWSYVERPGLLLVAAFIIAQLIATLLAVYANWAFAKIHGIGWGWAGVIWLYSIVFYIPLDVLKFAIRYALSGKAWDNLVQNKTAFTTKKDYGRGEREAQWAAAQRTLHGLQPPETAEIFQDKNYRELSEIAEQAKRRAEVARLRELHTLKGHVESVVKLKGLDIETIQQHYTV

SEQ ID NO: 5328 - protein, 948 aa, Brassica oleracea
MASEISWDEIKNENVDLERIPVEEVFKQLKCTKEGLSSDEGKKRLEIFGANKLEEKSENKFLKFLGFMWNPLSWVMESAAIMAIVLANGGGKPPDWQDFIGIMVLLVINSTISFIEENNAGNAAAALMANLAPKTKVLRDGKWGEQDASILVPGDLISVKLGDIVPADARLLQGDPLKIDQSALTGESLPVTKHPGDEVFSGSTCKQGEIEAVVIATGVHTFFGKAAHLVDSTNNVGHFQKVLTAIGNFCICSIGIGMLIEIVVMYPIQHRTYRDGIDNLLVLLIGGIPIAMPTVLSVTMAIGSHRLSQQGAITKRMTAIEEMAGMDVLCSDKTGTLTLNKLSVDKSLIEVFPSNLDTDAVVLMAARASRIENQDAIDASIVGMLGDPKEAREGIKEVHFLPFNPVDKRTAITYIDENGEWYRSSKGAPEQIIELCNLQGEARRKAHEVIDGFAERGLRSLGVAQQTVPEKSKESDGSPWEFIGLLPLFDPPRHDSAETIRRALELGVNVKMITGDQLAIGIETGRRLGMGTNMYPSTSLLGNSKDESLVGIPVDELIEKADGFAGVFPEHKYEIVKKLQERKHICGMTGDGVNDAPALKKADIGIAVADATDAARSASDIVLTEPGLSVIVSAVLTSRAIFQRMKNYTIYAVSITIRIVLGFMLVALIWRFDFAPFMVLIIAILNDGTIMTISKDRVKPSPVPDSWKLNEIFATGVVLGTYMALTTVLFFWLAHDTNFFSKTFGVRSIQENEEELMAALYLQVSIISQALIFVTRSRSWSFVERPGFLLLIAFVIAQLVATLIAVYANWGFARILGCGWGWAGVIWLYSIITYIPLDILKFTIRYSLTGKAWDNMIQQKTAFTTKKDYGKGEREAQWALAQRTLHGLPPPEAMFHDKNHELSEIAEQAKRRAEVARLRELHTLKGHVESVVKLKGLDIDTIQQHYTV

SEQ ID NO: 5329 - protein, 981 aa, Glycine max
MGGISLEEIKNENVDLEKIPVEEVFESLKCSRAGLTSDEGASRLQVFGPNKLEEKKESKLLKFLGFMWNPLSWVMEAAAIMAIALANGGGRPPDWQDFVGIIALLFINSTISFIEENNAGNAAAALMAGLAPKTKVLRDGRWTEQDAAILVPGDIISIKLGDIIPADARLLEGDALSVDQSALTGESLPVTKNPSEEVFSGSTVKKGEIEAVVIATGVHTFFGKAAHLVDSTNQVGHFQKVLTAIGNFCICSIAVGIIIELIVMYPIQHRKYRDGIDNLLVLLIGGIPIAMPTVLSVTMAIGSHRLSQQGAITKRMTAIEEMAGMDVLCSDKTGTLTLNKLSVDKNLIEVFAKGVEKDYVILLAARASRTENQDAIDAAIVGMLADPKEARAGIREVHFLPFNPVDKRTALTYIDSDGNWHRSSKGAPEQILNLCNCKEDVRKRVHGTIDKFAERGLRSLGVARQEVPEKNKDSPGAPWQFVGLLPLFDPPRHDSAETITRALNLGVNVKMITGDQLAIAKETGRRLGMGTNMYPSSSLLGQSKDAAVSAVPVDELIEKADGFAGVFPEHKYEIVKRLQERKHICGMTGDGVNDAPALKKADIGIAVADATDAARSASDIVLTEPGLSVIISAVLTSRAIFQRMKNYTIYAVSITIRIVFGFMFIALIWKFDFAPFMVLIIAILNDGTIMTISKDRVKPSPMPDSWKLREIFATGVVLGAYMALMTVVFFWLMKDTDFFSDKFGVRSIRNSPGEMMAALYLQVSIISQALIFVTRSRSWSYVERPGLLLLSAFMIAQLVATFLAVYANWGFARIQGMGWGWAGVIWLYSLVTYIPLDILKFAIRYVLSGKAWDNLLENKTAFTTKKDYGKEEREAQWATAQRTLHGLQPPETTNLFNDKNSYRELSEIAEQAKRRAEVARLRELHTLKGHVESVKLKTLIQSNSIIKFKEFGQPSSRTHFGACPRTRTTNIMKAQVNPPLD

SEQ ID NO: 5330 - protein, 951 aa, Eucalyptus grandis
MASGDISLEQIKNESIDLERIPVEEVFEQLKCTREGLSTTEGGRRLQIFGLNKLEEKKESKFLKFLGFMWNPLSWVMEAAAVMAIALANGGGKPPDWQDFVGIVTLLIINSTISFIEENNAGNAAAALMAGLAPKTKVLRDGKWNEQEAAILVPGDVVSIKLGDIVPADARLLEGDPLKIDQSALTGESLPVTKNPGDEVFSGSTCKQGEIEAIVIATGVHTFFGKAAHLVDSTNQVGHFQKVLTAIGNFCICSIALGMLVEIVVMYPIQHRSYRAGIDNLLVLLIGGIPIAMPTVLSVTMAIGSHRLSQQGAITKRMTAIEEMAGMDVLCSDKTGTLTLNKLSVDKSLIEVFPKDADKDTVMLLAARASRVENQDAIDASIVGTLADPKEARAGITEVHFLPFNPVDKRTAITYLDGNGNWHRCSKGAPEQIMDLCNLRGEAKKKAHSFIDNFAARGLRSLAVARQMVPEKTKESAGGPWEFVGLLSLFDPPRHDSAETIRRALNLGVNVKMITGDQLAIGKETGRRLGMGSNMYPSSSLLGESKDESIASIPVEELIEKADGFAGVFPEHKYEIVKKLQERKHICGMTGDGVNDAPALKKADIGIAVADATDAARSASDIVLTEPGLSVIVSAVLTSRAIFQRMKNYTIYAVSITIRIVLGFLLVALIWKFDFSPFMVLIIAILNDGTIMTISKDRVKPSPVPDSWKLKEIFATGIVLGTYLALMTVLFFWLAHDTDFFPNTFGVRPIKGSEDELTAALYLQVSIISQALIFVTRSRSWSFVERPGLLLVGAFLAAQLVATLIAVYATWGFARVQGIGWGWAGLIWIFSIITYFPLDVLKFLIRYALTGKAWDNMFQSKTAFTTKTDYGKGEREAQWALAERTLHGLQTPPSLFNDKSSYRELSEIAEQARRRAEVARLTELHTLKGHVDSVVKLKGLDIETIQQHYTV

SEQ ID NO: 5331 - protein, 949 aa, Mimulus guttatus
MASDLEDIRNETVDLETIPIEEVFTQLKCSKEGLTSDEGAKRLEIFGPNKLEEKKESKFLKFLGFMWNPLSWVMESAAIMAIVLANGGGKPPDWQDFVGIMTLLVINSTISFIEENNAGNAAAALMAGLAPKTKVLRDGKWSEQDASILVPGDLISVKLGDIIPADARLLEGDPLKIDQSALTGESLPVTKHPGDEVFSGSTCKQGELEAVVIATGVHTFFGKAAHLVDSTNNVGHFQKVLTSIGNFCICSIAVGMLIEVVVMYPIQHRKYREGIDNLLVLLIGGIPIAMPTVLSVTMAIGSHRLSQQGAITKRMTAIEEMAGMDVLCSDKTGTLTLNKLTVDKSLVEVFPQNADQDTVLLLAARASRVENQDAIDASIVNMLDDPKEARAGITEVHFLPFNPVDKRTAITYYDTDGNWHRCSKGAPEQIIELCELKGEVLKRAHEIIDNFANRGLRSLGVARQTVSEKTKESAGDSWEFVGLLPLFDPPRHDSAETIRKALDLGVNVKMITGDQLAIGKETGRRLGMGTNMYPSSSLLGQSKDESISSIPIDELIEKADGFAGVFPEHKYEIVRKLQELKHICGMTGDGVNDAPALKKADIGIAVADATDAARGASDIVLTEPGLSVIISAVLTSRAIFQRMKNYTIYAVSITIRIVMGFMLIALIWKFDFSPFMVLIIAILNDGTIMTISKDRVKPSPVPDSWKLNEIFATGIVLGTYMALMTVIFFYLASDTDFFSDTFNVKSMRGNPNELTAALYLQVSIISQALIFVTRSRSWSFVERPGFLLLGAFLIAQLLATVIAVYAKWEFARISGIGWGWAGVIWIFSIVTYFPLDVLKFIIRFALSGKAWDSMIQNKTAFTTKKDYGKGEREAQWAVAQRTLHGLSTTENAALYNDKNYRELSEIAEQAKRRAEVARLRELHTLKGHVESVVKLKGLDIDTIQQHYTV

SEQ ID NO: 5332 - protein, 946 aa, Phaseolus vulgaris
MASDISFEDLKNENVDLEHIPVEEVFKQLKCTKEGLTSAEGEKRLQIFGPNKLEEKTDSKFLKFLGFMWNPLSWVMEAAAVMAIALANGGGKPPDWQDFVGIVVLLIINSTISFIEENNAGNAAAALMAGLAPKTKVLRDGKWSEEEAAILVPGDLISIKLGDIVPADARLLEGDPLKIDQSALTGESLPVTKNPGSEVFSGSTCKQGEIEAVVIATGVHTFFGKAAHLVDSTNNVGHFQKVLTSIGNFCICSIAVGMLIEIIVMYPIQQRAYREGIDNLLVLLIGGIPIAMPTVLSVTMAIGSHRLSEQGAITKRMTAIEEMAGMDVLCSDKTGTLTLNKLTVDKTLIEVFPTGMDKDALVLYAARASRIENQDAIDASIVGMLADPKEARAGINEVHFLPFNPVDKRTAITYIDGQNNWHRSSKGAPEQIIELCGLKGEALKKAHKVIDEYANRGLRSLGVSRQTVSEKSKESVGDSWEFLGLLPLFDPPRHDSAETIRRALDLGVNVKMITGDQLAIGKETGRRLGMGTNMYPSSSLLGDSKDPAIASIPVDELIEKADGFAGVFPEHKYEIVKRLQDRKHICGMTGDGVNDAPALKKADIGIAVADATDAARSASDIVLTEPGLSVIVSAVLTSRAIFQRMKNYTIYAVSITIRIVFGFMLVALIWKFDFSPFMVLIIAILNDGTIMTISKDRVKPSPLPDSWKLKEIFATGVVLGAYMAIITVVFFFLVHDTDFFTRTFGVKPIVDSEEQLNSALYLQVSIISQALIFVTRSRSWSYVERPGILLITAFFAAQMVATVIAVYAHWDFARINGVGWGWAGAIWVFSIVTYIPLDILKFLIRLGLSGRAWDNMLENKTAFTTKKDYGKGEREAQWAVAQRTLHGLQVGETNKANHEQSEIAEQAKRRAEAARLKELHTLKGHVESVVKLKGIDIDTIQQHYTL

SEQ ID NO: 5333 - protein, 947 aa, Glycine max
MASDISFEDLKNENVDLEHIPVEEVFKQLKCTREGLTSAEGEKRLQIFGPNKLEEKKDSKLLKFLGFMWNPLSWVMEVAAIMAIVMANGGGKPPDWQDFVGIVVLLIINSTISFIEENNAGNAAAALMAGLAPKTKVLRDGKWSEEEAALLVPGDLISIKLGDIVPADARLLEGDPLKIDQSALTGESLPVTKNPGSEVFSGSTCKQGEIEAIVIATGVHTFFGKAAHLVDSTNNVGHFQKVLTSIGNFCICSIAVGMLIEIIVMFPIQQRAYRDGIDNLLVLLIGGIPIAMPTVLSVTMAIGSHRLSEQGAITKRMTAIEEMAGMDVLCSDKTGTLTLNKLTVDKSLIEVFPTGMDRDTLVLYAARASRIENQDAIDASIVGMLGDPKEARAGITEVHFLPFNPVDKRTAITYIDGQGNWHRSSKGAPEQIIELCELKGEVLKKAHKVIDEYANRGLRSLGVSRQTVSEKNKESAGESWEFLGLLPLFDPPRHDSAETIRRALDLGVNVKMITGDQLAIGKETGRRLGMGTNMYPSSSLLGDSKDPAIASIPVDELIEKADGFAGVFPEHKYEIVKRLQEMKHICGMTGDGVNDAPALKKADIGIAVADATDAARSASDIVLTEPGLSVIVSAVLTSRAIFQRMKNYTIYAVSITIRIVLGFMLVALIWRFDFSPFMVLIIAILNDGTIMTISKDRVKPSPLPDSWKLKEIFATGVVLGAYMAIITVVFFFLVHDTDFFTRVFGVEPIVDSEEQLNSALYLQVSIISQALIFVTRSRSWSYVELPGILLITAFFAAQLVATVIAVYAHWDFAKINGVGWGWAGAIWVFSIVTYIPLDILKFLIRMGLSGKAWDNMLDNKTAFTTKKDYGRGEREAEWAVAQRTLHGLQVGESNKAKQHEQSEIAEQAKRRAEAARLRELHTLKGHVESVVKLKGIDIDTIQQHYTL

SEQ ID NO: 5334 - protein, 948 aa, Eutrema parvulum
MASDISWDEIKKENVDLERIPVEEVFEQLKCSKEGLSSDEGKKRLEIFGPNKLEEKSENKYLKFLGFMWNPLSWVMESAAIMAIVLANGGGKPPDWQDFIGIMVLLVINSTISFIEENNAGNAAAALMANLAPKTKVLRDGKWGEQEASILVPGDLISVKLGDIVPADARLLEGDPLKIDQSALTGESLPVTKHPGDEVFSGSTCKQGEIEAVVIATGVHTFFGKAAHLVDSTNNVGHFQKVLTAIGNFCICSIGIGMLIEILIMYPIQHRKYRDGIDNLLVLLIGGIPIAMPTVLSVTMAIGSHRLSQQGAITKRMTAIEEMAGMDVLCSDKTGTLTLNKLSVDKSLIEVFPRNLDTDAVVLLAARASRIENQDAIDVSIVGMLSDPKEAREGIKEVHFLPFNPVDKRTAITYIDENGDWHRSSKGAPEQIIELCNLQGETRRKAHEVIDGFAERGLRSLGVAQQTVPEKNKESDGSPWEFVGLLPLFDPPRHDSAETIRRALELGVNVKMITGDQLAIGIETGRRLGMGTNMYPSTSLLGNSKDESLVGIPVDELIEKADGFAGVFPEHKYEIVKKLQERKHICGMTGDGVNDAPALKKADIGIAVADATDAARSASDIVLTEPGLSVIVSAVLTSRAIFQRMKNYTIYAVSITIRIVLGFMLVALIWRFDFAPFMVLIIAILNDGTIMTISKDRVKPSPVPDSWKLNEIFATGVVLGTYMALTTVLFFWLAHDTDFFSKTFGVRSIQGNEEELMAALYLQVSIISQALIFVTRSRSWSFVERPGFLLCIAFIIAQLAATLIAVYANWEFARILGCGWGWAGVIWLYSIITYIPLDILKFIIRYSLTGKAWDNMIQQKTAFTTKKDYGKGEREAQWALAQRTLHGLPPPEAMFHDKNHELSDIAEQAKRRAEVARLRELHTLKGHVESVVKLKGLDIDTIQQHYTV

SEQ ID NO: 5335 - protein, 955 aa, Populus trichocarpa
MSSKGGISLEEIKNESVDLERIPMEEVFEQLKCTREGLSADEGASRLQVFGPNKLEEKKESKILKFLGFMWNPLSWVMEAAALMAIALANGDGRPPDWQDFVGIVVLLVINSTISFIEENNAGNAAAALMAGLAPKTKVLRDGRWSEQDASILVPGDIISIKLGDIVPADARLLEGDPLKIDQSALTGESLPVTKNPSDEVFSGSTCKQGEIEAVVIATGVHTFFGKAAHLVDSTNQVGHFQKVLTAIGNFCICSIAVGIIAELIVMYPIQHRKYRDGIDNMLVLLIGGIPIAMPTVLSVTMAIGSHRLSQQGAITKRMTAIEEMAGMDVLCSDKTGTLTLNKLTVDRSLIEVFAKGVEKEHVMLLAARASRTENQDAIDAAIVGMLADPKEARAGIREVHFLPFNPVDKRTALTYIDSDGNWHRASKGAPEQILALCNCKEDVKKKVHSVIDKFAERGLRSLGVAKQEVPEKSKDAAGAPWQLVGLLPLFDPPRHDSAETIRRALHLGVNVKMITGDQLAIGKETGRRLGMGTNMYPSSALLGQDKDASIAALPVDELIEKADGFAGVFPEHKYEIVKRLQERKHICGMTGDGVNDAPALKKADIGIAVADATDAARSASDIVLTEPGLSVIISAVLTSRAIFQRMKNYTIYAVSITIRIVFGFMFIALIWKFDFAPFMVLIIAILNDGTIMTISKDRVKPSPQPDSWKLKEIFSTGIVLGGYMALMTVLFFWIMKDTDFFSDKFGVRSLRNNNEEMMAALYLQVSIVSQALIFVTRSRSWSFVERPGFLLLGAFVAAQLVATLIAVYANWGFARIEGCGWGWAGVIWLFSVVTYVPLDILKFAIRYILSGKAWDNLLENKTAFTTKKDYGKEEREAQWATAQRTLHGLQPPETSHNMFSEKNSYRELSEIAEQAKRRAEMARLRELNTLKGHVESVVKLKGLDIDTIQQHYTV

SEQ ID NO: 5336 - protein, 949 aa, Gossypium raimondii
MADKSISLEEIKNETVDLERIPVEEVFQQLKCTRNGLTSEEGQKRLQIFGPNKLEEKKENKLLKFLGFMWNPLSWVMEFAAIMAIALANGGGKPPDWQDFIGIVSLLFINSTISFIEENNAGNAAAALMAGLAPKTKVLRDGKWNEQEAAILVPGDIISIKLGDIVPADARLLEGDALKIDQSALTGESLPVNKHSGDEVFSGSTVKQGEIEAVVIATGVHTFFGKAAHLVDSTNNIGHFQQVLTAIGNFCICSIGVGMLIEIVVMYPIQRRKYRDGIDNLLVLLIGGIPIAMPTVLSVTMAIGSHRLSQQGAITKRMTAIEEMAGMDVLCSDKTGTLTLNKLTVDKSMIEVFMDNIDKEMVLLLAARASRVENQDAIDACIVGMLGDPKEARAGVTEVHFFPFNPVDKRTAMTYIEADGSWHRASKGAPEQIIELCNLRNDAKRRAHDIITKFADRGLRSLAVAKQKVPEKTKDGQGDPWQFVGLLPLFDPPRHDSAETIRRALSLGVNVKMITGDQLAIGKETGRRLGMGTNMYPSSVLLGENKGDALDTIGVDELIEKADGFAGVFPEHKYEIVKRLQQRKHICGMTGDGVNDAPALKKADIGIAVDDATDAARSASDIVLTEPGLSVIVSAVLTSRAIFQRMKNYTIYAVSITIRIVLGFMLLALIWKFDFSPFMVLIIAILNDGTIMTISKDRVKPSPMPDSWKLKEIFGTGIVLGTYLACMTVVFFWAANDSNFFSDKFGVRSIRHNQDELTAAVYLQVSIVSQALIFVTRSRSWSFIERPGFLLVIAFILAQLVATVIAVYANWGFARIKGIGWGWAGVIWIYSVVFYFPLDVFKFLIRYAMSGKAWNNLLQNKTAFTTKKDYGKGEREAQWALAQRTLHGLTPPEITEKSNYIELSEIAEQARKRAEVARLRELHTLKGHVESVVKLKGLDIDTIQQHYTV

SEQ ID NO: 5337 - protein, 949 aa, Cyclamen graecum
MASQSELSLEQIKNELVDLENIPIEEVFEQLKCSREGLTTAEGEHRLELFGPNKLEEKKESKFLKFLGFMWNPLSWVMECAAIMAIALANGGGKAPDWQDFVGIIVLLIINSTISFIEENNAGNAAAALMAGLAPKTKVLRDGKWSEQEAAILVPGDLISVKLGDIIPADARLLEGDPLKIDQSALTGESLPVTKYPGNEVFSGSTCKQGEIEAVVIATGVHTFFGKAAHLVDSTNQVGHFQKVLTAIGNFCICSIGIGMVIEIIVMYPIQHRQYRQGIDNLLVLLIGGIPIAMPTVLSVTMAIGSHRLSQQGAITKRMTAIEEMAGMDVLCSDKTGTLTLNKLTVDKTLIEVFPKDLDKDSVVLLAARASRIENQDAIDASIVGMLGDPKEARAGLTEVHFLPFNPVDKRTAITYIDDEGNWHRCSKGAPEQIIELCDLKGDVKKKSLDIIDNYANRGLRSLGVARQTVSEKSKESAGEAWEFVGLLPLFDPPRHDSAETIRRALDLGVNVKMITGDQLAIGKETGRRLGMGTNMYPSSSLLGQCKDESIAAIPVDELIEKADGFAGVFPEHKYEIVKKLQERKHICGMTGDGVNDAPALKRADIGIAVADATDAARGASDIVLTEPGLSVIVSAVLTSRAIFQRMKNYTIYAVSITIRIVMGFMLIALIWKFDFSPFMVLIIAILNDGTIMTISKDRVKPSPLPDSWKLKEIFATGIVLGTYLALMTVLFFWLANDTDFFSDTFGVRSLRGNVDELTAALYLQVSIVSQALIFVTRSRGFSFVERPGILLITAFFLAQLLATLIAVYAHWDFARIHGCGWGWAGVIWLFSLVTYFPLDVLKFIIRYSLSGNAWNTMIQNKTAFTTKKDYGKGEREAQWAVAQRTLHGLQSAQGYNDEHHTESDLAEQAKKRAEVARLRELHTLKGHVESVVKLKGLDIDTIQQHYTV

SEQ ID NO: 5338 - protein, 947 aa, Glycine max
MASDISFEDLKNENVDLEHIPIEEVFKQLKCTREGLTSAEGEKRLQVFGPNKLEEKTDSKLLKFLGFMWNPLSWVMEVAAIMAIVLANGGGKPPDWQDFVGIVVLLIINSTISFIEENNAGNAAAALMAGLAPKTKVLRDGKWSEEEAALLVPGDLISIKLGDIVPADARLLEGDPLKIDQSALTGESLPVTKNPGSEVFSGSTCKQGEIEAVVIATGVHTFFGKAAHLVDSTNNVGHFQKVLTSIGNFCICSIAIGMLIEIIVMYPIQQRAYRDGIDNLLVLLIGGIPIAMPTVLSVTMAIGSHRLSEQGAITKRMTAIEEMAGMDVLCSDKTGTLTLNKLTVDKSLIEVFPTGMDKDTLVLYAARASRTENQDAIDASIVGMLSDPKEARAGITEVHFLPFNPVDKRTAITYIDGQGNWHRSSKGAPEQIIELCELKGEVLKKAHKVIDEYANRGLRSLGVSRQTVSEKNKESAGESWEFLGLLPLFDPPRHDSAETIRRALDLGVNVKMITGDQLAIGKETGRRLGMGTNMYPSSSLLGNSKDPAIASIPVDELIEKADGFAGVFPEHKYEIVKRLQEMKHICGMTGDGVNDAPALKKADIGIAVADATDAARSASDIVLTEPGLSVIVSAVLTSRAIFQRMKNYTIYAVSITIRIVFGFMLVALIWKFDFSPFMVLIIAILNDGTIMTISKDRVKPSPLPDSWKLKEIFATGVVLGAYMAIITVVFFFLVHDTDFFTRVFGVEPIVDNEEQLNSALYLQVSIISQALIFVTRSRSWSYVERPGILLITAFFAAQLVATVIAVYAHWDFARVNGVGWGWAGAIWVFSIVTYIPLDILKFLIRLGLSGRAWDNMLENKTAFTTKKDYGRGEREAEWAVAQRTLHGLQVGESNKANQHDQSEIAEQAKRRAEAARLRELHTLKGHVESVVKLKGIDIDTIQQHYTL

SEQ ID NO: 5339 - protein, 948 aa, Eutrema halophilum
MTSDISWEEIKKENVDLERIPVEEVFEQLKCSKDGLSSDEGKKRLEIFGPNKLEEKSENKFLKFLGFMWNPLSWVMESAAIMAIVLANGGGKPPDWQDFIGIMVLLVINSTISFIEENNAGNAAAALMANLAPKTKVLRDGKWGEQEASILVPGDLISIKLGDIVPADARLLEGDPLKIDQSALTGESLPVTKHPGDEVFSGSTCKQGEIEAVVIATGVHTFFGKAAHLVDSTNNVGHFQKVLTAIGNFCICSIGLGMLIEILIMYPIQHRTYRDGIDNLLVLLIGGIPIAMPTVLSVTMAIGSHRLSQQGAITKRMTAIEEMAGMDVLCSDKTGTLTLNKLSVDKSLIEVFPRNLDTDAVVLMAARASRIENQDAIDASIVGMLGDPKEAREGITEVHFLPFNPVDKRTAITYIDENGDWHRSSKGAPEQIIELCNLQGDTKRKAHEVIDGFAERGLRSLGVAQQTVPDKTKESDGSPWEFVGLLPLFDPPRHDSAETIRRALELGVNVKMITGDQLAIGIETGRRLGMGTNMYPSTSLLGNTKDDSLVGIPVDELIEKADGFAGVFPEHKYEIVKKLQERKHICGMTGDGVNDAPALKKADIGIAVADATDAARSASDIVLTEPGLSVIVSAVLTSRAIFQRMKNYTIYAVSITIRIVLGFTLVALIWRFDFAPFMVLIIAILNDGTIMTISKDRVKPSPVPDSWKLNEIFATGVVLGTYMALTTVLFFWLAHDTNFFSKTFGVRSIQGNEEELMAALYLQVSIISQALIFVTRSRSWSFVERPGILLVIAFIIAQLAATLIAVYANWEFARILGCGWGWAGVIWLYSIITYMPLDILKFIIRYSLTGKAWDNMIQQKTAFTTKKDYGKGEREAQWALAQRTLHGLPPPEAMFHDKNHELSEIAEQAKRRAEVARLRELHTLKGHVESVVKLKGLDIDTIQQHYTV

SEQ ID NO: 5340 - protein, 952 aa, Solanum lycopersicum
MAKAISLEEIKNETVDLEKIPIEEVFEQLKCSREGLTSDEGANRLQIFGPNKLEEKKESKILKFLGFMWNPLSWVMEMAAIMAIALANGDGKPPDWQDFVGIVCLLVINSTISFIEENNAGNAAAALMAGLAPKTKVLRDGRWSEQEAAILVPGDIISVKLGDIVPADARLLEGDPLKIDQSALTGESLPVTKNPGDEVFSGSTCKQGELEAVVIATGVHTFFGKAAHLVDSTNNVGHFQKVLTAIGNFCICSIAIGMLVEIIVMYPIQHRKYRDGIDNLLVLLIGGIPIAMPTVLSVTMAIGSHRLSQQGAITKRMTAIEEMAGMDVLCSDKTGTLTLNKLSVDRSLVEVFTKGVDKEYVLLLAARASRVENQDAIDACMVGMLADPKEARAGIREVHFLPFNPVDKRTALTYIDSNGNWHRASKGAPEQILDLCNCKEDVRRKVHSMIDKYAERGLRSLAVARQEVPEKSKESAGGPWQFVGLLPLFDPPRHDSAETIRRALNLGVNVKMITGDQLAIAKETGRRLGMGTNMYPSASLLGQDKDSSIASLPVEELIEKADGFAGVFPEHKYEIVKKLQERKHIVGMTGDGVNDAPALKKADIGIAVADATDAARGASDIVLTEPGLSVIISAVLTSRAIFQRMKNYTIYAVSITIRIVFGFMLIALIWKYDFSAFMVLIIAILNDGTIMTISKDRVKPSPMPDSWKLNEIFATGVVLGGYQALMTVVFFWAMHDTSFFTDKFGVKDIRESDEEMMSALYLQVSIISQALIFVTRSRSWSFVERPGALLMIAFLIAQLVATLIAVYADWTFARVKGCGWGWAGVIWIFSIVTYFPLDIMKFAIRYILSGKAWNNLLDNKTAFTTKKDYGKEEREAQWALAQRTLHGLQPPEASNLFNEKNSYRELSEIAEQAKRRAEMARLRELHTLKGHVESVVKLKGLDIETIQQHYTV

SEQ ID NO: 5341 - protein, 951 aa, Phaseolus vulgaris
MGGISLEEIKNENVDLERIPIEEVFEQLKCSRAGLTSDEGANRLQVFGPNKLEEKKESKFLKFLGFMWNPLSWVMEAAAIMAIALANGGGRPPDWQDFVGIIALLVINSTISFIEENNAGNAAAALMAGLAPKTKVLRDGRWSEQDAAILVPGDIISIKLGDIIPADARLLEGDPLSVDQSALTGESLPVTKSSSDEVFSGSTVKKGEIEAVVIATGVHTFFGKAAHLVDSTNQVGHFQKVLTAIGNFCICSIAIGIAIELIVMYPIQHRKYRDGIDNLLVLLIGGIPIAMPTVLSVTMAIGSHRLSQQGAITKRMTAIEEMAGMDVLCSDKTGTLTLNKLSVDRNLIEVFAKGVEKEYVILLAARASRTENQDAIDAAIVGMLADPKEARSGIREVHFLPFNPVDKRTALTYIDSDGNWHRSSKGAPEQIITLCNCKEDVRKKVHAVIDKFAERGLRSLGVARQEVPEKSKDGAGGPWQFVGLLPLFDPPRHDSAETIRRALNLGVNVKMITGDQLAIGKETGRRLGMGTNMYPSSALLGQDKDASISALPVDELIEKADGFAGVFPEHKYEIVKRLQERKHICGMTGDGVNDAPALKKADIGIAVADATDAARSASDIVLTEPGLSVIISAVLTSRAIFQRMKNYTIYAVSITIRIVFGFLFIALIWKFDFAPFMVLIIAILNDGTIMTISKDRVKPSPLPDSWKLREIFATGVVLGSYMALMTVIFFWAMKDTNFFSNKFGVRSLRLSPEEMMAALYLQVSIISQALIFVTRSRSWSFAERPGLLLLGAFLIAQLVATFIAVYANWGFARIKGMGWGWAGVIWLYSVVTYIPLDILKFAIRYILSGKAWDNLLENKTAFTTKKDYGKEEREAQWAAAQRTLHGLQPPETSNLFNDKNSYRELSEIAEQAKRRAEVARLRELHTLKGHVESVVKLKGLDIDTIQQHYTV

SEQ ID NO: 5342 - protein, 949 aa, Arabidopsis thaliana
MAADISWDEIKKENVDLEKIPVDEVFQQLKCSREGLSSEEGRNRLQIFGANKLEEKVENKFLKFLGFMWNPLSWVMEAAAIMAIVLANGGGRPPDWQDFVGITCLLIINSTISFIEENNAGNAAAALMANLAPKTKVLRDGRWGEQEAAILVPGDLISIKLGDIVPADARLLEGDPLKIDQSALTGESLPATKHQGDEVFSGSTCKQGEIEAVVIATGVHTFFGKAAHLVDSTNNVGHFQKVLTAIGNFCICSIGIGMLIEIIIMYPIQHRKYRDGIDNLLVLLIGGIPIAMPTVLSVTMAIGSHRLSQQGAITKRMTAIEEMAGMDVLCSDKTGTLTLNKLTVDKNLIEVFSKDVDKDYVILLSARASRVENQDAIDTSIVNMLGDPKEARAGITEVHFLPFNPVEKRTAITYIDTNGEWHRCSKGAPEQIIELCDLKGETKRRAHEIIDKFAERGLRSLGVARQRVPEKDKESAGTPWEFVGLLPLFDPPRHDSAETIRRALDLGVNVKMITGDQLAIGKETGRRLGMGTNMYPSSSLLENKDDTTGGVPVDELIEKADGFAGVFPEHKYEIVRKLQERKHIVGMTGDGVNDAPALKKADIGIAVDDATDAARSASDIVLTEPGLSVIVSAVLTSRAIFQRMKNYTIYAVSITIRIVLGFMLVALIWEFDFSPFMVLIIAILNDGTIMTISKDRVKPSPIPDSWKLKEIFATGVVLGTYMALVTVVFFWLAHDTTFFSDKFGVRSLQGKDEELIAVLYLQVSIISQALIFVTRSRSWSFVERPGLLLLIAFFVAQLIATLIATYAHWEFARIKGCGWGWCGVIWIYSIVTYIPLDILKFITRYTLSGKAWNNMIENRTAFTTKKDYGRGEREAQWALAQRTLHGLKPPESMFEDTATYTELSEIAEQAKKRAEVARLREVHTLKGHVESVVKLKGLDIDNLNQHYTV

SEQ ID NO: 5343 - protein, 952 aa, Aquilegia formosa
MATKEINLEEIKNENVDLERIPIEEVFEQLKCTKEGLTSAEGEQRLEIFGPNKLEEKKESKLLKFLGFMWNPLSWVMEAAAIMAIALANGGGKPPDWQDFIGISVLLVINSTISFIEENNAGNAAAALMAGLAPKTKVIRDGKWSEQEAAILVPGDVISIKLGDIVPADARLLEGDPLKIDQSALTGESLPVTKHPGDEVFSGSTCKQGEIEAVVIATGVHTFFGKAAHLVDSTNQVGHFQKVLTAIGNFCICSIGVGMLIEVVVMYGIQHRRYREGIDNLLVLLIGGIPIAMPTVLSVTMAIGSHRLSEQGAITKRMTAIEEMAGMDVLCSDKTGTLTLNKLTVDKNMIEVFVKDMDKDTVVLTAARASRVENQDAIDASIVNMLADPKEARAGITEVHFLPFNPVDKRTAITYYDTEGNWHRASKGAPEQIIELCNLTGDAMNRVHAIIDKYADRGLRSLGVARQTVPEKTKESAGAPWEFVALLPLFDPPRHDSAETIRRALNLGVNVKMITGDQLAIGKETGRRLGMGTNMYPSSSLLGQSKDESIASIPVDELIEKADGFAGVFPEHKYEIVKKLQERKHICGMTGDGVNDAPALKRADIGIAVADATDAARGASDIVLTEPGLSVIISAVLTSRAIFQRMKNYTIYAVSITIRIVLGFMLIALIWKFDFSPFMVLIVAILNDGTIMTISKDRVKPSPMPDSWKLNEIFATGVVLGTYLAIMTVVFFWIIHDTDFFSTHFGVHSIRNNYDELTAALYLQVSIVSQALIFVTRSRSWSFVERPGILLVAAFLAAQLVATVIAVYASWGFARIQGIGWGWAGVIWLYSIVFYFPLDLLKFGIRYSLSGKAWDTLLQNKTAFTTKKDFGREEREAQWAMAQRTLHGLQHPEASSTLFSGDNKNESEIADQAKRRAEVARLREVLTLKAHVESVVKKKGLDIDTIQQHYTV

SEQ ID NO: 5344 - protein, 952 aa, Capsicum annuum
MAKSISLEEIKNETVDLEKIPIEEVFEQLKCTREGLSSDEGANRLQIFGPNKLEEKKESKILKFLGFMWNPLSWVMEAAAIMAIALANGDGKPPDWQDFVGIVCLLVINSTISFIEENNAGNAAAALMAGLAPKTKVLRDGRWSEQEAAILVPGDIISVKLGDIVPADARLLEGDPLKIDQSALTGESLPVTKNPGDEVFSGSTCKQGELEAVVIATGVHTFFGKAAHLVDSTNNVGHFQKVLTAIGNFCICSIAVGMVVEIIVMYPIQHRKYRDGIDNLLVLLIGGIPIAMPTVLSVTMAIGSHRLSQQGAITKRMTAIEEMAGMDVLCSDKTGTLTLNKLSVDRTLVEVFAKGVDKEYVLLLAARASRVENQDAIDACMVSMLADPKEARAGIREVHFLPFNPVDKRTALTYIENNGNWHRASKGAPEQILDLCNCKEDVKRKVHAIIDKYAERGLRSLAVARQEVPEKSKESPGGPWQFVGLLPLFDPPRHDSAETIRRALNLGVNVKMITGDQLAIAKETGRRLGMGTNMYPSASLLGQDKDSSIASLPVEELIEKADGFAGVFPEHKYEIVKKLQERKHIVGMTGDGVNDAPALKKADIGIAVADATDAARGASDIVLTEPGLSVIISAVLTSRAIFQRMKNYTIYAVSITIRIVFGFMLIALIWKYDFSAFMVLIIAILNDGTIMTISKDRVKPSPMPDSWKLNEIFSTGVVLGGYQALMTVVFFWAMHDTDFFSDKFGVKNIRESDDEMMSALYLQVSIISQALIFVTRSRSWSFVERPGALLMIAFLIAQLVATLIAVYADWGFARVKGCGWGWAGVIWLYSIVTYFPLDLMKFAIRYILSGKAWNNLLDNKTAFTTKKDYGKEEREAQWALAQRTLHGLQPPEASNLFNEKNSYRELTEIAEQAKRRAEMARLRELHTLKGHVESVVKLKGLDIETIQQHYTV

SEQ ID NO: 5345 - protein, 948 aa, Cucumis sativus
MGDISLEDVKNENIDLERIPVEEVFEQLKCTKEGLSTAEGEKRLQIFGPNKLEEKKESKLLKFLGFMWNPLSWVMECAAIMAIVLANGGGKPPDWQDFVGIIVLLIINSTISFIEENNAGNAAAALMAGLAPKTKVLRDGKWKEEEAAILVPGDVISVKLGDIIPADARLLEGDPLKIDQSALTGESLPVTKHPGDEVFSGSTCKQGEIEAVVIATGVHTFFGKAAHLVDSTNQVGHFQKVLTAIGNFCICSIAVGMVIEILVMYPIQHRAYREGIDNLLVLLIGGIPIAMPTVLSVTMAIGSHRLSQQGAITKRMTAIEEMAGMDVLCSDKTGTLTLNKLTVDKSLIEVFVPNMDKDTVMLFAARASRVENQDAIDACIVGMLGDPKEARAGITEVHFLPFNPVEKRTAITYIDGDGNWHRSSKGAPEQIIDLCELKGEIRRKAHEIIDNYANRGLRSLAVGRQTVKDKDKESAGEPWEFVGLLPLFDPPRHDSAETIRRALELGVNVKMITGDQLAIGKETGRRLGMGTNMYPSSSLLGQSKDESIASIPVDELIEKADGFAGVFPEHKYEIVKKLQERNHICGMTGDGVNDAPALKKADIGIAVADATDAARSASDIVLTEPGLSVIVSAVLTSRAIFQRMKNYTIYAVSITIRIVLGFMLVALIWKFDFSPFMVLIIAILNDGTIMTISKDRVKPSPVPDSWKLKEIFATGVVLGTYMALMTVVFFWLANETNFFTNTFGVKPLKDLAEINSALYLQVSIISQALIFVTRSRSWSFVECPGFLLVIAFIAAQLVATLIAVYSEWNFARIKGIGWGWAGAIWVFSIVTYFPLDVLKFAIRYGLSGKAWDNMLENKTAFTTKKDYGKGEREAQWAIAQRTMHGLQPPETIFHEKSNYEDLSEIAEQAKKRAEVARLRELHTLKGHVESVVKLKGLDIETIQQHYTV

SEQ ID NO: 5346 - protein, 913 aa, Flaveria ramosissima
MGGDTALSLEGIKNETVDLEKVPIEEVFEQLKCNREGLSSDEGAQRLEIFGPNKLEEKKESKILKFLGFMWNPLSWVMEAAAIMAIALANGGGKPPDWQDFVGIVCLLVINSTISFIEENNAGNAAAALMAGLAPKTKVLRDGRWSEQEAAILVPGDIISIKLGDIVPADARLLEGDPLKIDQSALTGESLPVTKNPYDEVFSGSTCKQGEIEAVVIATGVHTFFGKAAHLVDSTNQVGHFQKVLTAIGNFCICSIAVGMVVEIIVMYPIQHRAYRSGIDNLLVLLIGGIPIAMPTVLSVTMAIGSHRLSQQGAITKRMTAIEEMAGMDVLCSDKTGTLTLNKLTVDKNLIEVFGKGLDKEQVLLYAARASRMENQDAIDAAIVGTLADPKEARAGIREVHFFPFNPVDKRTALTYIDNNGNWFRASKGAPEQILTLCGCKEDLKKKVHAMIDKFAERGLRSLGVARQEVPQKSKDSPGGPWEFVGLLSLFDPPRHDSAETIRRALHLGVNVKMITGDQLAIAKETGRRLGMGTNMYPSSSLLGGHKDESIAALPIDELIEKADGFAGVFPEHKYEIVKKLQERKHICGMTGDGVNDAPALKKADIGIAVADATDAARSASDIVLTEPGLSVIISAVLTSRAIFQRMKNYTIYAVSITIRIVFGFMFIALIWKFDFSPFMVLIIAILNDGTIMTISKDRVKPSPLPDSWKLKEIFATGIVLGGYLALMTVIFFWIMKDTDFFTEKFSVKSLRTSDTEMMAALYLQVSIVSQALIFVTRSRSWSFVERPGFLLMGAFLAAQLVATLIAVYAEWEFARIKGIGWKWAGVIWLYSIVFYFPLDIMKFAIRYILSGKAWLSMIDNRTAFTTKKDYGRGEREAQWAHAQRTLHGLQAPDTSNLFNEKSSYRELSEIAE

SEQ ID NO: 5347 - protein, 944 aa, Populus trichocarpa
MEDIKNESIDLEKIPIEEVFEKLKCTKEGLRTTEGEERLRIFGPNKLEEKKESKILKFLGFMWNPLSWVMEAAAIMAIVLANGGGKPPDWQDFVGIIVLLIINSTISFIEENNAGNAAASLMAGLAPKTKVLRDGKWSEQDAAILVPGDIISIKLGDIIPADARLMVGDPLKIDQSALTGESLPVTKYPGSGVYSGSTCKQGEIEAVVIATGVHTFFGKAAHLVDSTNNVGHFQKVLTAIGNFCICSIAIGMLIEIIVMYPIQHRRYRDGIDNLLVLLIGGIPIAMPTVLSVTMAIGSHRLSQQGAITKRMTAIEEMAGMDVLCSDKTGTLTLNKLTVDKTLIEVFVKDMDKDTLILHAARASRTENQDAIDASIVGMLGDPSEARSGIIEVHFLPFNPVEKRTAITYFDGNGDWYRSSKGAPEQIIELCELKGNIRKKAHEIINNFADRGLRSLGVARHRIPEKNKESAGAPWEFVGLLPLFDPPRHDSAETIRRALDLGVNVKMITGDQLAIGKETGRRLGMGTNMYPSSSLLGDNKDESIASVPVDELIEKADGFAGVFPEHKYEIVKKLQERKHICGMTGDGVNDAPALKKADIGIAVADATDAARSASDIVLTEPGLSVIISAVLTSRAIFQRMKNYTIYAVSITIRIVLGFLLVALIWKFDFSPFMVLIIAILNDGTIMTISKDRVKPSPVPDSWKLKEIFAMGVVLGTYLAIITVLFFWLAHGTDFFSDKFGVRSIRGKPDELTAALYLQVSIISQALIFVTRSRSWSFTERPGLLLVGAFLAAQLVATVIAVYANWGFARIQGIGWGWAGIIWIFSIITYIPLDILKFITRYALTGKAWDNLLENKTAFTTKKDYGKGEREAQWATAQRTLHGLQSPETMKNDKASYRELSELAEQAKRRAEVARLREIHTLKGHVESVVKMKGLDIETIQQHYTV

SEQ ID NO: 5348 - protein, 951 aa, Glycine max
MGGISLEEIKNENVDLERIPIEEVFEQLKCSRAGLTSEEGANRLQVFGPNKLEEKKESKFLKFLGFMWNPLSWVMEAAAIMAIALANGGGRPPDWQDFVGIIALLVINSTISFIEENNAGNAAAALMAGLAPKTKVLRDNRWSEQDAAILVPGDIISIKLGDIIPADARLLEGDPLSVDQSALTGESLPVTKSPSDEVFSGSTVKKGEIEAVVIATGVHTFFGKAAHLVDSTNQVGHFQKVLTAIGNFCICSIAVGIAIELIVMYPIQHRRYREGIDNLLVLLIGGIPIAMPTVLSVTMAIGSHRLSQQGAITKRMTAIEEMAGMDVLCSDKTGTLTLNKLSVDRNLIEVFAKGVEKEYVILLAARASRTENQDAIDAAIVGMLADPKEARSGVREVHFLPFNPVDKRTALTYIDSDGNWHRASKGAPEQIITLCNCKEDVRRKVHAVIDKFAERGLRSLGVARQEVPEKSKDSPGGPWQFVGLLPLFDPPRHDSAETIRRALNLGVNVKMITGDQLAIGKETGRRLGMGTNMYPSSALLGQDKDASISALPVDELIEKADGFAGVFPEHKYEIVKRLQERKHICGMTGDGVNDAPALKKADIGIAVADATDAARSASDIVLTEPGLSVIISAVLTSRAIFQRMKNYTIYAVSITIRIVFGFLFIALIWKFDFAPFMVLIIAILNDGTIMTISKDRVKPSPLPDSWKLREIFATGVVLGSYMALMTVVFFWAMKDTNFFSNKFGVRPLRDSPDEMMAALYLQVSIISQALIFVTRSRSWSFVERPGLLLLGAFFIAQLVATFIAVYANWGFARIKGMGWGWAGVIWLYSVVTYIPLDLLKFAIRYILSGKAWDNLLENKTAFTTKKDYGKEEREAQWAAAQRTLHGLQPPETSNLFNDKNSYRELSEIAEQAKRRAEVARLRELHTLKGHVESVVKLKGLDIDTIQQHYTV

SEQ ID NO: 5349 - protein, 954 aa, Theobroma cacao
MGGDKGISLDEIKNESVDLERIPIEEVFEQLKCTRAGLTTEEGANRLQVFGPNKLEEKKESKFLKFLGFMWNPLSWVMEAAAIMAIALANGDGRPPDWQDFVGIIVLLFINSTISFIEENNAGNAAAALMANLAPKTKVLRDGRWSEQEAAILVPGDIITIKLGDIVPADARLLEGDPLKIDQSALTGESLPVTKNPSDEVFSGSTCKQGEIEAVVIATGVHTFFGKAAHLVDSTNQVGHFQKVLTAIGNFCICSIAVGIVVEIIVMYPIQHRKYRQGIDNLLVLLIGGIPIAMPTVLSVTMAIGSHRLSQQGAITKRMTAIEEMAGMDVLCSDKTGTLTLNKLTVDRNLIEVFAKGVEKEQVILYAARASRTENQDAIDTAIVGMLADPKEARAGIREIHFLPFNPVDKRTALTYIDSDGNWHRASKGAPEQIITLCNCKEDVKKKVHAVIDKFAERGLRSLGVARQEVPEKTKEAPGAPWQFIGLLPLFDPPRHDSAETIRRALNLGVNVKMITGDQLAIAKETGRRLGMGTNMYPSSSLLGQDKDASIAALPIDELIEKADGFAGVFPEHKYEIVKRLQERKHICGMTGDGVNDAPALKKADIGIAVADATDAARSASDIVLTEPGLSVIISAVLTSRAIFQRMKNYTIYAVSITIRIVFGFMFIALIWKFDFAPFMVLIIAILNDGTIMTISKDRVKPSPQPDSWKLKEIFCTGIVLGGYLALMTVLFFWAMHDTDFFTDKFSVRSLRGSDKEMMAALYLQVSIVSQALIFVTRSRSWSYVERPGLLLVSAFVIAQLVATLIAVYANWGFARIKGMGWGWAGVIWLYSVVTFVPLDLIKFATRYVLSGKAWDNLLENKTAFTTKKDYGKEEREAQWAAAQRTLHGLQPPETSNIFSERSSYRELSEIAEQAKRRAEVARLRELNTLKGHVESVVKLKGLDIDTIQQHYTV

SEQ ID NO: 5350 - protein, 949 aa, Arabidopsis lyrata
MAADISWDEIKKENVDLEKIPVDEVFQQLKCSREGLSSEEGRNRLQIFGANKLEEKVENKFLKFLGFMWNPLSWVMEAAAIMAIVLANGGGRPPDWQDFVGITCLLIINSTISFIEENNAGNAAAALMANLAPKTKVLRDGRWGEQEAAILVPGDLISIKLGDIVPADARLLEGDPLKIDQSALTGESLPATKHPGDEVFSGSTCKQGEIEAVVIATGVHTFFGKAAHLVDSTNNVGHFQKVLTAIGNFCICSIGIGMLIEIIIMYPIQHRKYRDGIDNLLVLLIGGIPIAMPTVLSVTMAIGSHRLSQQGAITKRMTAIEEMAGMDVLCSDKTGTLTLNKLTVDKNLIEVFPKDVDKDTVILLSARASRIENQDAIDTSIVNMLGDPKEARAGITEVHFLPFNPVEKRTAITYIDSNGEWHRCSKGAPEQIIELCDLKGETKRRAHEIIDKFAERGLRSLGVARQRVPEKDKESAGTPWEFVGLLPLFDPPRHDSAETIRRALDLGVNVKMITGDQLAIGKETGRRLGMGTNMYPSSSLLENKDDTTGGVPVDELIEKADGFAGVFPEHKYEIVRKLQERKHIVGMTGDGVNDAPALKKADIGIAVDDATDAARSASDIVLTEPGLSVIVSAVLTSRAIFQRMKNYTIYAVSITIRIVLGFMLVALIWEFDFSPFMVLIIAILNDGTIMTISKDRVKPSPIPDSWKLKEIFATGVVLGTYMALVTVVFFWLAHDTTFFSDKFGVRSLQGKDEELIAVLYLQVSIISQALIFVTRSRSWSFVERPGLLLLIAFFVAQLIATLIATYAHWEFARIKGCGWGWCGVIWIYSIVTYIPLDILKFITRYTLSGKAWNNMIENRTAFTTKKDYGRGEREAQWALAQRTLHGLKPPESMFEDTATYTELSEIAEQAKKRAEVARLREVHTLKGHVESVVKLKGLDIDNLNQHYTV

SEQ ID NO: 5351 - protein, 951 aa, Valeriana officinalis
MGSFSLEEIKNEAVDLERIPVEEVFEQLKCNTEGLSSEEGANRLVIFGPNKLEEKKESKVLKFLGFMWNPLSWVMEAAAIMAIALANGDGRPPDWQDFVGIVVLLVINSTISFIEENNAGNAAAALMAGLAPKTKVLRDGRWSEQDASILVPGDIISIKLGDIIPADARLLEGDPLKVDQSALTGESLAVTKNPSDEVFSGSTCKQGEIEAVVIATGVHTFFGKAAHLVDSTNQVGHFQKVLTAIGNFCICSIAVGIVVELVVMYPIQHREYRDGIDNLLVLLIGGIPIAMPTVLSVTMAIGSHRLSEQGAITKRMTAIEEMAGMDVLCSDKTGTLTLNKLTVDKNLIEVFPKGVEKEQVMLLAARASRTENQDAIDAAIVGMLADPKEARAGIREVHFLPFNPVDKRTALTYIDSNGNWHRASKGAPEQILTLCNCKEDVKRKVHSVIDKFAERGLRSLGVARQEVPEKTKESPGGAWQLVGLLPLFDPPRHDSAETIRRALHLGVNVKMITGDQLAIAKETGRRLGMGTNMYPSSSLLGQDKDSSIASLPIDELIEKADGFAGVFPEHKYEIVKRLQERKHICGMTGDGVNDAPALKKADIGIAVADATDAARGASDIVLTEPGLSVIISAVLTSRAIFQRMKNYTIYAVSITIRIVFGFLFIALIWRFDFAPFMVLIIAILNDGTIMTISKDRVKPSPMPDSWKLKEIFATGIVLGGYMALMTVVFFWLMEDTNFFSNAFGVRSLRASTPEKMAALYLQVSIVSQALIFVTRSRSWSFVERPGSLLMLAFLAAQLVATLIAVYANWGFARIQGCGWGWAGVIWLYSVVTYIPLDILKFTIRYALSGKAWNNLLENKTAFTTKSNYGKEEREAQWAAAQRTLHGLQPPESSNLFSEKNSYRELSEIAEQAKRRAEVARLRELLTLKGHVESVVKLKGLDIDTIQQHYTV

SEQ ID NO: 5352 - protein, 954 aa, Chrysanthemum coronarium
MGGDNTLSLEGIKNETVDLEKVPIEEVFEQLKCNREGLSTSEGDQRLEIFGPNKLEEKKESKLLKFLGFMWNPLSWVMEAAAIMAIALANGGGKPPDWQDFVGIITLLVINSTISFIEENNAGNAAAALMAGLAPKTKVLRDGRWSEQEAAILVPGDIISIKLGDIVPADARLLEGDPLKIDQSALTGESLPVTRNPYDEVFSGSTCKQGEIEAVVIATGVHTFFGKAAHLVDNTNNVGHFQKVLTAIGNFCICSIAVGMVVEIIVMYPIQHRPYRNGIDNLLVLLIGGIPIAMPTVLSVTMAIGSHRLSQQGAITKRMTAIEEMAGMDVLCSDKTGTLTLNKLSVDKNIIEVFGKGMDKDQVLLYAARASRTENQDAIDGAIVGTLADPKEARAGIREVHFLPFNPVDKRTALTYIDGNGNWFRASKGAPEQILTLCNCREDLKKKVHAMIDKFAERGLRSLGVARQEVPQKSKDSPGSAWEFVGLLSLFDPPRHDSAETIRRALNLGVNVKMITGDQLAIAKETGRRLGMGTNMYPSSSLLGGSKDESIASLPIEELIEKADGFAGVFPEHKYEIVKKLQERKHICGMTGDGVNDAPALKKADIGIAVADATDAARGASDIVLTEPGLSVIISAVLTSRAIFQRMKNYTIYAVSITIRIVFGFMFIALIWKFDFSPFMVLIIAILNDGTIMTISKDRVKPSPLPDSWKLKEIFATGVVLGGYLALMTVIFFWIMKDTDFFTEKFDVKSIRNSEPEMMAALYLQVSIVSQALIFVTRSRSWSFVERPGFLLMGAFLAAQLVATVIAVYADWEFARIKGIGWKWAGVIWLYSIVFYFPLDIMKFAIRYILSGKAWNSMIDNRVAFTTKKDYGRGEREAQWAHAQRTLHGLQAPDTSNLFNEKSSYRELSEIAEQAKRRAEVARLREVLTLKGHVESVVKLKGLDIDTIQQHYTV

SEQ ID NO: 5353 - protein, 947 aa, Lotus japonicus
MASDISFEDLKNENVDLENIPVDEVFQQLKCTKEGLSSDEGEKRLQIFGPNKLEEVTESKLLKFLGFMWNPLSWVMESAAIMAIVLANGGGKPPDWQDFTGIMVLLIINSTISFIEENNAGNAAAALMAGLAPKTKVLRDGKWSEEDAAILVPGDVISIKLGDIVPADARLLEGDPLKIDQSSLTGESLPVTRNPGDEVFSGSTCKQGEIEAVVIATGVHTFFGKAAHLVDSTNNVGHFQKVLTSIGNFCICSIAIGMLIEIIVMYPIQNRAYRDGIDNLLVLLIGGIPIAMPTVLSVTMAIGSHRLSQQGAITKRMTAIEEMAGMDVLCSDKTGTLTLNKLTVDKSLIEVFPSGFDKDSLILFAARASRTENQDAIDASIVNMLSDPKEARAGITEVHFLPFNPVDKRTAITYIDSNGDWHRSSKGAPEQIIELCDLKGETLKKAHKVIDEYANRGLRSLGVARQTVSEKTKESQGDEWEFLGLLPLFDPPRHDSAETIRRALDLGVNVKMITGDQLAIGKETGRRLGMGTNMYPSSSLLGQSKDAAIASIPIDELIEKADGFAGVFPEHKYEIVKRLQDRKHICGMTGDGVNDAPALKKADIGIAVADATDAARSASDIVLTEPGLSVIISAVLTSRAIFQRMKNYTIYAVSITIRIVLGFMLVALIWKFDFSPFMVLIIAILNDGTIMTISKDRVKPSPVPDSWKLKEIFATGVVLGTYMAIMTAVFFYAVHDTDLFTRLFGVHSIAESEDQLNSALYLQVSIISQALIFVTRSRSWSFVERPGLMLVGAFIAAQLVATVIAVYAHWDFARINGIGWRWAGVIWIYSVITYIPLDILKFFIRMGLSGSAWDNMLQNKTAFTTKKDYGRGEREAQWAVAQRTLHGLQVPEAHKNNHHEHSEIAEQAKRRAEAARLKELHTLKGHVESVVKLKGLDIETIQQHYTV

SEQ ID NO: 5354 - protein, 953 aa, Silene vulgaris
MSKAINLEDIKNEAVDLENIPIEEVFEQLKCSRAGLTTEEGAHRLELFGPNKLEEKKENKFLKFLGFMWNPLSWVMEAAAIMAIALANGGNKPPDWQDFVGIMCLLVINSTISFIEENNAGNAAAALMANLAPKCKLLRDNQWNESEAALLVPGDIISIKLGDIVPADARLLEGDALKIDQSALTGESLPVTKGPGDEVFSGSTCKQGEIEAVVIATGVHTFFGKAAHLVDSTNNVGHFQKVLTAIGNFCIVSIAVGMVVEILVMYPIQHRPYRSGINNLLVLLIGGIPIAMPTVLSVTMAIGSHRLSQQGAITKRMTAIEEMAGMDVLCSDKTGTLTLNKLSVDKNLIEVFCKGVDKEHVLLLAARASRVENQDAIDTCMVGMLADPKEARAGIREVHFLPFNPVDKRTALTYIDGNGNWHRVSKGAPEQILDLCHCKEDLRKKVHSVIEKYAERGLRSLAVARQEVPEKSKESPGGPWQFVGLLPLFDPPRHDSAETIRKALNLGVNVKMITGDQLAIGKETGRRLGMGTNMYPSSALLGQDKDSSLASLPIDELIEKADGFAGVFPEHKYEIVKRLQDKKHIVGMTGDGVNDAPALKKADIGIAVDDATDAARSASDIVLTEPGLSVIISAVLTSRAIFQRMKNYTIYAVSITIRIVLGFLLIALIWKYDFSPFMVLIIAILNDGTIMTISKDRVKPSPVPDSWKLKEIFATGVVLGTYLALMTVIFFWAMKETDFFPRKFGVRNISGSDPEMMAALYLQVSIVSQALIFVTRSRSWSFVERPGMLLVVAFLIAQLVATVIAVYANWAFADIKGCGWGWAGVVWIYNIVFYFPLDILKFIIRYVLSGKAWLNLFESKTAFTTKKDYGKEEREAQWAHAQRTLHGLQAPEPSSTLFHDKNNYRELSEIAEQAKRRAEVARLRELHTLKGHVESVVKLKGLDIDTINQNYTV

SEQ ID NO: 5355 - protein, 951 aa, Glycine max
MGGISLEEIKNENVDLEKIPVEEVFESLKCSTAGLTSDEGANRLQVFGPNKLEEKKESKLLKFLGFMWNPLSWVMEAAAIMAIALANGGGRPPDWQDFVGIIALLFINSTISFIEENNAGNAAAALMAGLAPKTKVLRDGRWTEQDAAILVPGDIISIKLGDIIPADARLLEGDALSVDQSALTGESLPVTKNPSEEVFSGSTVKKGEIEAVVIATGVHTFFGKAAHLVDSTNQVGHFQKVLTAIGNFCICSIAVGIIIELIVMYPIQHRKYRDGIDNLLVLLIGGIPIAMPTVLSVTMAIGSHRLSQQGAITKRMTAIEEMAGMDVLCSDKTGTLTLNKLSVDKNLIEVFAKGVEKDYVILLAARASRTENQDAIDAAIVGMLADPKEARAGIREVHFLPFNPVDKRTALTYIDSDGNWHRSSKGAPEQILNLCNCKEDVRKRVHGTIDKFAERGLRSLGVARQEVPEKNKDSPGAPWQFVGLLPLFDPPRHDSAETITRALNLGVNVKMITGDQLAIAKETGRRLGMGTNMYPSSSLLGQSKDAAVSAVPVDELIEKADGFAGVFPEHKYEIVKRLQERKHICGMTGDGVNDAPALKKADIGIAVADATDAARSASDIVLTEPGLSVIISAVLTSRAIFQRMKNYTIYAVSITIRIVFGFMFIALIWKFDFAPFMVLIIAILNDGTIMTISKDRVKPSPMPDSWKLREIFATGIVLGSYMALMTVVFFWIMKDTDFFSDKFGVRSIRNSPGEMMAALYLQVSIISQALIFVTRSRSWSYVERPGLLLLSAFMIAQLVATFLAVYANWGFARIQGMGWGWAGVIWLYSLVTYIPLDILKFAIRYVLSGKAWDNLLENKTAFTTKKDYGKEEREAQWATAQRTLHGLQPPETTNLFNDKNSYRELSEIAEQAKRRAEVARLRELHTLKGHVESVVKLKGLDIDTIQQHYTV

SEQ ID NO: 5356 - protein, 948 aa, Citrullus lanatus
MGDISLEDVKNENIDLERIPVEEVFEQLKCTKEGLSTAEGEKRLQIFGPNKLEEKKESKVLKFLGFMWNPLSWVMESAAIMAIVLANGGGKPPDWQDFVGIIVLLIINSTISFIEENNAGNAAAALMAGLAPKTKVLRDGKWKEEEAAILVPGDVISVKLGDIIPADARLLEGDPLKIDQSALTGESLPVTKHPGDEVFSGSTCKQGEIEAVVIATGVHTFFGKAAHLVDSTNQIGHFQKVLTAIGNFCICSIAIGMIIEILVMYPIQHRAYREGIDNLLVLLIGGIPIAMPTVLSVTMAIGSHRLSQQGAITKRMTAIEEMAGMDVLCSDKTGTLTLNKLTVDKSLIEVFVPNMDKDTVMLFAARASRVENQDAIDACIVGMLGDPKEARAGITEVHFLPFNPVDKRTAITYIDRDGNWHRSSKGAPEQIIDLCELKGEIRKKAHDIIDNYANRGLRSLAVGRQTVKDKDKESAGEPWEFVGLLPLFDPPRHDSAETIRRALELGVNVKMITGDQLAIGKETGRRLGMGTNMYPSSSLLGQCKDESIASIPVDELIEKADGFAGVFPEHKYEIVKKLQERNHICGMTGDGVNDAPALKKADIGIAVADATDAARSASDIVLTEPGLSVIVSAVLTSRAIFQRMKNYTIYAVSITIRIVLGFMLVALIWKFDFSPFMVLIIAILNDGTIMTISKDRVKPSPVPDSWKLKEIFATGVVLGTYMALMTVFFFWLANETNFFTNTFGVKPLKDLAEINSALYLQVSIISQALIFVTRSRSWSFVECPGLLLVIAFIAAQLVATLIAVFSEWDFARIRGIGWGWAGAIWVFSIVTYFPLDVLKFGIRYALSGKAWDNMLENKTAFTTKKDYGKGEREAQWAIAQRTMHGLQPPETIFHEKSNYEELSEIAEQAKKRAEVARLRELHTLKGHVESVVKLKGLDIETIQQHYTV

SEQ ID NO: 5357 - protein, 951 aa, Glycine max
MGGISLEEIKNENVDLERIPIEEVFEQLKCSRAGLTSEEGGNRLQVFGPNKLEEKKESKFLKFLGFMWNPLSWVMEAAAIMAIALANGGGRPPDWQDFVGIIALLVINSTISFIEENNAGNAAAALMAGLAPKTKVLRDNRWSEQDAAILVPGDIISIKLGDIIPADARLLEGDPLSVDQSALTGESLPVTKSPSDEVFSGSTVKKGEIEAVVIATGVHTFFGKAAHLVDSTNQVGHFQKVLTAIGNFCICSIAVGIVIELIVMYPIQHRRYRDGIDNLLVLLIGGIPIAMPTVLSVTMAIGSHRLSQQGAITKRMTAIEEMAGMDVLCSDKTGTLTLNKLSVDRNLIEVFAKGVEKEYVILLAARASRTENQDAIDAAIVGMLADPKEARSGIREVHFLPFNPVDKRTALTYIDSDGNWHRASKGAPEQIITLCNCKEDVRRKVHAVIDKFAERGLRSLGVARQEVPEKSKDSPGGPWQFVGLLPLFDPPRHDSAETIRRALNLGVNVKMITGDQLAIGKETGRRLGMGTNMYPSSALLGQDKDASISALPVDELIEKADGFAGVFPEHKYEIVKRLQERKHICGMTGDGVNDAPALKKADIGIAVADATDAARSASDIVLTEPGLSVIISAVLTSRAIFQRMKNYTIYAVSITIRIVFGFLFIALIWKFDFAPFMVLIIAILNDGTIMTISKDRVKPSPLPDSWKLREIFATGVVLGSYMALMTVVFFWAMKDTNFFSNKFGVRPLSDSPDKMMAALYLQVSIISQALIFVTRSRSWSFVERPGLLLLGAFFIAQLVATFIAVYANWSFARIKGMGWGWAGVIWLYSVVTYIPLDLLKFAIRYILSGKAWDNLLENKTAFTTKKDYGKEEREAQWAAAQRTLHGLQPPETSNLFNDKNSYRELSEIAEQAKRRAEVARLRELHTLKGHVESVVKLKGLDIDTIQQHYTV

SEQ ID NO: 5358 - protein, 952 aa, Gossypium raimondii
MASNGDISLEQIKNETVDLERIPVEEVFQQLKCTREGLTSEEGEKRLQIFGPNKLEEKEESKFLKFLGFMWNPLSWVMEAAAIMAIVLANGGGKPPDWPDFIGIVSLLFINSTISFIEENNAGNAAAALMAGLAPKTKVLRDGKWGEQEAATLVPGDVINVKLGDIIPADARLLEGDALKIDQSALTGESLPVTKNPGDEVFSGSTCKQGEIEAVVIATGVHTFFGKAAHLVDNTDNVGHFQKVLAAIGNFCICSIAVGMLIEILVMYPIQHRRYRDGIDNLLVLLIGGIPIAMPTVLSVTMAIGSHSLSQQGAITKRMTAIEEMAGMDVLCSDKTGTLTLNKLTVDKSLIEVFVSDMDADALVLIAARASRVENQDAIDASIVGMLGDPKEARAGITEVHFLPFNPVDKRTAITYIDRNGEWHRCSKGAPEQIIELCELTGGLRQKAHHVIDSFAGRGLRSLGVARQTIPEKKKECAGGPWEFVGLLPLFDPPRHDSAETIRQALDLGVNVKMITGDQLAIGKETSRRLGMGTNMYPSSSLLGQCKDEAIATIPVDELIETADGFAGVFPEHKYEIVKRLQELKHICGMTGDGVNDAPALKKADIGIAVADATDAARSASDIVLTEPGLSVIVSAVLTSRAIFQRMKNYTIYAVSITIRIVMGFMLIALIWEFDFSPFMVLIIAILNDGTIMTISKDRVKPSPTPDSWKLKEIFITGVVLGAYMAIVSVIFFWLVHDTLFFTEKFGVKPINENANELTSALYLQVSIISQALIFVTRSRSWSFVELPGLLLLGAFLAAQLVATCIAVYANWGFARIEGIGWEWAGVIWLFSVITYIPLDILKFIIRYSLTGKAWDNLLQKKAAFTTKKNYGKEAREAQWAADQRTLHGLSPPETSWTNEKDHHELSEIAEQAKKRAEIARLRELHTLKGHVESVVKLKGIDIDTIQQHYTV

SEQ ID NO: 5359 - protein, 954 aa, Ricinus communis
MATKGGISLEEIKNESVDLERIPIEEVFEQLKCSREGLSSEEGTNRLQVFGPNKLEEKKESKILKFLGFMWNPLSWVMEAAAIMAIALANGDGRPPDWQDFVGIVALLLINSTISFIEENNAGNAAAALMAGLAPKTKVLRDGRWTEQEAAILVPGDIISIKLGDIIPADARLLEGDPLKVDQSALTGESLPVTKNPSDEVFSGSTCKQGEIEAVVIATGVHTFFGKAAHLVDSTNQVGHFQKVLTAIGNFCICSIAVGIIIELIVMYPIQHRKYRDGIDNLLVLLIGGIPIAMPTVLSVTMAIGSHRLSQQGAITKRMTAIEEMAGMDVLCSDKTGTLTLNKLTVDRTLIEVFVKGVDKEYVILLAARASRTENQDAIDAAIVGMLADPKEARAGIRELHFLPFNPVDKRTALTYIDSDGNWHRASKGAPEQILTLCNSKEDVKKKVHAVIDKFAERGLRSLAVARQEVPERSKESPGGPWQLVGLLPLFDPPRHDSAETIRRALNLGVNVKMITGDQLAIAKETGRRLGMGTNMYPSSSLLGQDKDASIATLPVDELIEKADGFAGVFPEHKYEIVKRLQERKHICGMTGDGVNDAPALKKADIGIAVADATDAARGASDIVLTEPGLSVIISAVLTSRAIFQRMKNYTIYAVSITIRIVFGFLFIALIWKFDFSPFMVLIIAILNDGTIMTISKDRVKPSPQPDSWKLKEIFSTGVVLGGYLALMTVIFFWAMEETDFFSDKFGVRSLHNSEGEMMAALYLQVSIVSQALIFVTRSRSWSFVERPGLLLIGAFIAAQLIATVIAVYANWGFARIEGCGWGWAGVIWLYSVVTYVPLDLLKFAIRYILSGKAWDNLLENKTAFTTKKDYGKEEREAQWATAQRTLHGLQPPETTNFFADKNSYRELSEIAEQAKRRAEVARLRELHTLKGHVESVVKLKGLDIDTIQQHYTV

SEQ ID NO: 5360 - protein, 954 aa, Gossypium raimondii
MAGNKGISLDEIKNESVDLERIPIEEVFEQLKCTRAGLSTQEGNNRLQVFGPNKLEEKKESKFLKFLGFMWNPLSWVMEAAAIMAIALANGGGRPPDWQDFVGIIVLLVINSTISFIEENNAGNAAAALMANLAPKTKVLRDGRWSEQEAAILVPGDIITIKLGDIVPADARLLEGDPLKIDQSALTGESLPVTKNPSDEVFSGSTCKQGEIEAVVIATGVHTFFGKAAHLVDSTNQVGHFQQVLTAIGNFCICSIAVGIVIELIVMYPIQRRKYRDGIDNLLVLLIGGIPIAMPTVLSVTMAIGSHRLSQQGAITKRMTAIEEMAGMDVLCSDKTGTLTLNKLTVDRNLIEVFAKGVEKEQVLLYAARASRTENQDAIDAAIVGMLADPKEARAGIREVHFLPFNPVDKRTALTYIDSDGKWHRASKGAPEQIITLCNCKADVRNKVHAVIDKFAERGLRSLAVARQEVPEKTKESPGAPWQLVGLLPLFDPPRHDSAETITRALNLGVNVKMITGDQLAIAKETGRRLGMGTNMYPSSSLLGQDKDSSVSALPVDELIEKADGFAGVFPEHKYEIVKRLQERKHICGMTGDGVNDAPALKKADIGIAVADATDAARSASDIVLTEPGLSVIISAVLTSRAIFQRMKNYTIYAVSITIRIVFGFLFIALIWKFDFAPFMVLIIAILNDGTIMTISKDRVKPSPQPDSWKLKEIFSTGIVLGGYLALMTVLFFWAMKDTDFFSDKFHVRSLRDRPEQMMAALYLQVSIVSQALIFVTRSRSWSFVERPGLLLVTAFIAAQLVATLIAVYANWRFAKIQGMGWGWAAVIWLYSLVTYIPLDLIKFAIRYVLSGKAWDNLLENKTAFTTKKDYGKEEREAQWAAAQRTLHGLQPPETSNVFNERSSYRELSEIAEQAKRRAEVARLRELNTLKGHVESVVKLKGLDIDTIQQHYTV

SEQ ID NO: 5361 - protein, 922 aa, Ananas comosus
MQPRGAHRRTSLAEARHFWPQQARGEEGEQVPQVLGLHVEPAVVGDGDGGGHGHRPRQRRGQAPDWQDFVGIIVLLVINSTISFIEENNAGNAAAALMAGLAPKTKVLRDGRWSEQEAAILVPGDIISIKLGDIIPADARLLEGDPLKIDQSALTGESLPVTKSPGDEIFSGSTCKQGEIEAVVIATGVHTFFGKAAHLVDSTNNVGHFQKVLTAIGNFCICSIAVGMLIEIVVMYPIQHRRYREGIDNLLVLLIGGIPIAMPTVLSVTMAIGSHRLSEQGAITKRMTAIEEMAGMDVLCSDKTGTLTLNKLTVDKTMIEAFVKDIDRDTVVLYAARASRVENQDAIDASIVGMLADPKEARAGIQEVHFLPFNPVEKRTAITYIDSAGKWHRISKGAPEQIIDLCNLREDARKRVHGIIDKFADRGLRALAVARQEVPEAAKESAGGPWQFVAVLPLFDPPRHDSAETIRRALNLGVNVKMITGDQLAIAKETGRRLGMGTNMYPSSTLLADKKDDLAGGLPVDELIEKADGFAGVFPEHKYEIVRRLQERRHICGMTGDGVNDAPALKKADIGIAVADATDAARGASDIVLTEPGLSVIVSAVLTSRAIFQRMKNYTIYAVSITIRIVLGFLLLALIWRFDFSPFMVLIIAILNDGTIMTISKDRVKPSPVPDSWKLQEIFATGVVLGTYLALVTVLFFWATFRTDFFSDAFKVRPIRDSADELMAAVYLQVSIVSQALIFVTRSRSWCFVERPGLLLVAAFIAAQLVATIIAVYANWGFARIRGIGWGWAGVIWLFSIITFFPLDILKFIIRYALSGKAWDNVFQNKTAFANTLDYGKGEREAQWAIAQRTIHGLHPPESSGLFNDKTNYRELSEIAEQAKRRAEVARLRELHTLKGHVESVVKLKGLDIETIQQHYTV

SEQ ID NO: 5362 - protein, 953 aa, Gossypium raimondii
MVDIDDTLQEIKNENVDLERIPVEEVFLQLKCTKEGLTTEEGLKRLQIFGPNKLEEKSESKVLKFLGFMWNPLSWVMEIAAIMAIALANGGGKPPDWQDFVGITVLLIINSTISFIEENNAGNAAAALMAGLAPKTKVLRDGKWCEQEAAILVPGDIISIKLGDIIPADARLLEGDALKVDQSALTGESLPVNKNPGDGVYSGSTVKQGELEAVVIATGVHTFFGKAAHLVDSTNNVGHFQKVLTAIGNFCICSIAVGMLVEIVVMYPIQRRKYRDGIDNLLVLLIGGIPIAMPTVLSVTMAIGSHRLSQQGAITKRMTAIEEMAGMDVLCSDKTGTLTLNKLTVDKSMVEVFTKDVDKEMLLLLAARASRVENQDAIDACIVGMLGDPKEAREGITEVHFFPFNPVDKRTAMTYIESDGSWHRVSKGAPEQIISLCDLRDDVKKKAHDIIDKFADRGLRSLGVARQTVPEKTKDSPGSPWEFVGLLPLFDPPRHDSAETIRRALHLGVNVKMITGDQLAIGKETGRRLGMGTNMYPSSALLGHNKDEKVDTIDVDELIEKADGFAGVFPEHKYEIVKRLQERNHICGMTGDGVNDAPALKKADIGIAVDDATDAARSASDIVLTEPGLSVIVSAVLTSRAIFQRMKNYTIYAVSITIRIVLGFMLLALIWKFDFSPFMVLIIAILNDGTIMTISKDRVKPSPMPDSWKLKEIFATGIVLGTYLACMTVVFFWAANDSDFFSDKFGVKSIRYSQDELTAAVYLQVSIVSQALIFVTRSRSWSFIERPGLLLVVAFILAQLVATVLAVYANWGFARIKGIGWPWAGVIWLYSIVFYIPLDVLKFLIRYALSGKAWDNLLQNKTAFTTKKDYGREEREAQWATAQRTLHGLQAPGAEEILNEKSSYRELSEIAEQAKKRAEVARLRELHTLKGHVDSVVKLKGLDIETINQNYTV

SEQ ID NO: 5363 - protein, 954 aa, Chrysanthemum coronarium
MGGDNTLSLEGIKNETVDLEKVPIEEVFEQLKCNREGLSTSEGDQRLEIFGPNKLEEKKESKFLKFLGFMWNPLSWVMEAAAIMAIALANGGGKPPDWQDFVGIITLLVINSTISFIEENNAGNAAAALMAGLAPKTKVLRDGRWSEQEAAILVPGDIISIKLGDIVPADARLLEGDPLKIDQSALTGESLPVTRNPYDEVFSGSTCKQGEIEAVVIATGVHTFFGKAAHLVDNTNNVGHFQKVLTAIGNFCICSIAVGMVVEIIVMYPIQHRPYRNGIDNLLVLLIGGIPIAMPTVLSVTMAIGSHRLSQQGAITKRMTAIEEMAGMDVLCSDKTGTLTLNKLSVDKNIIEVFGKGMDKDQVLLYAARASRTENQDAIDGAIVGTLADPKEARAGIREVHFLPFNPVDKRTALTYIDGNGNWFRASKGAPEQILTLCNCREDLKKKVHAMIDKFAERGLRSLGVARQEVPQKSKDSPGSAWEFVGLLSLFDPPRHDSAETIRRALNLGVNVKMITGDQLAIAKETGRRLGMGTNMYPSSSLLGGSKDESIASLPIEELIEKADGFAGVFPEHKYEIVKKLQERKHICGMTGDGVNDAPALKKADIGIAVADATDAARGASDIVLTEPGLSVIISAVLTSRAIFQRMKNYTIYAVSITIRIVFGFMFIALIWKFDFSPFMVLIIAILNDGTIMTISKDRVKPSPLPDSWKLKEIFATGVVLGGYLALMTVIFFWIMKDTDFFTEKFDVKSIRNSEPEMMAALYLQVSIVSQALIFVTRSRSWSFVERPGFLLMGAFLAAQLVATVIAVYADWEFARIKGIGWKWAGVIWLYSIVFYFPLDIMKFAIRYILSGKAWNSMIDNRVAFTTKKDYGRGEREAQWAHAQRTLHGLQAPDTSNLFNEKSSYRELSEIAEQAKRRAEVARLREVLTLKGHVESVVKLKGLDIDTIQQHYTV

SEQ ID NO: 5364 - protein, 932 aa, Cyclamen graecum
DLEKIPIEEVFEQLKCTREGLSSEEGSNRLQIFGPNKLEEKKESKFLKFLGFMWNPLSWVMEAAAIMAIALANGDGKPPDWQDFVGIFCLLVINSTISFIEENNAGNAAAALMAGLAPKTKVLRDGKWSEQEAAILVPGDLISVKLGDIIPADARLLEGDPLKIDQSALTGESLPVTKYPGNEVFSGSTCKQGELEAVVIATGVHTFFGKAAHLVDSTNQVGHFQKVLTAIGNFCICSIGIGMLVEILVMYPIQGRAYRQGIDNLLVLLIGGIPIAMPTVLSVTMAIGSHRLSQQGAITKRMTAIEEMAGMDVLCSDKTGTLTLNKLTVDKTLIEVFAKDLDKDSVVLLAARASRIENQDAIDASIVGMLGDPKEARAGLTEVHFLPFNPVDKRTAITYIDDEGNWHRCSKGAPEQIIELCNLKGNAKNKSLAIIDNYANRGLRSLGVARQTVSEKSKESAGDPWEFVGLLPLFDPPRHDSAETIRRALDLGVNVKMITGDQLAIGKETGRRLGMGTNMYPSSSLLGQCKDESITGIPIDELIEKADGFAGVFPEHKYEIVKKLQERKHICGMTGDGVNDAPALKKADIGIAVADATDAARGASDIVLTEPGLSVIVSAVLTSRAIFQRMKNYTIYAVSITIRIVMGFMLIALIWKFDFSPFMVLIIAILNDGTIMTISKDRVKPSPLPDSWKLKEIFATGVVLGTYLAIMTVVFFWLAADTDFFSNTFGVRSLRGNVDELTAALYLQVSIVSQALIFVTRSRGWSFVERPGVLLVTAFFLAQLVATLIAVYAHWDFARIHGCGWGWAGVIWLFSLVTYFPLDVLKFIIRYSLSGNAWNTMIQNKTAFTTKKDYGKGEREAQWAVAQRTLHGLQSAQGYNDEHHTESDLAEQAKKRAEVARLRELHTLKGHVESVVKLKGLDIDTIQQHYTV

SEQ ID NO: 5365 - protein, 636 aa, Ambrosia trifida
MTAIEEMAGMDVLCSDKTGTLTLNKLTVDKNLIEVFAKGLDKEQVLLYAARASRTENQDAIDAAIVGTLADPKEARAGIREVHFFPFNPVDKRTALTYIDNNGNWFRASKGAPEQILTLCGCKEDLKKKVHAMIDKFAERGLRSLGVARQEVPQKSKDSTGGPWEFVGLLSLFDPPRHDSAETIRRALNLGVNVKMITGDQLAIAKETGRRLGMGTNMYPSSSLLGGHKDESIAGLPVDELIEKADGFAGVFPEHKYEIVKKLQERKHICGMTGDGVNDAPALKKADIGIAVADATDAARSASDIVLTEPGLSVIISAVLTSRAIFQRMKNYTIYAVSITIRIVFGFMFIALIWKFDFSPFMVLIIAILNDGTIMTISKDRVKPSPLPDSWKLKEIFATGVALGGYLALMTVIFFYIMKDTDFFTDKFSVKSLRNSNPEMMAALYLQVSIVSQALIFVTRSRSWSFIERPGFLLMGAFLAAQLVATIIAVYAEWGFARIKGIGWKWAGVIWLYSIVFYFPLDIMKFAIRYILSGKAWLSMIDNRTAFTTKKDYGRGEREAQWAHAQRTLHGLQAPDTSNLFNEKSSYRELSEIAEQAKRRAEVARLREVLTLKGHVESVVKLKGLDIDTIQQHYTV

SEQ ID NO: 5366 - protein, 954 aa, Malus domestica
MAEGKAISLEEIKKENVDLERIPVQEVFEQLNCTKEGLSSDEGQKRLQIFGPNKLEEKKDNKVLKFLGFMWNPLSWVMEAAAIMAIALANGGGRPPDWQDFVGITALLIINSTISFIEENNAGNAAAALMAGLAPKTKVLRDGRWNELEAAILVPGDVVSIKLGDIVPADARLLDGDPLKIDQSALTGESLPVTRYPGDEVFSGSTVKQGEIEAVVIATGVHTFFGKAAHLVDSTNQVGHFQKVLTAIGNFCICSIGVGIVIEVIVMYPIQHRAYRDGIDNLLVLLIGGIPIAMPTVLSVTMAIGSHRLSTQGAITKRMTAIEEMAGMDVLCSDKTGTLTLNKLTVDKTMVEVFVKDVDKDGLILLGARASRVENQDAIDTCIVGMLGDPKEAREGINEVHFLPFNPVEKRTAITYIDPEGNWHRVSKGAPEQIIELCNLKGDAEKKAHAIIGKFADRGLRSLAVARQTVPEKTKESAGTPWQFVGLLPLFDPPRHDSAETIRRALNLGVNVKMITGDQLAIGKETGRRLGMGTNMYPSSSLLGDTKDESIASLPIDELIEKADGFAGVFPEHKYEIVKRLQDRKHICGMTGDGVNDAPALKRADIGIAVDDATDAARSASDIVLTEPGLSVIISAVLTSRAIFQRMKNYTIYAVSITIRVVLGFMLLALIWKFDFSPFMVLVIAILNDGTIMTISKDRVKPSPLPDSWKLKEIFATGVVLGTYMAVMTVVFFWAAHGSDFFTEKFGVRSIRGNFPELTAAIYLQVSIISQALIFVTRSRSWSYVERPGFFLLGAFVIAQLIATIIAVYANWGFARIHGIGWGWAGVIWLYSLITYVPLDILKFIIRYVLSGKAWDNVLERKTAFTTKKDYGKGEREAQWATAQRTLHGLQPPETSELFNDKNNYRELSEIAEQAKRRAEVARLRELHTLKGHVESVVKLKGLDIDTIQQHYTV

SEQ ID NO: 5367 - protein, 413 aa, Arnica chamissonis
MGGDKALSLEEIKNETVDLEKVPIEEVFQQLKCDREGLSSDEGATRLEIFGPNKLEEKKESKLLKFLGFMWNPLSWVMEAAAIMAIAMANGGGKPPDWQDFVGIVCLLVINSTISFIEENNAGNAAAALMAGLAPKTKVLRDGRWSEQEASILVPGDIISIKLGDIVPADARLLEGDPLKIDQSALTGESLPVNKNPYDEVFSGSTCKQGEIEAVVIATGVHTFFGKAAHLVDSTNQVGHFQQVLTAIGNFCICSIAVGMLVEIVVMYPIQHRQYRSGIDNLLVLLIGGIPIAMPTVLSVTMAIGSHRLSQQGAITKRMTAIEEMAGMDVLCSDKTGTLTLNKLSVDKNLIEVFAKGVDKEQVLLFAARASRTENQDAIDAAIVGTLADPKEARAGIREIHSFHLTLLTRGQL

SEQ ID NO: 5368 - protein, 509 aa, Flaveria ramosissima
MGGDKALSLEEIKNETVDLEKVPIEEVFEQLKCNREGLSSDEGAARLQIFGPNKLEEKKESKILKFLGFMWNPLSWVMEAAAIMAIALANGGGKPPDWQDFVGIVCLLVINSTISFIEENNAGNAAAALMAGLAPKTKVLRDGRWSEQEAAILVPGDIISIKLGDIVPADARLLEGDPLKIDQSALTGESLPVNKNPYDEVFSGSTCKQGEIEAVVIATGVHTFFGKAAHLVDSTNQVGHFQQVLTAIGNFCICSIAVGMLVEIIVMYPIQHRPYRSGIDNLLVLLIGGIPIAMPTVLSVTMAIGSHRLSQQGAITKRMTAIEEMAGMDVLCSDKTGTLTLNKLTVDKNLIEVFAKGVDKEQVLLYAARASRTENQDAIDAAIVGTLADPKEARAGIREVHFFPFNPVDKRTALTYIDEQGNWHRTSKGAPEQILTLCGCKEDLKKKVHAMIDKFAERGLRSLAVAKQEVPEKTKKALVVRGSLLDCCPCLTHLGMTVPRPFVELSISV

SEQ ID NO: 5369 - protein, 903 aa, Medicago truncatula
MTTDISFEDLKDENVDLENIPIDEVFQQLKCTKEGLSSEEGEKRLQVFGPNKLEEKSESKLLKFLGFMWNPLSWVMEAAAIMAIVLANGGGKPPDWQDFTGIMVLLIINSTISFIEENNAGNAAAALMAGLAPKTKVLRDGKWSEQEAEILVPGDVISIKLGDIVPADARLLEGDPLKIDQSALTGESLPVTRNPGQEVFSGSTCKQGEIEAIVIATGVHTFFGKAAHLVDSTNNVGHFQKVLTSIGNFCICSIAVGMVIEIIVMYPIQNRAYRDGIDNLLVLLIGGIPIAMPTVLSVTMAIGSHRLSQQGAITKRMTAIEEMAGMDVLCSDKTGTLTLNKLTVDKNLIEVFPTDMNKDSVVLYAARASRVENQDAIDASIVNMLSDPKEARAGITEVHFLPFNPVDKRTAITFIDGNGNWHRSSKGAPEQIIELCGLKGETLKRAHKTIDEYAERGLRSLAVGFQTVSEKTKESAGEPWVFLGLLPLFDPPRHDSAETIRRALDLGVNVKMITGDQLAIGKETGRRLGMGTNMYPSSSLLGQSNDAAIASIPIDELIEKADGFAGVFPEHKYEIVKRLQDRKHICGMTGDGVNDAPALKKADIGIAVADATDAARSASDIVLTEPGLSVIVSAVLTSRAIFQRMKNYTIYAVSITIRIVLGFMLVALIWKFDFSPFMVLIIAILNDGTIMTISKDRVKPSPVPDSWKLKEIFATGVVLGTYMAIMTAVFFHFIHDTDFFSEIFDVHSIADSEEQLNSALYLQVSIISQALIFVTRSRSWSFVERPGLMLLGAFIAAQLVATAIAVYAHWDFARINGIGWRWAGVIWIYSIITYIPLDILKFLIRMGLTGSAWDNMLQNKTAFTTKKDYGKGEREAQWAVAQRTMHGLDTQDAHKNNHHHELS

SEQ ID NO: 5370 - protein, 951 aa, Cajanus cajan
MGGISLEEIKNENVDLERIPVEEVFEQLKCSRAGLSSDEGASRLQVFGPNKLEEKKESKLLKFLGFMWNPLSWVMEAAAIMAIALANGGGRPPDWQDFVGIIALLFINSTISFIEENNAGNAAAALMAGLAPKTKVLRDGRWTEQDAAILVPGDIVSIKLGDIIPADARLLEGDALSVDQSALTGESLPVTKNPSDEVFSGSTVKKGEIEAVVIATGVHTFFGKAAHLVDSTNQVGHFQKVLTAIGNFCICSIAVGIIIELIVMYPIQHRKYRDGIDNLLVLLIGGIPIAMPTVLSVTMAIGSHRLSQQGAITKRMTAIEEMAGMDVLCSDKTGTLTLNKLSVDKNLIEVFAKGVEKDHVILLAARASRTENQDAIDAAIVGMLADPKEARAGIREVHFLPFNPVDKRTALTYIDSDGNWHRSSKGAPEQILNLCNCKEDVRKRVHGVIDKFAERGLRSLGVARQEIPEKNKDSPGAPWQFVGLLPLFDPPRHDSAETITRALNLGVNVKMITGDQLAIAKETGRRLGMGTNMYPSSSLLGQSKDASVSALPVDELIEKADGFAGVFPEHKYEIVKRLQERKHICGMTGDGVNDAPALKKADIGIAVADATDAARSASDIVLTEPGLSVIISAVLTSRAIFQRMKNYTIYAVSITIRIVFGFMFIALIWKFDFAPFMVLIIAILNDGTIMTISKDRVKPSPQPDSWKLREIFATGVVLGSYLALMTVVFFWLMKDTDFFSDKFGVRSIRNSPEEMMAALYLQVSIISQALIFVTRSRSWSYVERPGLLLLGAFMIAQLVATFLAVYASWGFARIKGMGWGWAGVIWLYSLVTYVPLDILKFTIRYVLSGKAWDNLLENKTAFTTKKDYGKEEREAQWATAQRTLHGLQPPETTNLFNDKNSYRELSEIAEQAKRRAEVARLRELHTLKGHVESVVKLKGLDIDTIQQHYTV

SEQ ID NO: 5371 - protein, 954 aa, Tabernaemontana elegans
MGGDKGISLEEIKNETVDLEKIPIEEVFEQLKCTRDGLSSEEGANRIQIFGPNKLEEKKESKILKFLGFMWNPLSWVMEAAAIMAIALANGGGAPPDWQDFVGIVCLLVINSTISFIEENNAGNAAAALMAGLAPKTKVLRDGRWTEQEAAILVPGDIISIKLGDIIPADARLLEGDPLKIDQSALTGESLPVTKNPGDEVFSGSTCKQGEIEAVVIATGVHTFFGKAAHLVDSTNQVGHFQKVLTAIGNFCICSIAVGMLAEIIVMYPIQHRAYRKGIDNLLVLLIGGIPIAMPTVLSVTMAIGSHRLSQQGAITKRMTAIEEMAGMDVLCSDKTGTLTLNKLTVDKSIIEVFAKGVDKDHVILLAARASRVENQDAIDACIVGSLADPKEARAGIREVHFFPFNPVDKRTALTYIDSDGNWHRSSKGAPEQILTLCNASEDMKRKVHSIIDKFAERGLRSLAVARQQVPAKSKDSPGGPWQFVGLLSLFDPPRHDSAETIRRALNLGVNVKMITGDQLAIAKETGRRLGMGTNMYPSASLLGQHKDESIAGLPVEELIEKADGFAGVFPEHKYEIVKKLQERKHIVGMTGDGVNDAPALKKADIGIAVADATDAARSASDIVLTEPGLSVIISAVLTSRAIFQRMKNYTIYAVSITIRIVFGFLFIALIWKFDFSPFMVLIIAILNDGTIMTISKDRVKPSPTPDSWKLKEIFATGIVLGGYLALMTVIFFWVMKDTDFFTDKFGVRSIRNSEHEMMAALYLQVSIVSQALIFVTRSRSWSFMERPGLFLLGAFLIAQLVATLIAVYANWSFARIKGCGWGWAGVIWLYSVVFYVPLDLIKFFIRYVLSGKAWTNLLENKTAFTTKKDYGKEEREAQWAVAQRTLHGLQPPETSNIFEEKSSYRELSEIAEQAKRRAEMARLRELHTLKGHVESVVKLKGLDIETIQQHYTV

SEQ ID NO: 5372 - protein, 581 aa, Triphysaria pusilla
MASDITLDGVKNETVDLENIPIEEVFTELKCSREGLSSDEGAKRLEIFGPNKLEEKKDSKFLKFLGFMWNPLSWVMESAAVMAIVLANGGGKPPDWQDFVGIVVLLIINSTISFIEENNAGNAAAALMAGLAPKTKVLRDGKWSEQEACILVPGDLISVKLGDIIPADARLLEGDPLKIDQSALTGESLPVTKNPGDGVFSGSTCKQGELEAVVIATGVHTFFGKAAHLVDSTNNVGHFQKVLTAIGNFCICSIAVGMAIEIIVMYPIQQREYRQGIDNLLVLLIGGIPIAMPTVLSVTMAIGSHRLSQQGAITKRMTAIEEMAGMDVLCSDKTGTLTLNKLTVDKSLIEVFVKDMDKDTVVLLAARASRTENQDAIDASIVNMLSDPKEARAGLTEVHFLPFNPVDKRTAITYYDSNGDWHRCSKGAPEQIIELCELKGAELKKAHDIIDNYANRGLRSLGISRQTVPEKTKESAGSPWEFVGLLPLFDPPRHDSAETIKKALELGVNVKMITGDQLAIGKETGRRLGMGTNMYPSSSLLGQCKDESISSIPVDELIKKPTASPESSRSTSTRSSGDSKK

SEQ ID NO: 5373 - protein, 951 aa, Theobroma cacao
MASDGDTSLEQIKNETVDLERIPVEEVFEQLKCTREGLTTAEGEKRLEIFGPNKLEEKKECKFLKFLGFMWNPLSWVMEAAAIMAIVLANGGGKPPDWQDFVGIVALLFINSTISFIEENNAGNAAAALMAGLAPKTKVLRDGKWGEQDAAILVPGDVISVKLGDIIPADARLLEGDALKIDQSALTGESLPVTKNPGDEVFSGSTCKQGEIEAVVIATGVHTFFGKAAHLVDSTNNVGHFQKVLTAIGNFCICSIAVGMLIEIIVMYPIQHRRYRDGIDNLLVLLIGGIPIAMPTVLSVTMAIGSHRLSEQGAITKRMTAIEEMAGMDVLCSDKTGTLTLNKLTVDRSLIEVFASGIDKDTLMLLAARASRVENQDAIDASIVGMLGDPKEARAGITELHFFPFNPVDKRTAITYIDSDGEWHRCSKGAPEQIIDLCGLTGELRKKALGVIDNFADRGLRSLAVARQTIPEKTKESAGGPWEFVGLLPLFDPPRHDSAETIRRALDLGVNVKMITGDQLAIGKETGRRLGMGTNMYPSSSLLGQSKDEAIAAIPVDELIEKADGFAGVFPEHKYEIVKRLQDRKHICGMTGDGVNDAPALKKADIGIAVADATDAARSASDIVLTEPGLSVIVSAVLTSRAIFQRMKNYTIYAVSITIRIVMGFMLVALIWKFDFSPFMVLIIAILNDGTIMTISKDRVKPSPMPDSWKLNEIFATGIVLGAYMAIISVLFFWLAHDTDFFTEKFGVRPIHDNIDELTSALYLQVSIISQALIFVTRSRSWSFVERPGLLLIGAFIAAQLVATLIAVYASWGFARIQGIGWGWAGVIWLFSLITYIPLDILKFIIRYSLSGKAWDNLLQNKTAFTTKKDYGKGEREAQWAAAQRTLHGLSPPETILNDKSYHELSEIAEQAKKRAEVARLRELHTLKGHVESVVKLKGLDIDTIQQHYTV

SEQ ID NO: 5374 - protein, 951 aa, Musa acuminata
MSSAISLEEIKNDAVDLEHIPVGEVFEQLKCDRNGLTNVEGENRIKIFGLNKLEEKKESKVLKFLGFMWNPLSWVMESAAIMAIALANGGGKPPDWQDFIGIISLLIINSTISFIEENNAGNAAAALMAGLAPKTKVLRDGRWSEQDAAILVPGDIISIKLGDIIPADARLLDGDPLKIDQSALTGESLPVTRNPGDEVFSGSTCKQGEIEAVVIATGVHTFFGKAAHLVDSTNNVGHFQKVLTAIGNFCICSIAVGMAIEIVVMYPIQRRKYRDGIDNLLVLLIGGIPIAMPTVLSVTMAIGSHRLSEQGAITKRMTAIEEMAGMDVLCSDKTGTLTLNKLTVDRNLIEVFERDVDREAVILHAARAARVENQDAIDAAIVGMLADPKEARAGIDEVHFLPFNPVDKRTAITYVDSFGNWHRSSKGAPEQIVELCNMREDAKKKVHAVIDKFADRGLRSLAVARQEIPEKRKESAGGPWQFMGLLPLFDPPRHDSAETIRRALNLGVNVKMITGDQLAIAKETGRRLGMGTNMYPSSTLLGNKNDDFTGSIPVDELIEKADGFAGVFPEHKYEIVKRLQERSHICGMTGDGVNDAPALKKADIGIAVADATDAARGASDIVLTEPGLSVIVSAVLTSRAIFQRMKNYTIYAVSITIRVVLGFLLLALIWRFNFSPFMVLIIAILNDGTIMTISKDRVKPSPMPDSWKLREIFATGIVLGTYLALMTVLFFWIADQTDLFPKTFGVRPIRDNQDELTSAIYLQVSVVSQALIFVTRSRSWCFVERPGLLLVAAFVVAQLVATFISVYASWGFARIHGIGWGWAGVIWLFSIVTFFPLDILKFIIRYTLSGKAWVNLYESKTAFTTKLDYGKGEREAQWALAQRTLHGLQPPDSSGLFNEKNYRELSEIAEQAKRRAEVARLRELHTLKGHVESVVKLKGLDIETMQHHYTL

SEQ ID NO: 5375 - protein, 950 aa, Petroselinum crispum
MGLSLEEIKNETVDLEKIPIEEVFEQLKCTREGLSTDEGENRLQIFGPNKLEEKKESKLLKFLGFMWNPLSWVMEAAAIMAIALANGNGKPPDWQDFVGIMCLLVINSTISFIEENNAGNAAAALMAGLAPKTKVLRDGRWSEQDAAILVPGDIISIKLGDIVPADARLLEGDPLKIDQSALTGESLPVTRNPYDEVFSGSTCKQGEIEAVVIATGVHTFFGKAAHLVDSTNQVGHFQKVLTAIGNFCICSIAVGMLVEIVVMYPIQHRKYRDGIDNLLVLLIGGIPIAMPTVLSVTMAIGSHRLSQQGAITKRMTAIEEMAGMDVLCSDKTGTLTLNKLTVDKNLIEVFAKGSDKEHVLLCAARASRTENQDAIDAAIVGTLADPKEARAGIREVHFLPFNPVDKRTALTYIDSDGNWHRTSKGAPEQILTLCNCKEDLKKKVHAMIDKFAERGLRSLGVASQVVPEKSKDSAGGPWQFVGLLSLFDPPRHDSAETIRRALHLGVNVKMITGDQLAIAKETGRRLGMGTNMYPSASLLGQDKDASIAALPVEELIEKADGFAGVFPEHKYEIVKKLQERKHICGMTGDGVNDAPALKKADIGIAVADATDAARSASDIVLTEPGLSVIISAVLTSRAIFQRMKNYTIYAVSITIRIVFGFMFIALIWKFDFSPFMVLIIAILNDGTIMTISKDRVKPSPLPDSWKLKEIFATGVVLGGYLALLTVIFFWLMKDTDWFPNTFGVRSIRYNPEEMMAALYLQVSIVSQALIFVTRSRSWSFVERPGFLLLGAFLIAQLIATLVAVYANWGFARIHGCGWGWAGVIWLYSIVFYFPLDIMKFATRYALSNKAWQSMIDNRTAFTTKKDYGKEEREAQWALAQRTLHGLQPPEASNIFNEKSSYRELSEIAEQAKRRAEVARLRELHTLKGHVESVVKLKGLDIDTIQQHYTV

SEQ ID NO: 5376 - protein, 951 aa, Cicer arietinum
MGGISLEEIKNESVDLERIPIEEVFEQLKCSRQGLTSEEGANRLQVFGPNKLEEKKESKFLKFLGFMWNPLSWVMEAAAIMAIALANGSGRPPDWQDFVGIIALLVINSTISFIEENNAGNAAAALMAGLAPKTKVLRDSRWSEQDAAILVPGDIISIKLGDIIPADARLLEGDPLSVDQSALTGESLPVTKSSSDEVFSGSTVKKGEIEAVVIATGVHTFFGKAAHLVDSTNQVGHFQKVLTAIGNFCICSIAIGILIELIVMYPIQHRKYRDGIDNLLVLLIGGIPIAMPTVLSVTMAIGSHRLSQQGAITKRMTAIEEMAGMDVLCSDKTGTLTLNKLSVDRNLIEVFAKGIEKEYVILLAARASRTENQDAIDAAIVGMLADPKEARAGIREVHFLPFNPVDKRTALTYIDSEGKWHRASKGAPEQIINLCNCKEDVRKKVHSVIDKFAERGLRSLGVARQEVPEKSKESPGGPWQFVGLLPLFDPPRHDSAETIRRALNLGVNVKMITGDQLAIGKETGRRLGMGTNMYPSSALLGQDKDASISALPVDELIEKADGFAGVFPEHKYEIVKRLQEKKHICGMTGDGVNDAPALKKADIGIAVADATDAARSASDIVLTEPGLSVIISAVLTSRAIFQRMKNYTIYAVSITIRIVFGFLFIALIWKFDFAPFMVLIIAILNDGTIMTISKDRVKPSPLPDSWKLREIFATGVVLGSYMALMTVVFFWAMKDTNFFSNKFGVRSLRHNSEEMMAALYLQVSIISQALIFVTRSRSWSFAERPGLLLLGAFFIAQLVATFIAVYANWGFARIKGMGWGWAGVIWLYSLVTYIPLDLLKFAIRYVLSGKAWDNLLENKTAFTTKKDYGKEEREAQWAAAQRTLHGLQPPEASNLFNEKNSYRELSEIAEQAKRRAEVARLRELHTLKGHVESVVKLKGLDIDTIQQHYTV

SEQ ID NO: 5377 - protein, 951 aa, Lupinus angustifolius
MGVISLEEIKNENVDLERIPIEEVFEQLKCSRAGLTSEEGDNRIQVFGPNKLEEKRESKFLKFLGFMWNPLSWVMEAAAIMAIALANGNGRPPDWQDFVGIIALLVINSTISFIEENNAGNAAAALMAGLAPKTKVLRDGRWSEQDAAILVPGDIISIKLGDIIPADARLLEGDPLSVDQSALTGESLPATKHSSDEVFSGSTVKKGEIEAVVIATGVHTFFGKAAHLVDSTNQVGHFQKVLTAIGNFCICSIAVGIVIELVVMYPIQHRKYRDGIDNLLVLLIGGIPIAMPTVLSVTMAIGSHRLSQQGAITKRMTAIEEMAGMDVLCSDKTGTLTLNKLSVDRNLIEVFAKGVEKEYVILLAARASRTENQDAIDAAIVGMLADPKEARAGIREVHFLPFNPVDKRTALTYIDSNGNWHRSSKGAPEQIIELCNCKEDVRKRVHSVIDKFAERGLRSLGVARQEVPEKTKESPGAPWQFVGLLPLFDPPRHDSAETIRRALNLGVNVKMITGDQLAIGKETGRRLGMGTNMYPSSSLLGQDKDSSISALPVDELIEKADGFAGVFPEHKYEIVKRLQERKHICGMTGDGVNDAPALKKADIGIAVADATDAARSASDIVLTEPGLSVIISAVLTSRAIFQRMKNYTIYAVSITIRIVFGFMFIALIWKFDFAPFMVLIIAILNDGTIMTISKDRVKPSPLPDSWKLREIFATGVVLGTYMALMTVVFFWAMKDTNFFPDMFGVRTIRYNPDEMMAALYLQVSIISQALIFVTRSRSWSFAERPGLLLLGAFLIAQLVATFIAVYANWGFARIKGMGWGWAGVIWLYSLVTYIPLDLLKFAIRYILSGKAWDNLLENKTAFTTKKDYGKEEREAQWAAAQRTLHGLQPPETSNLFNEKNSYRELSEIAEQAKRRAEVARLRELHTLKGHVESVVKLKGLDIDTIQQHYTV

SEQ ID NO: 5378 - protein, 951 aa, Lupinus angustifolius
MGVISLEEIKNENVDLERIPIEEVFEQLKCSRAGLTSEEGDNRLQVFGPNKLEEKKESKFLKFLGFMWNPLSWVMEAAAIMAIALANGDGMPPDWQDFVGIIALLVINSTISFIEENNAGNAAAALMAGLAPKTKVLRDGRWSEQDAAILVPGDIISIKLGDIIPADARLLEGDPLSVDQSALTGESLPVTKHSSDEVFSGSTVKKGEIEAVVIATGVHTFFGKAAHLVDSTNQVGHFQKVLTAIGNFCICSIAVGIVIELVVMYPIQRRKYRDGIDNLLVLLIGGIPIAMPTVLSVTMAIGSHRLSQQGAITKRMTAIEEMAGMDVLCSDKTGTLTLNKLSVDRNLIEVFAKGVEKEYVILLAARASRTENQDAIDAAIVGMLADPKEARAAIREVHFLPFNPVDKRTALTYIDSNGNWHRASKGAPEQIIELCNCKEDVRKKVHSVIDKFAERGLRSLGVARQEVPEKTKDSPGAPWQFVGLLPLFDPPRHDSAETIRRALNLGVNVKMITGDQLAIGKETGRRLGMGTNMYPSSSLLGQDKDSSISALPVDELIEKADGFAGVFPEHKYEIVKRLQERKHICGMTGDGVNDAPALKKADIGIAVADATDAARSASDIVLTEPGLSVIISAVLTSRAIFQRMKNYTIYAVSITIRIVFGFMFIALIWKFDFAPFMVLIIAILNDGTIMTISKDRVKPSPLPDSWKLREIFATGVVLGSYMAFMTVVFFWAMKDTNFFPNKFGVRTIRYNPDEMMAALYLQVSIISQALIFVTRSRSWSFAERPGLLLLGAFFIAQLVATFIAVYANWEFARIKGMGWGWAGVIWLYSLVTYIPLDILKFAIRYILSGKAWDNLLENKTAFTTKKDYGKEEREAQWAAAQRTLHGLQPPETSNLFNEKNSYRELSEIAEQAKRRAEVARLRELHTLKGHVESVVKLKGLDIDTIQQHYTV

SEQ ID NO: 5379 - protein, 951 aa, Arachis hypogaea
MGGISLEEIKNENVDLEHIPVDEVFEQLKCSREGLSQDEGASRLQVFGPNKLEEKKESKFLKFLGFMWNPLSWVMEAAAIMAIALANGGGRPPDWQDFVGIIALLFINSTISFIEENNAGNAAAALMAGLAPKTKVLRDGRWTEQDAAILVPGDIISIKLGDIIPADARLLEGDALSVDQSALTGESLPVTKNPHDEVFSGSTVKKGEIEAVVIATGVHTFFGKAAHLVDSTNQVGHFQKVLTAIGNFCICSIAVGIAIELIVMYPIQHRKYRDGIDNLLVLLIGGIPIAMPTVLSVTMAIGSHRLSQQGAITKRMTAIEEMAGMDVLCSDKTGTLTLNKLTVDKNLIEVFAKGVEKDHVILLAARASRTENQDAIDAAIVGMLADPKEARAGIREVHFFPFNPVDKRTALTYIDSDGNWHRSSKGAPEQILNLCNCKEDVRRKAHAIIDKFAERGLRSLGVARQEVPEKSKDAPGAPWQFVALLPLFDPPRHDSAETITRALNLGVNVKMITGDQLAIAKETGRRLGMGTNMYPSSSLLGQSKDAAVSALPVDELIEKADGFAGVFPEHKYEIVKRLQDRKHICGMTGDGVNDAPALKRADIGIAVADATDAARSASDIVLTEPGLSVIISAVLTSRAIFQRMKNYTIYAVSITIRIVFGFMFIALIWKFDFAPFMVLIIAILNDGTIMTISKDRVKPSPQPDSWKLKEIFATGIVLGSYLALMTVVFFWLMKDTDFFSDKFGVRSLRHSPAEMMAALYLQVSIISQALIFVTRSRSWSYVERPGLLLLGAFMIAQLVATALAVYANWSFARIKGMGWGWAGVIWLYSLVTYVPLDLLKFAIRYALSGKAWDNLLENKTAFTTKKDYGKEEREAQWAAAQRTLHGLQPPETTNLFNDKNSYRELSEIAEQAKRRAEVARLRELHTLKGHVESVVKLKGLDIDTIQQHYTV

SEQ ID NO: 5380 - protein, 906 aa, Papaver somniferum
DLERIPMDEVFEQLKCSKEGLSTEEGANRLEIFGPNKLEEKKESKLLKFLGFMWNPLSWVMEIAAIMAIALANGGGRPPDWQDFVGIMVLLVINSTISFIEENNAGNAAQALMAGLAPKTKVLRDGRWSEQDAAILVPGDIISIKLGDIVPADARLLEGDPLKIDQSALTGESLPVTKNPSDEVFSGSTCKQGELEAVVIATGVHTFFGKAAHLVDSTNQVGHFQKVLTAIGNFCICSIAIGMLIEIIVMYPIQKRKYRDGIDNLLVLLIGGIPIAMPTVLSVTMAIGSHRLSQQGAITKRMTAIEEMAGMDVLCSDKTGTLTLNKLSVDKNLVEVFAKGVEKDHVLLVAARASRVENQDAIDACMVGMLADPKEARAGIREVHFLPFNPVDKRTALTYIDNDGKWHRASKGAPEQIIDLCNCKEDVRNKVHSVIDKYAERGLRSLAVARQEVPEKNKDSPGAPWQFVGLLPLFDPPRHDSAETIRRALNLGVNVKMITGDQLAIAKETGRRLGMGTNMYPSSALLGNNKDASIASLPVDELIEKADGFAGVFPEHKYEIVKKLQEKKHICGMTGDGVNDAPALKKADIGIAVADATDAARGASDIVLTEPGLSVIISAVLTSRAIFQRMKNYTIYAVSITIRIVFGFMFIALIWKFDFAPFMVLIIAILNDGTIMTISKDRVKPSPTPDSWKLKEIFATGVVLGSYLALMTVIFFWAAWKTDFFSDKFGVRPIRDDKREMMAALYLQVSIVSQALIFVTRSRSWSFVERPGFLLVFAFFAAQLVATLIAVYANWEFANMRGIGWGWAGVVWLFSLVTYFPLDILKFIIRYVLSERLGTTSLKTRLPSLPRRITEKRREKLNGLLLKELYMDYNHQKQITSSLTRIATESFQKLLSKLRGELKLPD

SEQ ID NO: 5381 - protein, 954 aa, Helianthus annuus
MGGDKALSLEEIKNETVDLEKVPIEEVFEQLKCNREGLSSDEGAARLQIFGPNKLEEKKESKLLKFLGFMWNPLSWVMEAAAIMAIALANGGGKPPDWQDFVGIVCLLVINSTISFIEENNAGNAAAALMAGLAPKTKVLRDGNWSEQEAAILVPGDIISIKLGDIVPADARLLEGDPLKIDQSALTGESLPVNKNPYDEVFSGSTCKQGEIEAVVIATGVHTFFGKAAHLVDSTNQVGHFQQVLTAIGNFCICSIAVGMLVEIVVMYPIQHREYRNGIDNLLVLLIGGIPIAMPTVLSVTMAIGSHRLSQQGAITKRMTAIEEMAGMDVLCSDKTGTLTLNKLSVDKNLIEVFAKGVDKDQVLLYAARASRTENQDAIDAAIVGTLADPKEARAGIREVHFFPFNPVDKRTALTYIDERGNWHRTSKGAPEQILTLCGCKEDMKKKVHAMIDKFAERGLRSLAVAKQEVPEKNKESPGGPWTFIGLLSLFDPPRHDSAETIRRALNLGVNVKMITGDQLAIAKETGRRLGMGTNMYPSSSLLGNHKDASIAAIPIEELIEKADGFAGVFPEHKYEIVKKLQERKHICGMTGDGVNDAPALKKADIGIAVADATDAARGASDIVLTEPGLSVIISAVLTSRAIFQRMKNYTIYAVSITIRIVFGFLFIALIWKFDFSPFMVLIIAILNDGTIMTISKDRVKPSPLPDSWKLKEIFATGIVLGGYLALMTVIFFWIMKDTNFFSDTFGVRSLRHSEVEMMAALYLQVSIVSQALIFVTRSRSWSFIERPGLLLLGAFLAAQLVATLIAVYANWEFARIKGVGWGWAGVIWLYSIVFYFPLDLMKFAIRYILSGKAWNNLLENKTAFTSKKDYGREEREAQWALAQRTLHGLQQPETSNIFNEKSSYRELSEIAEQAKRRAEVARLREVLTLKGHVESVVKLKGLDIDTIQQHYTV

SEQ ID NO: 5382 - protein, 922 aa, Ananas comosus
MASNKSTGLEDIKNETVDLERIPIDEVFEQLKCTREGLSSEEGANRLQLFGPNKLEEKKESKVLKFLGFMWNPLSWVMEMAAIMAIALANGDGKPPDWQDFVGIVVLLLINSTISFIEENNAGNAAAALMAGLAPKTRVLRDGRWTEQDAAILVPGDIISIKLGDIVPADARLLEGDPLKIDQSALTGESLPVTKNPGDEVFSGSTCKQGEIEAVVIATGVHTFFGKAAHLVDSTNQVGHFQKVLTAIGNFCICSIAVGIVVEIIVMYPIQHRKYRDGIDNLLVLLIGGIPIAMPTVLSVTMAIGSHRLAQQGAITKRMTAIEEMAGMDVLCSDKTGTLTLNKLSVDKNLIEVFAKGVDKEYVILLAARASRTENQDAIDAAIVGMLADPKEARAGIREVHFLPFNPVDKRTALTYIDADGTWHRVSKGAPEQILNLCNCKEDVRNKVHSVIDKFAERGLRSLAVARQVVPEKNKDSPGGPWQFVGLLPLFDPPRHDSAETIRRALNLGVNVKMITGDQLAIAKETGRRLGMGTNMYPSSSLLGQHKDASIAVLPVDELIEKADGFAGVFPEHKFEIVKRLQERKHICGMTGDGVNDAPALKKADIGIAVADATDAARSASDIVLTEPGLSVIISAVLTSRAIFQRMKNYTIYAVSITIRIVLGFMLIALIWKFDFSPFMVLIIAILNDGTIMTISKDRVKPSPMPDSWKLKEIFVTGVVFGSYLALMTVVFFWAMIDTDFFLDKFNVRSLRHSEDEMMAALYLQVSIISQALIFVTRSRSWCFVERPGLLLISAFIIAQLVATVIAVYADWGFARIKGIGWGWAGVIWLYSIASFMPLDWFKFAIRYALSGKAWDNLLENKTAFTTKKDYGREEREAQWAMAQRTLHGLQPPETANIFPDKGGYRELSEIAEQAKRRAEVA

SEQ ID NO: 5383 - protein, 951 aa, Allium cepa
MGAISLEEIKNENVDLERIPIEEVFEQLKCTREGLSSDEGASRLTIFGPNKLEEKKESKLLKFLGFMWNPLSWVMEMAAIMAIALANGGGKPPDWQDFVGIVVLLVINSTISFIEENNAGNAAAALMAGLAPKTKVLRDGRWSEQDAAILVPGDIISIKLGDIVPADARLLEGDPLKIDQSALTGESLPVTRHPGDEVFSGSTCKQGEIEAVVIATGVHTFFGKAAHLVDSTNQVGHFQKVLTAIGNFCICSIAIGMVVEIVVMYPIQKRHYRSGIDNLLVLLIGGIPIAMPTVLSVTMAIGSHRLSEQGAITKRMTAIEEMAGMDVLCSDKTGTLTLNKLSVDKNLIEVFVKGVDKDYVMLLAARASRTENQDAIDTCMVGMLADPKEARAGIREIHFLPFNPVDKRTALTYIDSDGNWHRASKGAPEQIVDLCKCKEDVKNKVHSIMEKYAERGLRSLAVARQEVPEKSKESSGGPWQFVGLLPLFDPPRHDSAETIRRALNLGVNVKMITGDQLAIAKETGRRLGMGTNMYPSSSLLGQHKDESIASLPIDELIEKADGFAGVFPEHKYEIVKKLQERKHICGMTGDGVNDAPALKKADIGIAVDDATDAARSASDIVLTEPGLSVIISAVLTSRAIFQRMKNYTIYAVSITIRIVLGFLLIALIWKFDFSPFMVLIIAILNDGTIMTISKDRVKPSPLPDSWKLKEIFATGVVYGTYLAIMSVIFFWVMKDTDFFSKKFGVRSIRHSEDEMMSALYLQVSIVSQALIFVTRSRGWFFVERPGLLLVSAFFIAQLVATLIAVYADWGFARIKGIGWGWAGVIWLYSVIFFFPLDWFKFAIRYILSGKAWDNLLQNKTAFTTKKDYGKEEREAQWATAQRTLHGLQTSENTNLFSDKNNYRELSEIAEQAKKRAEVARLRELHTLKGHVESVIKLKGLDIDGMQQHYTV

SEQ ID NO: 5384 - protein, 951 aa, Nicotiana tabacum
MASNLSLEDIKNEQVDLENIPVEEVFQQLKCSKEGLSSEEGKTRLQIFGPNKLEEKKENKFLKFLGFMWNPLSWVMESAAIMAIALANGGGKAPDWPDFVGITVLLVINSTISFIEENNAGNAAAALMANLAPKTKILRDGKWSEEDASILVPGDLISIKLGDIVPADARLLEGDPLKIDQAALTGESLPVTKFPGAEVFSGSTVKQGEIEAVVIATGVHTFFGKAAHLVDSTNQVGHFQKVLTAIGNFCICSIAVGMVIEIVVMYPIQRRKYRDGIDNLLVLLIGGIPIAMPTVLSVTMAIGSHRLAQQGAITKRMTAIEEMAGMDVLCSDKTGTLTLNKLTVDKNLIEVFPKDADKDTVMLLAARASRVENQDAIDACIVNMLGDPKEARAGIQEVHFLPFNPVEKRTAITYIDDKGNWHRASKGAPEQIIELCELKGDIRKKSLDIIDSYANRGLRSLAVARQTVPEKSKESDGSPWEFVGLLPLFDPPRHDSAETIRKALDLGVNVKMITGDQLAIGKETARRLGMGTNMYPSSALLGEHKDAAIASIPVDELIEKADGFAGVFPEHKYEIVKKLQERNHICGMTGDGVNDAPALKKADIGIAVDDATDAARSASDIVLTEPGLSVIVSAVLTSRAIFQRMKNYTIYAVSITIRVVMGFMLIALIWKFDFSPFMVLIIAILNDGTIMTISKDRVKPSPLPDSWKLKEIFATGVVLGTYQAIMTVVFFYLAADTDFFSENFHVRSIRNSPTELTAALYLQVSIISQALIFVTRSRSWSFVERPGLMLVGAFFAAQLVATVLAVYANWEFARIKGVGWGWAAVIWIYTIITYIPLDILKFIIRFALSGRAWDSMIQNKTAFTTKKDYGRGEREAQWALAQRTLHGLQTPENTGLFNDKNYRELSEIAEQAKRRAEVARLRELHTLKGHVESVVKLKGLDIETIQQHYTV

SEQ ID NO: 5385 - protein, 954 aa, Cocos nucifera
MGGGTAISLEEIKNETVDLENIPIEEVFQQLKCTREGLTSDEGAQRLQIFGPNKLEEKKESKVLKFLGFMWNPLSWVMESAAIMAIALANGGGKPPDWQDFVGIVVLLVINSTISFIEENNAGNAAAALMAGLAPKTKVLRNGCWCEEEAAILVPGDIISIKLGDIVPADARLLEGDPLKIDQSALTGESLPVTKNPGDEVFSGSTCKQGEIEAVVIATGVHTFFGKAAHLVDSTNQVGHFQKVLTAIGNFCICSIALGMIVEILVMYPIQHRKYRNGIDNLLVLLIGGIPIAMPTVLSVTMAIGSHRLSEQGAITKRMTAIEEMAGMDVLCSDKTGTLTLNKLSVDKNLIEVFAKGVDKDHVVLLAARASRTENQDAIDAAMVGMLADPKEARAGITEVHFLPFNPVDKRTALTYVDAHGKWHRASKGAPEQILSLCNCKEDVRKKVHGVIDKFAERGLRSLGVARQEVPEKNKESPGAPWQFVGLLSLFDPPRHDSAETIRRALNLGVNVKMITGDQLAIAKETGRRLGMGTNMYPSSSLLGQNKDESIAGLPVDELIEKADGFAGVFPEHKYEIVKKLQERKHICGMTGDGVNDAPALKKADIGIAVADATDAARSASDIVLTEPGLSVIISAVLTSRAIFQRMKNYTIYAVSITIRIVLGFMLIALIWKFDFSPFMVLIIAILNDGTIMTISKDRVKPSPQPDSWKLREIFATGVVLGTYLALMTVIFFWAMKETDFFSDKFHVRSLRNSEDEMMAALYLQVSIVSQALIFVTRSRSWCFVERPGLLLVTAFVVAQLVATLIAVYANWGFARIKGIGWGWAGVIWLYSIVFFFPLDLFKFAIRYILSGKAWDNVLEKKTAFTSKKDYGIEEREAQWATAQRTLHGLQPPETTNLFNDKNSYRELSEIAEQAKRRAEVARLRELHTLKGHVESVVKLKGLDIDTIQQHYTV

SEQ ID NO: 5386 - protein, 954 aa, Cocos nucifera
MGGGSAISLEEIKNETVDLERIPIEEVFEQLKCTQEGLTSEEGANRLQIFGPNKLEEKKESKVLKFLGFMWNPLSWVMESAAIMAIALANGGGKPPDWQDFVGIIALLVINSTISFIEENNAGNAAAALMAGLAPKTKVLRDGRWSEQDAAILVPGDIISIKLGDIVPADARLLEGDPLKIDQSALTGESLPVTKNPGDEVFSGSTCKQGEIEAVVIATGVHTFFGKAAHLVDSTNQVGHFQQVLTAIGNFCICSIAVGILVEIIVMYPIQHRKYRDGIDNLLVLLIGGIPIAMPTVLSVTMAIGSHRLSEQGAITKRMTAIEEMAGMDVLCSDKTGTLTLNKLSVDKNLIEVFVKGVDKDHVLLLAARASRTENQDAIDAAMVGMLADPKEARAGIREVHFLPFNPVDKRTALTYIDADGKWHRVSKGAPEQILNLCNCKEDVRKRVHSVIDKFAERGLRSLAVARQEVPEKTKESPGSPWQFVGLLPLFDPPRHDSAETIRRALNLGVNVKMITGDQLAIAKETGRRLGMGTNMYPSSSLLGQHKDESIAGLPVDELIEKADGFAGVFPEHKYEIVKKLQERRHICGMTGDGVNDAPALKKADIGIAVADATDAARSASDIVLTEPGLSVIISAVLTSRAIFQRMKNYTIYAVSITIRIVLGFMLIALIWKFDFSPFMVLIIAILNDGTIMTISKDRVKPSPQPDSWKLKEIFATGIVLGTYLALMTVIFFWAMHKTDFFSDEFKVRSLREKEEQQMSALYLQVSIVSQALIFVTRSRSWCFVERPGLLLVTAFVIAQLVATLIAVYANWGFARIKGIGWGWAGVIWLYSIVFFFPLDLFKFAIRYILSGKAWDNVLEKKTAFTSKKDYGIEEREAQWATAQRTLHGLQPPETTNLFNDKNSYRELSEIAEQAKRRAEVARLRELHTLKGHVESVVKLKGLDIDTIQQHYTV

SEQ ID NO: 5387 - protein, 951 aa, Allium cepa
MGAISLEEIKNENVDLERIPIEEVFEQLKCTREGLSSDEGASRLTIFGPNKLEEKKESKILKFLGFMWNPLSWVMEMAAIMAIALANGGGKPPDWQDFVGIVVLLVINSTISFIEENNAGNAAAALMAGLAPKTKVLRDGRWSEEDAAILVPGDIISIKLGDIVPADARLLEGDPLKIDQSALTGESLPVTRNPGDEVFSGSTCKQGEIEAVVIATGVHTFFGKAAHLVDSTNQVGHFQKVLTAIGNFCICSIAIGMVIEIIVMYPIQKRQYRSGIDNLLVLLIGGIPIAMPTVLSVTMAIGSHRLSEQGAITKRMTAIEEMAGMDVLCSDKTGTLTLNKLSVDKNLIEVFAKGVDKDYVMLLAARASRTENQDAIDTCMVGMLADPKEARAGIREVHFLPFNPVDKRTALTYIDSEGNWHRVSKGAPEQIVELCKCKEDVKNKVHSIMEKYAERGLRSLAVARQEVPEKSKDSPGGPWQFVGLLPLFDPPRHDSAETIRRALNLGVNVKMITGDQLAIAKETGRRLGMGTNMYPSSSLLGQNKDASIASLPVDELIEKADGFAGVFPEHKYEIVKKLQERKHICGMTGDGVNDAPALKKADIGIAVDDATDAARSASDIVLTEPGLSVIISAVLTSRAIFQRMKNYTIYAVSITIRIVLGFLLIALIWKFDFSPFMVLIIAILNDGTIMTISKDRVKPSPLPDSWKLKEIFATGVVFGTYLAVMSVIFFWAMKDTDFFSDKFGVRSIRHSEDEMMSALYLQVSIVSQALIFVTRSRGWFFVERPGLLLVSAFFIAQLVATVIAVYADWGFARIKGIGWGWAGVIWLYSVVFFFPLDWFKFAIRYVLSGKAWDNLLENRTAFTSKKDYGKEEREAQWAMAQRTLHGLQPPETTNLFADKNSYRELSEIAEQAKKRAEVARLRELHTLKGHVESVVKLKGLDIDTIQQHYTV

SEQ ID NO: 5388 - protein, 618 aa, Arnica chamissonis
MWNPLSWVMEAAAIMAIALANGGGKPPDWQDFVGIVCLLVINSTISFIEENNAGNAAAALMAGLAPKTKVLRDGRWSEQEASILVPGDIISIKLGDIVPADARLLEGDPLKIDQSALTGESLPVTKNPYDEVFSGSTCKQGEIEAVVIATGVHTFFGKAAHLVDSTNQVGHFQKVLTAIGNFCICSIAVGMVVEIIVMYPIQHREYRKGIDNLLVLLIGGIPIAMPTVLSVTMAIGSHRLSQQGAITKRMTAIEEMAGMDVLCSDKTGTLTLNKLSVDKNLIEVFAKGLDKEQVLLYAARASRTENQDAIDAAIVGTLADPKEARAGIREVHFFPFNPVDKRTALTYIDGSGNWFRASKGAPEQILTLCGCKEDLKKKVHAMIDKFAERGLRSLGVARQEVPQKSKDSAGGPWEFVGLLSLFDPPRHDSAETIRRALNLGVNVKMITGDQLAIAKETGRRLGMGTNMYPSSSLLGGHKDESIASLPIDELIEKADGFAGVFPEHKYEIVKKLQERKHICGMTGDGVNDAPALKKADIGIAVADATDAARSASDIVLTEPGLSVIISAVLTSRAIFQRIEKLHNLCRFYHHPYCVWIYVHRFDLEVRLLSLHGSYYCNS

SEQ ID NO: 5389 - protein, 951 aa, Gossypium hirsutum
MGAISLEEIKNETVDLEKIPIEEVFEQLKCSREGLSSEEGANRLQIFGPNKLEEKKESKILKFLGFMWNPLSWVMEAAAIMAIALANGDGKPPDWQDFVGIVCLLVINSTISFIEENNAGNAAAALMAGLAPKTKVLRDGKWSEQEAAILVPGDIISIKLGDIIPADARLLEGDPLKIDQSALTGESLPVTKNPGDEVFSGSTCKQGEIEAVVIATGVHTFFGKAAHLVDSTNNVGHFQKVLTAIGNFCICSIAIGMLVEIIVMYPIQHRKYRDGIDNLLVLLIGGIPIAMPTVLSVTMAIGSHRLSQQGAITKRMTAIEEMAGMDVLCSDKTGTLTLNKLSVDRNLIEVFVKDVDKEHVVLLAARASRTENQDAIDAAIVGMLADPKEARAGIREVHFLPFNPVDKRTALTYIDSNGNWHRASKGAPEQILTLCNAKEDVKKKVHAIIDKFADRGLRSLGVARQQVPEKSKDGAGTPWQFVGLLPLFDPPRHDSAETIRRALNLGVNVKMITGDQLAIAKETGRRLGMGTNMYPSASLLGQDKDASIAALPVEELIEKADGFAGVFPEHKYEIVRKLQERKHICGMTGDGVNDAPALKKADIGIAVADATDAARSASDIVLTEPGLSVIISAVLTSRAIFQRMKNYTIYAVSITIRIVFGFMLIALIWKFDFSPFMVLIIAILNDGTIMTISKDRVKPSPLPDSWKLKEIFATGIVLGGYLALMTVVFFWIMHDTDFFSEKFGVRSLRKKDDQMMGALYLQVSIVSQALIFVTRSRSWSYFERPGLLLVTAFIIAQLAATVIAVYANWGFARIQGIGWGWAGVIWLYSVVFYIPLDLMKFAIRYILSGKAWLNLLENKTAFTTKKDYGKEEREAQWALAQRTLHGLQPPEASNLFNDKSSYRELSEIAEQAKRRAEVARLRELHTLKGHVESVVKLKGLDIDTIQQHYTV

SEQ ID NO: 5390 - protein, 951 aa, Gossypium raimondii
MGAISLEEIKNETVDLEKIPIEEVFEQLKCSREGLSSEEGANRLQIFGPNKLEEKKESKILKFLGFMWNPLSWVMEAAAIMAIALANGDGKPPDWQDFVGIVCLLVINSTISFIEENNAGNAAAALMAGLAPKTKVLRDGKWSEQEAAILVPGDIISIKLGDIIPADARLLEGDPLKIDQSALTGESLPVTKNPGDEVFSGSTCKQGEIEAVVIATGVHTFFGKAAHLVDSTNNVGHFQKVLTAIGNFCICSIAIGMLVEIIVMYPIQHRKYRDGIDNLLVLLIGGIPIAMPTVLSVTMAIGSHRLSQQGAITKRMTAIEEMAGMDVLCSDKTGTLTLNKLSVDRNLIEVFVKDVDKEHVVLLAARASRTENQDAIDAAIVGMLADPKEARAGIREVHFLPFNPVDKRTALTYIDSNGNWHRASKGAPEQILTLCNAKEDVKKKVHAIIDKFADRGLRSLGVARQLVPEKSKDGAGTPWQFVGLLPLFDPPRHDSAETIRRALNLGVNVKMITGDQLAIAKETGRRLGMGTNMYPSASLLGQDKDASIAALPVEELIEKADGFAGVFPEHKYEIVRKLQERKHICGMTGDGVNDAPALKKADIGIAVADATDAARSASDIVLTEPGLSVIISAVLTSRAIFQRMKNYTIYAVSITIRIVFGFMLIALIWKFDFSPFMVLIIAILNDGTIMTISKDRVKPSPLPDSWKLKEIFATGIVLGGYLALMTVVFFWIMHDTDFFSEKFGVRSLRKRDDQMMGALYLQVSIVSQALIFVTRSRSWSYFERPGLLLVTAFIIAQLVATVIAVYANWGFARIQGIGWGWAGVIWLYSVVFYIPLDLMKFAIRYILSGKAWLNLLENKTAFTTKKDYGKEEREAQWALAQRTLHGLQPPEASNLFNDKSSYRELSEIAEQAKRRAEVARLRELHTLKGHVESVVKLKGLDIDTIQQHYTV

SEQ ID NO: 5391 - protein, 947 aa, Lupinus angustifolius
MTSDISFEELKNENVDLENIPIEEVFKQLKCSREGLTTAEGENRLQVFGPNKLEEKTESKFLKFLGFMWNPLSWVMEAAAIMAIALANGGGKPPDWQDFVGIVVLLIINSTISFIEENNAGNAAAALMAGLAPKTKVLRDGKWSEEEAALLVPGDLISIKLGDIVPADARLLEGDPLKIDQSALTGESLPVTRHPGDEVFSGSTCKQGEIEAIVIATGVHTFFGKAAHLVDSTNNVGHFQKVLTSIGNFCICSIAVGMLIEIVVMYPIQQRAYRDGIDNLLVLLIGGIPIAMPTVLSVTMAIGSHRLSEQGAITKRMTAIEEMAGMDVLCSDKTGTLTLNKLTVDKNMIEVFPTGMDKDTLVLHAARASRIENQDAIDASIVGMLGDPKEARAGITEVHFLPFNPVEKRTAITFIDGQGKWHRSSKGAPEQIIELCDLKGEVLKRAHGIIDQFAERGLRSLGVAHQTVSEKTKESAGDSWEFLGLLPLFDPPRHDSAETIRRALDLGVNVKMITGDQLAIGKETGRRLGMGTNMYPSSTLLGDNKDPSLATIPIDELIEKADGFAGVFPEHKYEIVKRLQDRKHIVGMTGDGVNDAPALKKADIGIAVDDATDAARSASDIVLTEPGLSVIVSAVLTSRAIFQRMKNYTIYAVSITIRIVFGFMLVALIWKFDFSPFMVLIIAILNDGTIMTISKDRVKPSPLPDSWKLKEIFATGVVLGSYMAIITVVFFYLVHDTDFFTRVFGVKPIADSEEMLNSALYLQVSIISQALIFVTRSRSWSYVERPGFLLMAAFLAAQLVATVIAVYAHWDFARIHGFGWRWAGVIWIFSIVTYIPLDILKFLIRLGLSGKAWDNMLQNKTAFTTKKDYGKGQREAQWAVAQRTLHGLHVPESHKNINYEQSDIAEQAKRRAEAARLRELHTLKGHVESVVKLKGLDIDTIQQHYTL

SEQ ID NO: 5392 - protein, 947 aa, Lupinus angustifolius
MASDISFEDLKNENVDLENIPIEEVFQHLKCSKEGLSSEEGEKRLLVFGPNKLEEITESKFLKFLGFMWNPLSWVMEAAAIMAIVLANGGGKPPDWQDFTGIVVLLIINSTISFIEENNAGNAAAALMAGLAPKTKVLRDGKWGEEDAAILVPGDLISIKLGDIVPADARLLEGDPLKIDQSALTGESLPVTRNPGDQVFSGSTCKQGEIEAIVIATGVHTFFGKAAHLVDSTNNVGHFQKVLTSIGNFCICSIAIGMLVEIIVMYPIQQRSYRDGIDNLLVLLIGGIPIAMPTVLSVTMAIGSHRLSQQGAITKRMTAIEEMAGMDVLCSDKTGTLTLNKLTVDKSLIEVFTSGVDKDSLVLYAARASRTENQDAIDASIVGMLGDPKEARAGITEVHFLPFNPVDKRTAITFIDSNGNWHRSSKGAPEQIIELCGLKGEVLKKAHKTIDSYAERGLRSLGVSRQTVSEKTKESAGDSWEFLGLLPLFDPPRHDSAETIRRALDLGVNVKMITGDQLAIGKETGRRLGMGTNMYPSSSLLGNSKDPAIASIPVDELIEKADGFAGVFPEHKYEIVKRLQDKKHIVGMTGDGVNDAPALKKADIGIAVDDATDAARSASDIVLTEPGLSVIVSAVLTSRAIFQRMKNYTIYAVSITIRIVLGFLLVALIWKFDFSPFMVLIIAILNDGTIMTISKDRVKPSPLPDSWKLNEIFATGVVLGTYMAIMTAVFFYAVHDTDFFSRIFGVKSIADSEENLNSALYLQVSIISQALIFVTRSRSWSYFERPGAMLCIAFLAAQLVATVIAVYAHWDFARINGVGWRWAGVIWIYSIVTYIPLDILKFFIRMGLSGSAWNSMLQNKTAFTTKKDYGRGDREAQWAVAQRTLHGLQVSDAHLNNQHEHSEIAEQAKKRAEAARLRELHTLKGHVESVVKLKGLDIETMQQHYTV

SEQ ID NO: 5393 - protein, 951 aa, Medicago truncatula
MGGISLEEIKNESVDLERIPIDEVFEQLKCSRQGLTSEEGANRLQVFGPNKLEEKKESKFLKFLGFMWNPLSWVMEAAAIMAIALANGSGRPPDWQDFVGIIALLVINSTISFIEENNAGNAAAALMAGLAPKTKVLRDSRWSEQDAAILVPGDIISIKLGDIVPADARLLEGDPLSIDQSALTGESLPVTKSSSDEVFSGSTVKKGEIEAVVIATGVHTFFGKAAHLVDSTNQVGHFQKVLTAIGNFCICSIAIGILVELIVMYPIQHRKYRDGIDNLLVLLIGGIPIAMPTVLSVTMAIGSHRLSQQGAITKRMTAIEEMAGMDVLCSDKTGTLTLNKLSVDRNLIEVFAKGIEKEYVMLLAARASRTENQDAIDAAIVGMLADPKEARAGIREVHFLPFNPVDKRTALTYIDSDGKWHRASKGAPEQIINLCNCKEDVRKKVHAVIDKFAERGLRSLGVARQEVPERTKDSPGGPWQFVGLLPLFDPPRHDSAETIRRALNLGVNVKMITGDQLAIGKETGRRLGMGTNMYPSSALLGQDKDSSISALPVDELIEKADGFAGVFPEHKYEIVKRLQEKKHICGMTGDGVNDAPALKKADIGIAVADATDAARSASDIVLTEPGLSVIISAVLTSRAIFQRMKNYTIYAVSITIRIVFGFMFIALIWKFDFAPFMVLIIAILNDGTIMTISKDRVKPSPLPDSWKLREIFATGVVLGSYMALMTVVFFWAMKDTNFFSNKFGVRPIRHNPDEMMAALYLQVSIISQALIFVTRSRSWSFAERPGLLLLGAFLIAQLIATFIAVYANWGFARIKGMGWGWAGVIWLYSLVTYIPLDLLKFAIRYFLSGKAWDNLLENKTAFTTKKDYGKEEREAQWAAAQRTLHGLQPPEASNVFNEKNSYRELSEIAEQAKRRAEVARLREVHTLKGHVESVVKLKGLDIDTIQQHYTV

SEQ ID NO: 5394 - protein, 949 aa, Populus trichocarpa
MGDVSLEQIKNENIDLERIPVEEVFQQLRCTKEGLSTAQGEERLKIFGPNKLEEKRESKFLKFLGFMWNPLSWVMEAAAIMAIALANGGGKPPDWQDFVGIVVLLIINSTISFIEENNAGNAAAALMAGLAPKTKVLRDGKWMEEDASILVPGDMISIKLGDIVPADARLMKGDPLKIDQSALTGESLPVTKHPGEGVFSGSTCKQGEIEAVVIATGVHTFFGKAAHLVDSTNNVGHFQKVLTAIGNFCICSIAIGMLVEIIVMYPIQNRRYREGIDNLLVLLIGGIPIAMPTVLSVTMAIGSHRLSQQGAITKRMTAIEEMAGMDVLCSDKTGTLTLNKLTVDKSLIEVFIKDMDKDTLLLLAARASRIENQDAIDASIVGMLGDPKEARAEITEVHFLPFNPVEKRTAITYYDNNGDWHRSSKGAPEQIIELCNVKGETKKKAHEIIDNFAERGLRSLGVARQRIPEKTKESEGAPWEFVGLLPLFDPPRHDSAETIRRALDLGVNVKMITGDQLAIGKETGRRLGMGTNMYPSSSLLGNSKDESISGIPVDELIEKADGFAGVFPEHKYEIVKKLQERKHICGMTGDGVNDAPALKKADIGIAVADATDAARSASDIVLTEPGLSVIISAVLTSRAIFQRMKNYTIYAVSITIRIVLGFLLVALIWKFDFSPFMVLIIAILNDGTIMTISKDRVKPSPVPDSWKLKEIFATGVVLGTYMAIMTVLFFWLAHDTDFFPEKFGVRTIRGKPDELTAALYLQVSIISQALIFVTRSRSWSFVECPGLLLVSAFIAAQLVATLIAVYASWSFARIEGIGWGWAGIIWLFSIITYIPLDIIKFIIRYALTGKAWDNMLQNKTAFTNKKDYGKGEREAQWATAQRTLHGLQPPETMFNDKTTYRELSELAEQAKKRAEVARLRELHTLKGHVDSVVKMKGLDIETIQQHYTV

SEQ ID NO: 5395 - protein, 955 aa, Fragaria vesca
MSGGTKAISLEEIKNESVDLERIPIEEVFEQLKCTREGLTSDEGQNRLQVFGPNKLEEKKESKLLKFLGFMWNPLSWVMEAAALMAIVLANGDGKPPDWQDFLGITVLLIVNSTISFIEENNAGNAAAALMAGLAPKTKVLRDGRWTEQDASILVPGDIISIKLGDIVPADARLLEGDPLKIDQSALTGESLAVTKNPGDEVFSGSTCKQGEIEAVVIATGVHTFFGKAAHLVDSTNNVGHFQKVLTAIGNFCICSIAVGIAIEIVVMYPIQHRKYRDGIDNLLVLLIGGIPIAMPTVLSVTMAIGSHRLSQQGAITKRMTAIEEMAGMDVLCSDKTGTLTLNKLTVDRNLIEVFPKGVEKEHVILLAARASRTENQDAIDAAIVNMLADPKEARAGVREIHFLPFNPVDKRTALTYIDSDGNWHRASKGAPEQILELCNCKEDFKRKVHAVIDKFAERGLRSLGVARQQIPEKTKESPGAPWQFVGLLPLFDPPRHDSAETIRRALNLGVNVKMITGDQLAIGKETGRRLGMGTNMYPSSALLGQDKDAAISSLPIDELIEKADGFAGVFPEHKYEIVRRLQERKHICGMTGDGVNDAPALKKADIGIAVADATDAARGASDIVLTEPGLSVIISAVLTSRAIFQRMKNYTIYAVSITIRIVFGFMFIALIWKFDFSPFMVLIIAILNDGTIMTISKDRVKPSPVPDSWKLKEIFATGIVLGGYMALMTVVFFWLMQDTDFFSEKFQVRSLRNNPSEMMAALYLQVSIISQALIFVTRSRSFSFLERPGLLLLGAFIVAQLVATLIAVYANWEFARIHGCGWGWAGVVWLFSVVTYFPLDLLKFAIRYILSGKAWDNLLENKTAFTTKKDYGKEEREAQWATAQRTLHGLQPPESSNIFSDKSSYRELSEIAEQAKRRAEVARLRELNTLKGHVESVVKLKGLDIDNIQQHYTV

SEQ ID NO: 5396 - protein, 355 aa, Sorghum bicolor
MRGKKPLKDLKLSVPAQETPVDKFLTASGTFKDGELRLNQSGLRLISEENGGEDESTKLKVEDVQLSMDDLEMIQVIGKGSGGVVQLVRHKWVGTLYALKGIQMNIQESVRKQIVQELKINQATQSPHIVMCHQSFYHNGVIYLVLEYMDRGSLADIVKQVKTVLEPYLAVLCKQVLEGLLYLHHERHVIHRDIKPSNLLVNRKGEVKITDFGVSAVLASSIGQRDTFVGTYNYMAPERISGSSYDYKSDIWSLGLVILECAIGRFPYIPSEGEGWLSFYELLEAIVDQPPPSAPADQFSPEFCSFISSCIQKDPAQRMSASELLNHPFLKKFEDKDLDLRILVEDLEPPMNIPE

SEQ ID NO: 5397 - protein, 355 aa, Echinochloa colona
MRGKKPLKELKLSVPAQETPVDKFLTASGTFKDGELRLNQSGLRLISEENGDEDESTKLKVEDVQLSMDDLEMIQVIGKGSGGVVQLVRHKWVGTLYALKGIQMNIQESVRKQIVQELKINQATQSPHIVLCHQSFYHNGVIYLVLEYMDRGSLADIIKQVKTILEPYLAVLCKQVLEGLLYLHHERHVIHRDIKPSNLLVNRKGEVKITDFGVSAVLASSMGQRDTFVGTYNYMAPERISGSSYDYKSDIWSLGLVILECAIGRFPYIPSEGEGWLSFYELLEAIVDQPPPSAPADQFSPEFCSFISSCIQKDPAQRMSASELLDHPFLKKFEDKDLDLRILVESLEPPMNIPE

SEQ ID NO: 5398 - protein, 355 aa, Setaria italica
MKGKKPLKELKLSVPAQEIPVDKFLTASGTFKDGELRLNQSGLRLTSEENGDEDESTKLKVEDVQLSMDDLEMIQVIGKGSGGVVQLVRHKWVGTLYALKGIQMNIQESVRKQIVQELKINQATQSPHIVLCHQSFYHNGVIYLVLEYMDRGSLADIIKQVKTVLEPYLAVLCKQVLEGLLYLHHERHVIHRDIKPSNLLVNRKGEVKITDFGVSAVLASSVGQRDTFVGTYNYMAPERISGSSYDYKSDIWSLGLVILECAIGRFPYIPSEGEGWSSFYELLEAIVDQPPPSAPADQFSPEFCSFISSCIQKDPAQRMSAAELLNHPFLKKFEDKDLDLRILVESLEPPMNIPE

SEQ ID NO: 5399 - protein, 355 aa, Panicum virgatum
MRGKKPLKDLKLSVPVQESPVDKFLTASGTFKDGELRLNQSGLRLISEENGDEDESTKLKVEDVQLSMDDLEMIQVIGKGSGGVVQLVRHKWVGTLYALKGIQMNIQESVRKQIVQELKINQATQSPHIVLCHQSFYHNGVIYLVLEYMDRGSLADIIKQVKTVLEPYLAVLCKQVLEGLLYLHHERHVIHRDIKPSNLLVNRKGEVKITDFGVSAVLASSMGQRDTFVGTYNYMAPERISGSSYDYKSDIWSLGLVILECAIGRFPYIPSEGEGWLSFYELLEAIVDQPPPSAPADQFSPEFCSFISSCIQKDPAQRMSASELLNHPFLKKFEDKDLDLRGLVETLEPPMNIPE

SEQ ID NO: 5400 - protein, 355 aa, Setaria italica
MRGKKPVMELKLAVPAQETPVDKFLTASGTFKDGELRLNQRGLRLISEENGDENQSTNLKVEDVQLSMDDLEMIQVIGKGSGGVVQLVRHKWVGTLYALKGIQMNIQESVRKQIVQELKINQATQSPHIVMCHQSFYHNGVIYLVLEYMDRGSLADIIKQVKTVLEPYLAVLCKQVLEGLLYLHHERHVIHRDIKPSNLLVNRKGEVKITDFGVSAVLASSMGQRDTFVGTYNYMAPERISGSSYDYKSDIWSLGLVILECAIGRFPYIPSEGEGWISFYELLEAIVDQPPPSAPADQFSPEFCSFISSCIQKDPAERMSASELLNHPFIKKFEGKDLDLRTLVESLEPPMNIPE

SEQ ID NO: 5401 - protein, 355 aa, Panicum virgatum
MRGKKPVKELKLAVPAQETPVDKFLTASGTFKDGELRLNQRGLRLISEENGDENQSTNLKVEDVQLSMDDLEMIQVIGKGSGGVVQLVRHKWVGTLYALKGIQMNIQESMRKQIVQELKINQATQSPHIVLCHQSFYHNGVIYLVLEYMDRGSLADIIKQVKTILEPYLAVLCKQVLEGLLYLHHERHVIHRDIKPSNLLVNRKGEVKITDFGVSAVLASSMGQRDTFVGTYNYMAPERISGSSYDYKSDIWSLGLVILECAIGRFPYIPSEGDGWLSFYELLEAIVDQPPPSAPADQFSPEFCSFISSCIQKDPAERMSASELLNHPFIQKFEGKDLDLRTLVESLEPPMNIPE

SEQ ID NO: 5402 - protein, 355 aa, Oryza sativa
MRGKKPHKELKLSVPAQETPVDKFLTASGTFKDGELRLNQRGLQLISEETADEPQSTNLKVEDVQLSMDDLEMIQVIGKGSGGIVQLVRHKWVGTLYALKGIQMNIQEAVRKQIVQELKINQATQNPHIVLCHQSFYHNGVIYLVLEYMDRGSLADIIKQVKTILEPYLAVLCKQVLEGLLYLHHERHVIHRDIKPSNLLVNRKGEVKITDFGVSAVLASSMGQRDTFVGTYNYMAPERISGSSYDYKSDIWSLGLVILECAIGRFPYIPSEGEGWLSFYELLEAIVDQPPPSAPADQFSPEFCAFISSCIQKDPAERMSASELLNHPFIKKFEDKDLDLRILVESLEPPMNISE

SEQ ID NO: 5403 - protein, 355 aa, Pseudoroegneria spicata
MRGKKPLKELTLSVPAQETPVDKFLTASGTFKDGELRLNQRGLQLISEENGDEHQSTKMKVEDVQLSMDDLEMIQVIGKGSGGVVQLVRHKWVGTFYALKGIQMNIQESVRKQIVQELKINQATQSPHIVLCHQSFYHNGVIYLVLEYMDRGSLADIIKQVKTILEPYLAVLCKQVLEGLLYLHHERHVIHRDIKPSNLLVNHKGEVKITDFGVSAVLASSIGQRDTFVGTYNYMAPERISGSSYDYKSDVWSLGLVILECAIGRFPYTPPEGEGWLSFYELLEAIVDQPPPSAPADQFSPEFCSFISSCIQKDPAERMSASELLNHAFIKKFEDKDLDLRILVESLEQPMNVPE

SEQ ID NO: 5404 - protein, 355 aa, Avena sativa
MRGKKTLKDLKLDVPAQETPVDKFLTASGTFKDGELRLNQRGLQLISEENGDEHQSTNMKVEDVQLSMDDLEMIQVIGKGSGGVVQLVQHKWVGTFYALKGIQMNIQEAVRKQIVQELKINQATQSPHIVSCHQSFYHNGVIYLVLEYMDRGSLADIIKQVKTILEPYLAVLCKQVLEGLLYLHHDRHVIHRDIKPSNLLVNHKGEVKITDFGVSAVLASSIGQRDTFVGTYNYMAPERISGSSYDYKSDVWSLGLVILECAIGRFPYIPPEGEGWLSFYELLEAIVDQPPPSAPADQFSPEFCSFISSCIQKDPAERMSASELLNHPFIKKFEGKDLDLKILVETLEPPMNVPE

SEQ ID NO: 5405 - protein, 353 aa, Avena sativa
MRGKKTLKDLKLDVPAQETPVDKFLTASGTFKDGELRLNQRGLQLISEENGDEHQSTNMKVEDVQLSMDDLEMIQVIGKGSGGVVQLVQHKWVGTFYALKGIQMNIQEAVRKQIVQELKINQATQSPHIVSCHQSFYHNGVIYLVLEYMDRGSLADIIKQVKTILEPYLAVLCKQVLEGLLYLHHDRHVIHRDIKPSNLLVNHKGEVKITDFGVSAVLASSIGQRDTFVGTYNYMAPERISGSSYDYKSDVWSLGLVILECAIGRFPYIPPEGEGWLSFYELLEAIVDQPPPSAPADQFSPEFCSFISSCIQKDPAERMSASELLNHPFIKKFEGKDLDLKILVETLEPPMNV

SEQ ID NO: 5406 - protein, 356 aa, Brachypodium distachyon
MRGKKPLKELKLSVPAQETSVDKFLTASGTFKDGELRLNQRGLRLISEEENGDEHQSTNMKVEDVQLSMDDLEMIQVIGKGSGGVVQLVQHKWVGTFYALKGIQMNIQEAVRKQIVQELKINQATQSPHIVSCHQSFYHNGVIYLVLEYMDRGSLADIIKQVKTILEPYLAVLCKQVLEGLLYLHHERHVIHRDIKPSNLLVNHKGEVKITDFGVSAVLASSIGQRDTFVGTYNYMAPERISGSSYDYKSDVWSLGLVILECAIGRFPYTPSEGEGWLSFYELLEAIVDQPPPGAPADQFSPEFCSFISACIQKDPAERMSASELLNHAFIKKFEGKDLDLRILVESLEPPMNVPE

SEQ ID NO: 5407 - protein, 355 aa, Festuca arundinacea
MRGKKALKDLKLDVPAQETPVDKFLTASGTFKDGELRLNQRGLQLISEENGDENQSTNMKVEDVQLSMDDLEMIQVIGKGSGGVVQLVQHKWVGTFYALKGIQMNIQEAVRKQIVQELKINQATQSPHIVSCHQSFYHNGVIYLVLEYMDRGSLADIIKQVKTILEPYLAVLCKQVLEGLLYLHHERHVIHRDIKPSNLLVNHKGEVKITDFGVSAVLASSIGQRDTFVGTYNYMAPERISGSSYDYKSDVWSLGLVILECAIGRFPYIPPEGDGWLSFYELLEAIVDQPPPSAPADQFSPEFCSFISSCIQKDPAERKSASELLNHPFIKKFEGQDLDLKILVESLEPPMNVPE

SEQ ID NO: 5408 - protein, 354 aa, Festuca arundinacea
MRGKKALKDLKLDVPAQETPVDKFLTASGTFKDGELRLNQRGLQLISEENGDENSTNMKVEDVQLSMDDLEMIQVIGKGSGGVVQLVQHKWVGTFYALKGIQMNIQEAVRKQIVQELKINQATQSPHIVSCHQSFYHNGVIYLVLEYMDRGSLADIIKQVKTILEPYLAVLCKQVLEGLLYLHHERHVIHRDIKPSNLLVNHKGEVKITDFGVSAVLASSIGQRDTFVGTYNYMAPERISGSSYDYKSDVWSLGLVILECAIGRFPYIPPEGDGWLSFYELLEAIVDQPPPSAPADQFSPEFCSFISFCIQKDPAERKSASELLNHPFIKKFEGQDLDLKILVESLEPPMNVPE

SEQ ID NO: 5409 - protein, 330 aa, Avena sativa
TASGTFKDGELRLNQRGLQLISEENGDEHQSTNMKVEDVQLSMDDLEMIQVIGKGSGGVVQLVQHKWVGTFYALKGIQMNIQEAVRKQIVQELKINQATQSPHIVSCHQSFYHNGVIYLVLEYMDRGSLADIIKQVKTILEPYLAVLCKQVLEGLLYLHHDRHVIHRDIKPSNLLVNHKGEVKITDFGVSAVLASSIGQRDTFVGTYNYMAPERISGSSYDYKSDVWSLGLVILECAIGRFPYIPPEGEGWLSFYELLEAIVDQPPPSAPADQFSPEFCSFISSCIQKDPAERMSASELLNHPFIKKFEGKDLDLKILVETLEPPMNVPE

SEQ ID NO: 5410 - protein, 336 aa, Panicum virgatum
MRGKKPLKDLKLSVPAQESPVDKFLTASGTFKDGELRLNQSGLRLISEENGDEDESTKLKVEDVQLSMDDLEMIQVIGKGSGGVVQLVRHKWVGTLYALKGIQMNIQESVRKQIVQELKINQATQSPHIVLCHQSFYHNGVIYLVLEYMDRGSLADIIKQVKTVLEPYLAVLCKQVLEGLLYLHHERHVIHRDIKPSNLLINRKGEVKITDFGVSAVLASSMGQRDTFVGTYNYMAPERISGSSYDYKSDIWSLGLVILECAIGRFPYIPSEGEGWLSFYELLEAIVDQPPPSAPADQFSPEFCSFISSWYAKHSFLKLDVKINLVSTFMLVSRNI

SEQ ID NO: 5411 - protein, 334 aa, Hordeum vulgare
MRGKKPLKELTLSVPAQETPVDKFLTASGTFKDGELRLNQRGLQLISEENGDEHQSTKMKVEDVQLSMDDLEMIQVIGKGSGGVVQLVRHKWVGTFYALKGIQMNIQESVRKQIVQELKINQATQSPHIVLCHQSFYHNGVIYLVLEYMDRGSLADIIKQVKTILEPYLAVLCKQVLEGLLYLHHERHVIHRDIKPSNLLVNHKGEVKITDFGVSAVLASSIGQRDTFVGTYNYMAPERISGSSYDYKSDVWSLGLVILECAIGRFPYTPPEGEGWLSFYELLEAIVDQPPPSAPADQFSPEFCSFISSWYVKHYSEELHMKLAQSLHFCFFFL

SEQ ID NO: 5412 - protein, 562 aa, Ananas comosus
LWGCSAATPAASPPRSPFLTLSAFAPSPPARAFHVSARYSHSLRPFAGFFVNLRGFRKVRRRQAAAKKQPTKEKQLELDVQIAIEEELPDDPEVLGIAEMLKLNVPMAMKIAFDGLKDSEYKTRDTSISDVGKYEKVELSVLLCNDNFIQNLNKDWRGEDHATDVLSMSQHIPDLDLPILMLGDIVISVETATRQAEERGHTLLDEVRILMVHGLLHLLGFDHEINDEAEAEMEKEEELVLKSLGWKGKGLIKSAHDAANDSKLHAESSDGQARDDLKKAGSLRFYKPKFSHIFCDMDGTLLNSKSQITTTTAEALREAISRGVNIVIATGKARPAVISALKMVGLAGKNGVVSEFSPGIFLQGLLVYGRRGREICRRNLDKGVCRKAFSYSVEHEIPLVAFCQDRCFTLFDHPLIDSLHTVYHEPKAEVLSSVEQLLASNDIQKLLFVDTPEGITSTLRPHWEEATDGLAGVVQAVPDMLEIVPAGTSKGSGVKMLLDHLGISPKEVMAIGDGENDVEMLQVASLGVALANGSEKTKAVANVIGATNDEDGAAKAIYEYAF

SEQ ID NO: 5413 - protein, 354 aa, Ananas comosus
MKGTKPLKQLKLAVPAQETPVDKFLTASGTFQDGDLRLNQRGLRLISEEKETRTPDAEEVDMQFALEDLETIKVIGKGSGGVVQLVRHKWMGTLYALKGIQMNIQETVRKQIVQELKINQASLCPHIVVCYHSFYHNGVISLVLEYMDRGSLADIIKQVKTILEPYLAVLCKQVLEGLVYLHHERHVIHRDIKPSNLLVNHKGEVKITDFGVSAVLASSMGQRDTFVGTYNYMSPERISGSSYDYKSDIWSLGLVILECAIGRFPYIPSEEEEGWLSFYELLEAIVDQPAPCAPPDQFSPEFCSFVSACIQKDPQQRLSCLELLNHPFIKKFEDKDIDLGILVSSLDPPVNVVD

SEQ ID NO: 5414 - protein, 356 aa, Elaeis guineensis
MKGPKPLKQLQVAVPAQETPVDKFLTASGTFTDGDLRLNQKGMRLISEATESRQPDVKEEDMQFSLEDLETIKVIGKGSGGVVQLARHKWLGTLYALKGIQMNIQEAVRKQIVQELKINQASQCPHVVVCYHSFYHNGIIYLVLEYMDRGSLADIIKQVKTILEPYLAIVCKQVLKGLVYLHHERHVIHRDIKPSNLLVNHSGEIKITDFGVSAVLANSMGQRDTFVGTYNYMSPERISGSSYDYKSDIWSLGLVILECAIGRFPYIPSEQEEGCLSFYELLEAIVDQPPPSAPSDQFSPEFCSFISACLQKDPQERMSSLELLSHPFIKKFEDKDIGLAILVSSLDPPVNIPGDV

SEQ ID NO: 5415 - protein, 335 aa, Setaria italica
MGPNMSAFSSKQQASAKRRAYVTFLAGDGDYWKGVVGLAKGLRKARSAYPLVVAVLPDVPEEHRRKLREQGCVVREIQPVYPPESQTQFAMAYYVINYSKLRIWEFVEYERMVYLDADIQVYENIDHLFDLEKGRFYAVMDCFCEKTWSHTPQYKIGYCQQCPDKVTWPEHELGPPPPRYFNAGMFVHEPSLGTAKDLLDALVVTPPTPFAEQDFLNMFFRDVYEPIPPVYNLVLAMLWRHPENVKPLDKVKVVHYCAAGSKPWRYTGEEANMDREDIKMLVSKWWDIFNDESLDYKGPAVDDDGAEVVDQAREPLRQALAEAGAAKFFPAPSAA

SEQ ID NO: 5416 - protein, 317 aa, Panicum virgatum
MSSAYSSKQQAAAKRAYVTFLAGDGDYWKGVVGLAKGLRRVRSAYPLVVAVLPDVPEEHRRKLRDQGCVVREIQPVYPPDSQTQFAMAYYVINYSKLRIWEFVEYERMVYLDADIQVFDNIDELFELDKGRFYAVMDCFCEKTWSHTPQYKIGYCQQCPEPVAWPAAELGPPPPLYFNAGMFVHEPSLGTARDLLDALVATPPTPFAEQDFLNVFFRDVYTPIPPAYNLVLAMLWRHPDKMPELGKVKVVHYCAAGSKPWRYTGQEPNMERDDIKMLVTKWWDVFNDDTLDYKGDEPLLQALAEAGAANYFPAPSAA

SEQ ID NO: 5417 - protein, 327 aa, Panicum virgatum
MMSSKQQQQQQQQAAPNNKRRAYVTFLAGDGDYWKGVVGLAKGLRRVRSAYPLVVAVLPDVPEEHRRKLRGQGCVVREIQPVYPPESQTQFAMAYYVINYSKLRIWELVEYERMVYLDADIQVLDNIDHLLDLDKGRFYAVMDCFCEKTWSHTPQYKIGYCQQCPERVPWPEQQLGPPPPPYFNAGMFVHEPSLGTAKELLDALVATPPTPFAEQDFLNMFFRDVYTPIPPVYNLVLAMLWRHPDKVEPLAEVKVVHYCAAGSKPWRFTGQEPNMERQDIKMLVARWWDVFNDDSLDYKGDDADQPLLRQALAEAGAANYFPAPSAA

SEQ ID NO: 5418 - protein, 616 aa, Sorghum bicolor
MATPPPPLRRAAALLLVVLAGVLASTARADLVISKADRRVDLTSHIVRILASLKVENVGPDPVSQVLLSFPNIQAKNLAAIRAFGSEGKVKGQSTILPIEVVQPSGAPPDLTFFSALLPKPLEKGKTLYLDVLTVFTHSLQPFPEEITQAEAQLVVYQDSAHYLSPYPVKAQTLAIRLPGGRVESYTRHPNAKLVDSELKYGPFHDLPPFSYLPVIVHFENNNPFAVAKEVIREIEISHWGNVQITEHYNIAHGGARLKGEFSRIDYQSRPYVRGVSSFRHLIAKLPPRAHSIYYRDEIGNISTSHVWSDSMKTQLEIEPRFPLFGGWQTTFTVGYGLPLEDFVFYSDGKRFLNITFGSPLEEVLIEKLVVKVVLPEGSKDIEVSAPFPTQQRQEVKYSHLDIVGRPVVVLEKPDVIPEHNLYFQVYYKFSNISLLTEPLMLITGFFLLFVACIVYMRTDMSISKSSPSYLAKLQWDEVQATVQKIQGIFEQCLAVHDKLEASLRDLSRTGDIQSCKAARKAADAQFKELSKDLKPLLMTLQSSPQSYQIWPKVEDLIAKEREMQEKLMTRHSTVVDSFEKKLRGQDVENRIALQQQKVAALRQEVESLLEYISEI

SEQ ID NO: 5419 - protein, 616 aa, Saccharum officinarum
MATPPPHLRRIAALLLVVLAGLLASTARADLVISKADRRVDLTSHIVRVLASLKVENVGPDPVSQVLLAFPNIQAKNLAAIRAFGSEGKVKGQSTVLPIEVVQPSGAPPELTFFSALLPKPLEKGKTLYLDVLTVFTHSLQPFPEEITQAEAQLVVYQDSAHYLSPYPVKAQTLAIRLPGGRVESYTRHPNAKLVDSELKYGPFHDLPPFSYLPVIVHFENNNPFAVAKEVIREIEISHWGNVQITEHYNIAHGGARLKGEFSRIDYQSRPYVRGVSSFRHLIAKLPPRAHSIYYRDEIGNISTSHLWSDSMKTQLEIEPRFPLFGGWQTTFTVGYGLPLKDFVFYSDGKRFLNITFGSPLEEILIEKLIVKVVLPEGSKDIEVSAPFPTQQRQEVKYSHLDIVGRPVVVLEKPDVIPEHNLYFQVYYKFNNISLLREPLMLISGFFLLFVACIGYMRTDMSISKSSPSYLAKLQWDEVQATVQKIQGIFEQCLAVHDKLEASLRDLSRTGDIQSCKAARKAADAQFKELSKDLKPLLTTLQSSSQSYQIWPKVEDLIAKEREMQEKLMTRHSTVVDSFERKLRGQDIENRIALQQQKIAALRQEVESLLEYISEI

SEQ ID NO: 5420 - protein, 616 aa, Echinochloa colona
MAPTPPPLRRATALLLAVLVGVLASTARADLVISKADRRVDLTSHIVRVLASLKVENVGPDPVSQVLLSFPNIQAKNLAAIRAFGTEGKVKGPSTVLPIEVVQPSGAPPELTFFSALLPKPLEKGKTLHLDVLTVFTHSLQPFPEEITQAEAQLVVYQDSAHYLSPYPVKVQTLAIRLPGGRVESYTRHPSAKLVDSELKYGSFEDLPPFSYLPVIVHFENNNPFAVAKEVIREIEISHWGNVQITEHYNIAHGGARLKGEFSRIDYQSRPYVRGVSSFRNLIARLPPRAHSIYYRDEIGNISTSHLWSDSKKTQLEIEPRFPLFGGWQTTFTVGYGLPLQDFVFYSDGKRFLNITFGSPLEEILIEKLIVKVVLPEGSKDIEVSAPFPTKQWQEVKYSHLDIVGRPVVVLEKPDVIPEHNLHFQVYYKFNNISLLREPLMLITGFFLLFVACIVYMRTDMSISKSSPSYLAKLQWDEVQATVQKIQGIFEQCLAVHDKLEASLRDLSRTGDIQSCKAARKAADAQFKELSKELKPLLTSLQSSPQSYQIWPKVEDLITKEREMQEKLMTRHSTVVDSFEKKLRGQDVENRIALQQQKIAALRQEVESLLEYISEI

SEQ ID NO: 5421 - protein, 617 aa, Setaria italica
MATPLPPLRRATTTLLLVVLVAVLASTARADLVISKADRRVDLTSHIVRVLASLKVENVGPDPVSQVLLSFPNIQAKNLAAIRAFGTEGKVKGPSTILPIEVVEPSGAPPELTFFSALLPKPLGKGKTLHLDVLTVFTHSLQPFPEEITQAEAQLVVYQDSAHYLSPYPVKVQTLTIRLPGGRVESYTRHPSAKLVDSELKYGQFEDLPPFSYLPVIVHFENNNPFAVAKEVIREIEISHWGNVQITEHYNIAHGGAKLKGEFSRIDYQSRPYVRGVSSFRNLIARLPPRAHSIYYRDEIGNISTSHLWSDSKKTHLEIEPRFPLFGGWQTTFTVGYGLPLQDFVFYSDGKRFLNITFGSPMEEILIEKLIVKVVLPEGSKDIEVSAPFPTKQWQEVKYSHLDIVGRPVVVLEKPDVIPEHNLYFQVYYKFNNISLLREPLMLITGFFLLFVACIVYMRTDMSISKSSPSYLAKLQWDEVQATVQKIQGLFEQCLAVHDKLEASLRDLSRTGDVQSCKAARKAADAQFKELWKELKPLLTSLQSSPQSYQIWPKVEDLITKEREMQEKLMTRHSTVVDSFEKKLRGQDVENRIALQQQKIAALRQEVESLLEYISEI

SEQ ID NO: 5422 - protein, 620 aa, Pennisetum glaucum
MATPLPPLRRATATATLLPFLLLAAVLASTARADLVISKADRRVDLTSHIVRVLASLKVENVGPDPVSQVLLSFPNIQAKNLAAIRAFGTEGKVKGPSTVLPIEVVEPSGAPPELTFFSALLPKPLGKGKTLHLDVLTVFTHSLQPFPEEITQAEAQLVVYQDSAHYLSPYPVKVQTLTIRLPGGRVESYTRHPGAKLVDSELKYGQFEDLPPFSYLPVIVHFENNNPFAVAKEVIREIEISHWGNVQITEHYNIAHGGAKLKGEFSRIDYQSRPYVRGVSSFRNLIARLPPRAHSIYYRDEIGNISTSHLWSDSKKTHLEIEPRFPLFGGWQTTFTVGYGLPLQDFVFYSDGKRFLNITFGSPMEEILIEKLIVKVVLPEGSKDIEVSAPFPTKQWQEVKYSHLDIVGRPVVVLEKPDVIPEHNLYFQVYYKFNNISLLREPLMLITGFFLLFVACIAYMRTDMSISKSSPSYLAKLQWDEVQATAQKIQALFEQCLAVHDKLEASLRDLSRTGDVQSCKAARKAADAQFKELSKELKPLLTSLQSSPQSYQIWPKVEDLIAKEREMQEKLMTRHSTVVDSFEKKLRGQDVENRIALQQQKIAALRQEVESLLEYISEI

SEQ ID NO: 5423 - protein, 612 aa, Brachypodium distachyon
MAPPPRLAALLLLLLAGASASAVRADLVISRADRKVDLTSHIVRVLTSLKVENVVSEPVSKVLLAFPNIQAKNLAAIRAFGTEGKVKGPSVVLPIETVQPSGVPPELTFFSVSLHKPLQKGKILHLDVLTVFTHSLQPFPEEITQAESQLVVFQDSSHYLSPYPVKVQTLSIRLPGGRVESYTKYANTKLVDSELKYGPFEDLPPFSYSPVIVHFENNNPFAVAKELVREIEISHWGNVQITEHYNIAHGGARLKGEFSRIDYQSRPYVRGVSSFRHLIARLPPTAHSICYRDEIGNISTSHLWSDSKKTQLEIEPRFPLFGGWQTTFTIGYGLPLQDFVFTSDGKRFLNITFGSPVEEILIEKLIVKVVLPEGSKDIDVSVPFPTKQWQEVKYSHLDIAGRPVLVLEKPDVIPEHNLHFQVYYKFSNISLLIEPMMLITGFFLLFVACIAYMHTDMSISKNSPSYLAKLQWDEVQATVQQIQSIFGQCLAVHDKLEVSLHDLSRTGDTKSCKAARKAADAQFKELAKELKPLLISLQSSTQSYQIWPKVEDLVAKEREMQEKLMARHSTVVDSFEKKLRGQDIENRIASQQQKITVLRQEVESLLEYLSEI

SEQ ID NO: 5424 - protein, 611 aa, Avena sativa
MAPPLRLAALLLVIVAVFASSARADLVISRADRKVDLTSHIVRVLSSLKVENAGSEPASKVLVAFPNIQAKNLAAIRAFGTEGKVKGLSSVLPIEVVEPSGAPPELTFFSVSLQKPLEKGRILHLDVLTVFTHSLQPFPEEITQADSQLVVFQDSSYYLSPYPVKVQTLSIRLPGGRVESYTKHANTKLVDSELKYGPFEDLPPFSYNPIIVHFENNNPFAVAKELIREIEISHWGNVQITEHYTIVHGGARLKGEFSRLDYQSRPYVRGVSSFRHLIAKLPPRAHSIYYRDEIGNISTSHLWSDSKKTQLEIEPRFPLFGGWQTTFTVGYGLPLQDFVFSSDGRRYLNITFGSPVEEILIEKLIVKVILPEGSKDIDVSAPFPTKQWQEVKYSHLDIVGRPVIVLEKPDVIPEHNLHFQVYYKFSNISLLIEPMMLITGFFLLFVACIAYMHTDMSISKNSPSYLAKLQWDEVQATIQQIQGIFDQCLAVHDKLETSLHDLSRTGDTKSCKAARKAADAQFKELAKELKPLLTSVQSSPQSYQIWPKVEELVAKEREMQEKLMARHSTVVDSFEKKLRGQDIENRIASQQQKIGALRQEVESLLEYLSEI

SEQ ID NO: 5425 - protein, 611 aa, Avena sativa
MAPPLRLAALLLVIVAVFASSARADLVISRADRKVDLTSHIVRVLSSLKVENAGSEPASKVLVAFPNIQAKNLAAIRAFGTEGKVKGLSSVLPIEVVEPSGAPPELTFFSVSLHKPLEKGRILHLDVLTVFTHSLQPFPEEITQADSQLVVFQDSSYYLSPYPVKVQTLSIRLPGGRVESYTKHANTKLVESELKYGPFEDLPPFSYNPIIVHFENNNPFAVAKELIREIEISHWGNVQITEHYTIVHGGARLKGEFSRLDYQSRPYVRGVSSFRHLIAKLPPRAHSIYYRDEIGNISTSHLWSDSKKTQLEIEPRFPLFGGWQTTFTVGYGLPLQDFVFSSDGRRYLNITFGSPVEEILIEKLIVKVILPEGSKDIDVSAPFPTKQWQEVKYSHLDIVGRPVIVLEKPDVIPEHNLHFQVYYKFSNISLFIEPMMLITGFFLLFVACIAYMHTDMSISKNSPSYLAKLQWDEVQATIQQIQGIFDQCLAVHDKLETSLHDLSRTGDTKSCKAARKAADAQFKELAKELKPLLTSVQSSPQSYQIWPKVEDLVAKEREMQEKLMARHSTVVDSFEKKLRGQDIENRIASQQQKIGALRQEVESLLEYLSEI

SEQ ID NO: 5426 - protein, 615 aa, Oryza sativa
MATPPPLRRVAALLLLLVAAASTPTARADLVVTRADRKVDLTSHIVRVLTSLKVENSGPEAVSQFLLAFPNVQAKNLAAIRAFGTEEKVKGPSMVLPIEVVQPSGVPPELTFFSASLSKPLEKGKTLHLDVLTVFTHSVQPFPEEITQAESQLVVYQDSAQYLSPYPVKVQTLSIRLPGGRVESYTKYPNTKLAESELKYGPYEDLPPFSYSPMVVHYENNNPFAVAKEVIREIEISHWGNVQITEHYNIAHGGAKLKGEFSRIDYQSRPYIRGVSSFRHLIARLPPRAHSIYYRDEIGNISTSHLWSDSKKTQLEVEPRFPLFGGWQTTFTIGYGLPLQDFVFNSDGKRFLNITFGSPVEEILIEKLIVKVVLPEGSKDIDISVPFPTKQEQEVKYSHLDISGRPVVVLEKLDVIPEHNLYFQVYYRFNNISLLREPMMLITGFFLLFMACIVYMRTDMSISKNSPSYLAKVQWDEVQSIIQQIQAIFNQCLAAHDKLETSLHELSRSGDVKSCKVARKTADAQFKELAKELKPLLTSLQSSSQSYQIWPKVEELVAKERELQDKLMTRHSTVVDSFEKKLRGQDVENRIAAQQQKVAALRQEVESLLEYISEI

SEQ ID NO: 5427 - protein, 590 aa, Festuca arundinacea
ARADLVISKADRKVDLTSHIVRILTSLKVENVGSEPVSNVLLAFPNIQAKNLAAIRAFGTEGKVKGLSTIVPIEVVQPSGAPPELTFFSASLHKALEKGRILHLDVLTVFTHSLQPFPEEISQADSQLVVFQDSSHYLSPYPVKVQTLSIRLPGGRVESYTKHANTKLVDSELKYGPFEDLAPFSYNPIIVHFENNNPFAVAKELIREIEISHWGNVQITEHYNIVHGGARLKGEFSRLDYQSRPYVRGVSSFRHLVAKLPPRAHSIYFRDEIGNISTSHLWSDAKKTQLEIEPRFPLFGGWQTTFTIGYGLPLQDFVFSSDGKRFLNITFGSPMEEILIEKLIVKVVLPEGSKDIDVSAPFPTNQRQEVKYSHLDIAGRPVLVLEKPDVIPEHNLHFQVYYKFNNISLLIEPMMLIIGFFLLFVACIAYMHTDMSISKSSPSYLAKLQWDEVQATVQQIQGIFDQCLAVHDKLETSLHDLSRTGDTKSCKAARKAADAQFKELAKELKPLLMSVQSSPQSYQIWPKLEDLVAKEREMQDKLMARHSTVVDSFEKKLRGQDIENRIASQQQKIAALRQEVESLLEYLSEI

SEQ ID NO: 5428 - protein, 589 aa, Lolium multiflorum
RADLVISRADRKVDLTSHIVRILTSLKVENVGSEPVSNVLLAFPNIQAKNLAAIRAFGTEGKVKGLSTIVPIEVVQPSGAPPELTFFSASLHKALEKGRILHLDVLTVFTHSLQPFPEEIGQADSQLVVFQDSSHYLSPYPVKVQTLSIRLPGGRVESYTKHANTKLVDSELKYGPYEDLAPFSYNPMIVHFENNNPFAVAKELVREIEISHWGNVQITEHYNIVHGGARLKGEFSRLDYQSRPYVRGVSSFRHLVAKLPPRAHSIYFRDEIGNISTSHLWSDAKKTQLEIEPRFPLFGGWQTTFTIGYGLPLQDFVFSSEGKRFLNITFGSPMEEILIEKLIVKVVLPEGSKDIDVSAPFPTNQRQEVKYSHLDIAGRPVLVLEKPDVIPEHNLHFQVYYKFNNISLLIEPMMLIIGFFLLFVACIAYMHTDMSISKSSPSYLAKLQWDEVQATVQQIQGIFDQCLAVHDKLETSLHDLSRTGDTKSCKAARKAADAQFKELAKELKPLLMSVQSSPQSYHIWPKLEDLAAKEREMQDKLMARHSTVVDSFEKKLRGQDIENRIASQQQKIAALRQEVESLLEYLSEI

SEQ ID NO: 5429 - protein, 584 aa, Triticum aestivum
ISRADRKVDLTSHIVRVLTSLKVENAGSEPVSKVLLAFPNIQAKNLAAIRAFGTEGKVKGLSSILPIEVVEPSGVPPELTFFSASLHKPLTKGKILHLDVLTVFTHFLQPFPEEITQADSQLVVFQDSSHYLSPYPVKVQTLSIRLPGGRVESYTKYGNTKLVDSELKYGPYEDVPPFSYNPIIVHFENNNPFAVAKELIREIEISHWGNVQITEHYNIVHGGARLKGEFSRLDYQSRPYARGVSSFRHLIARLPARAHSIYYRDEIGNISTSHLWSDSKKTQLEIEPRFPLFGGWQTTFTIGYGLPLQDFVFSADGKRFLNITFGSPMEEILIEKLIVKVVLPEGSKDIDVSAPFPTNQWQEVKYSHLDIAGRPVLVLEKPDVIPEHNLHFQVYYKFNNISLLIEPMMLITGFFLLFVACIAYMHTDMSISKNSPSYLAKLQWDEVQATVQQIQGIFHQCLAVHDKLETSLHDLSRTGDAKSCKAARKAADAQFKELAKELKPLLLSVQSSPQSYQIWPKLEDLVAKERELQEKLMARHATVVDSVEKKQRGQDIENRISSQQQKIAALRQEVESLLEYLSEI

SEQ ID NO: 5430 - protein, 521 aa, Setaria italica
MATAPANGDSESGPQRNYQVVVAATRDMGIGKDGVLPWKLLGDLKFFKELTLATSDPAKKNAVIMGRKTWESIPVKSRPLPGRLNVILTRSGSFDFATVENVVICGSMKSALELLASTPYCLSIEKVFVIGGGQVLREYLNRPACEAIHLTDIQSSIECDTFIPPIDFSVFQPWYSSFPVVESNIRHSFVTFVRVRKSLAETHESNGKESTEVDTKNDKFETENFSFLPKMIFDRHEEYHYLNLVEDIIRSGAQKNDRTGTGTLSKFGCQMRFNLRKNFPLLTTKRVFWRGVVEELLWFISGSTNAKVLQEKGIHIWDGNASREYLDSVGLAHREEGDLGPVYGFQWRHFGAEYTDMHADYTGKGFDQLMDVIDKIKNNPDDRRIILSAWNPSDLKKMALPPCHMFAQFYVENGELSCQMYQRSADMGLGVPFNIASYSLLTYMIAQVCDLSPGDFVHVIGDAHVYRTHVRALEEQIQKMPKPFPILKINPSKKDIDSFVASDFKLVGYDPHQKIEMKMAI

SEQ ID NO: 5431 - protein, 523 aa, Zea mays
MAMAAVLANGDSQGRPQRNYQVVVAGTRDMGIGKDGVLPWKLPGDLKFFKELTLITSDPVKKNAVIMGRKTWESIPVKSRPLPGRLNVILTRSGSFDFATVENVVICGSMESALELLASTPYCLSIEKVFVIGGGQVLREYLKGPACEAIHLTDIQSSIECDTFIPPVDFSVFQPWYSSFPVIESNIRHSFVSFVRVRKSVAETHESNGKESTEVDTKNDKFETENFSFLPKMVYDRHEEYQYLNLVEDIIRSGAQKNDRTGTGTLSKFGCQMRFNLRKNFPLLTTKRVFWRGVVEELLWFISGSTNAKVLQEKGIHIWDGNASREYLNSVGLAHREEGDLGPIYGFQWRHFGAEYTDMHADYTGKGFDQLMDVIDKIKNDPDDRRIILSAWNPSDLKKMALPPCHMFAQFYVENGELSCQMYQRSADMGLGVPFNIASYSLLTYMIAQVCDLSPGDFVHVIGDAHVYRNHVRALEEQIQKMPKPFPILKINPSKKDIDSFMASDFKLVGYDPHQKIEMKMAV

SEQ ID NO: 5432 - protein, 521 aa, Setaria italica
MATAPANGDSQSGPQRNYQVVVAATRDMGIGKDGVLPWKLLGDLKFFKEVTLSTSDPAKKNAVIMGRKTWESIPVKSRPLPGRLNVILTRSGSFDFATVENVVICGSMKSALELLASTPYCVSIEKVFVIGGGQVLREYLNGPACEAIHLTDVQSSIECDTFIPPIDFSVFQPWYSSFPVVESNIRHSFVTFVRVRKSLEETHVSNGKESTEVDTKNDKFETENFSFLPKMIFDRHEEYHYLNLAEDIIKSGAQKNDRTGTGTLSKFGCQMRFNLRKIFPLLTTKRVFWRGVVEELLWFISGSTNAKVLQEKGIHIWDGNASREYLDSVGLAHREEGDLGPVYGFQWRHFGAEYTDMHADYTGKGFDQLMDVIDKIKNNPDDRRIILSAWNPSDLKKMALPPCHMFAQFYVENGELSCQMYQRSADMGLGVPFNIASYSLLTYMIAQVCGLSPGDFVHVIGDAHVYRTHVRALEEQIQKMPKPFPILKINPSKKDIDSFVASDFKLVGYDPHQKIEMKMAI

SEQ ID NO: 5433 - protein, 494 aa, Zea mays
MGIGKGGVMPWKLLGDLKFFKELTLTTTDPAKKNAVIMGRKTWESIPVKSRPLPGRLNVILTRSGSFDFATVENVVICGSMKSALELLASTPYCLSIEKVFVIGGGQVLREYLNGPACEAIHLTDIQSSIECDTFIPPVDFSVFQPWYSSFPVVESNIRHSFVTFVRVRKSVAETHESNGKESTEIDTKNDKFEIENFSFLPKIVYDRHEEYQYLNLVEDIIRFGAQKNDRTGTGTLSKFGCQMRFNLRKNFPLLTTKRVFWRGVVEELLWFISGSTNAKVLQEKGIHIWDGNASREYLDRIGLAHREEGDLGPVYGFQWRHFGAEYTDMHADYTGKGFDQLMDVIDKIKNNPDDRRIILSAWNPSDLKKMALPPCHMFAQFYVENGELSCQMYQRSADMGLGVPFNIASYSLLTYMIAQVCDLSPGDFVHVIGDAHVYRNHVRALEEQIQKMPKPFPILKINPSKKDIDSFMASDFKLVGYDPHQKLEMKMAV

SEQ ID NO: 5434 - protein, 521 aa, Festuca arundinacea
MAAALANGDSPNSLQRNYQVVVAATRDMGIGKDGVLPWKLPGDLKFFKELTLTTSDPAKKNAVIMGRKTWESIPLKARPLPGRLNVILTRSGSFDFATAENVVICGSMNSALELLASTPYCLSIEKVFVIGGGQILRDSLNGPACEAIHLTDIQSNIECDTFIPPVDFSVFQPWCSSLPVVESNIRHSFVTYVRVRKSVLESHDSNGKESTENDTKSSKFEIENFSFLPKMIFERHEEYYYLNLVDDIIRCGAQKGDRTGTGTLSKFGCQMRFNLRKSFPLLTTKRVFWRGVLEELLWFISGSTNAKVLQEKGIHIWDGNASREYLDSVGLANRGEGDLGPVYGFQWRHFGAEYTDMHADYTGKGFDQLMDVIDKIKNNPDDRRIIMSAWNPSDLKKMALPPCHMFAQFYVENGELSCQMYQRSADMGLGVPFNIASYSLLTCMIAQVCGLSPGDFIHVIGDAHVYRTHVRALEEQIQKLPKPFPILKINPLKKDIDSFVASDFKLDGYDPHKKIEMEMAI

SEQ ID NO: 5435 - protein, 518 aa, Avena sativa
MATALANGDSHNSLQRNYQVVVAATRGMGIGKDGVLPWKLPGDLKFFKKLTLTTSDPAKKNAVIMGRKTWESIPLKARPLPGRLNVILTRSGSFDFATAENVVICGSMNSALELLASTPYCLSIEKVFVIGGGQILRESLNGPACEAIHLTDIQSNIECDTFIPPVDFSVFQPWCSSLPVTESNIRHSFVTFVRVRKSVPESNGKESTEHDTKSNKFEIENFSFLPKMIFDRHEEYYYLNLVDDIIRCGAQKGDRTGTGTLSKFGCQMRFNLRKSFPLLTTKRVFWRGVLEELLWFISGSTNAKVLQEKGIHIWDGNASREYLDSVDLANREEGDLGPVYGFQWRHFGAEYTDMHADYTGKGFDQLMDVIDKIKNNPDDRRIILSAWNPSDLKKMALPPCHMFAQFYVENGELSCQMYQRSADMGLGVPFNIASYSLLTCMIAQVCGLSPGDFVHVIGDAHVYRTHVRALEEQIEKLPKPFPILKINPSKKDIDSFVASDFKLDSYDPHKKIEMEMAI

SEQ ID NO: 5436 - protein, 521 aa, Oryza sativa
MATTLSNDVSQNGPQRNYQVVVAATRDMGIGKDGVLPWKLLGDLKFFKELTVTTADPVKKNAVIMGRKTWESLPLKARPLPGRLNIILTRSGSFEFATVENVVICGSMNSALELLSSTPYCLSIEKVFVIGGGQVLRESLNGPSCEAVHLTDIQSSIECDTFIPPIDLSVFQPWYSSLPVVESNIRHSFVTYVRVRKTMAETHDSNGKESANDGIKSDKFETENFSFLPKLIFDRHEEYHYLNLVEDIIRSGAQKNDRTGTGTLSKFGCQMRFNLRNSFPLLTTKKVFWRGVVEELLWFISGSTSAKVLQEKGIHIWDGNASREYLDSVGLAHREEGDLGPVYGFQWRHFGAEYTDMHADYTGKGFDQLMDVIDKIKNNPDDRRIILSAWNPSDLKKMALPPCHMFAQFYVESGELSCQMYQRSADMGLGVPFNIASYSLLTYMIAHVCGLSPGEFVHVIGDAHVYRTHVRALEEQIQKLPKPFPILKINPLKKDIDSFVASDFKLVGYDPHQKIEMKMAI

SEQ ID NO: 5437 - protein, 518 aa, Avena sativa
MATALANGDSQNSLQRNYQVVVAATRDMGIGKDGDLPWTLPIDLKFFKNVTLTTSDPAKKNAVIMGRKSWDSLPLKARPLRGRLNVILTRSGSFDFATAENVVICGSMNSALELLASTPYCLSIEKVFVIGGGQILRESLNGPTCEAIHLTDIQSNIECDTFIPPVDFSVFQPWCSSLPVTESNIRHSFVTFVRVRKSVPESNGKESTEHDIKSNKFEIENFSFLPKMIFDRHEEYYYLNLVDDIIRCGAQKGDRTGTGTLSKFGCQMRFNLRKSFPLLTTKRVFWRGVLEELLWFISGSTNAKVLQEKGIHIWDGNASREYLDSVGLANREEGDLGPVYGFQWRHFGAEYTDMHADYTGKGFDQLMDVIDKIKNNPDDRRIILSAWNPSDLKKMALPPCHMFAQFYVENGELSCQMYQRSADMGLGVPFNIASYSLLTCMIAQVCGLSPGDFIHVIGDAHVYRTHIRALEEQIQKQPKPFPILKINPSKKDIDSFEASDFKLAGYDPHKKIEMEMAI

SEQ ID NO: 5438 - protein, 521 aa, Avena sativa
MATALANGDSQNSLQRNYQVVVAATRDMGIGKDGDLPWTLPIDLKFFKNVTLTTSDPAKKNAVIMGRKSWDSLPLKARPLRGRLNVILTRSGSFDFATAENVVICGSMNSALELLASTPYCLSIEKVFVIGGGQILRESLNGPTCEAIHLTDIQSNIECDTFIPPVDFSVFQPWCSSLPVVENNIRHAFVTFVRVRRSVSESHDSNGKASTEHDTKSNKFEIENFSFLPKMIFDRHEEYYYLNLVDDIIRCGAQKGDRTGTGTLSKFGCQMRFNLRKSFPLLTTKRVFWRGVLEELLWFISGSTNAKVLQEKGIHIWDGNASREYLGSVGLANREEGDLGPVYGFQWRHFGAEYTDMHADYTGKGFDQLMDVIDKIKNNPDDRRIILSAWNPSDLKKMALPPCHMFAQFYVENGELSCQMYQRSADMGLGVPFNIASYSLLTCMIAQVCGLSPGDFIHVIGDAHVYRTHIRALEEQIQKQPKPFPILKINPSKKDIDSFVASDFKLDSYDPHKKIEMEMAI

SEQ ID NO: 5439 - protein, 494 aa, Lolium multiflorum
MGIGKDGVLPWRLPGDLKFFKELTLTTSDPAKKNAVIMGRKTWESIPLKARPLPGRLNVILTRSGSFDFATAENVVICGSMNSALELLASTPYCLSIEKVFVIGGGHILRDSLNGPACEAIHLTDIQSNIECDTFIPPVDFSVFQPWCSSLPVVESNIRHSFVTFVRVRTSVSESHDSNGKESTEQDTKSSKFEIENFSFLPKMIFERHEEYYYLNLVDDIIRCGAQKGDRTGTGTLSKFGCQMRFNLRKSFPLLTTKRVFWRGVLEELLWFISGSTSAKVLQEKGIHIWDGNASREYLDSVGLANREEGDLGPVYGFQWRHFGAEYTDMHADYTGKGFDQLIDVIDKIKNNPDDRRIIMSAWNPSDLKRMALPPCHMFAQFYVENGELSCQMYQRSADMGLGVPFNIASYSLLTCMIAQVCGLSPGDFIHVIGDAHVYRTHVRALEEQIQKLPKPFPILKINPLKKDIDSFVASDFKLDGYDPHKKIEMEMAI

SEQ ID NO: 5440 - protein, 517 aa, Brachypodium distachyon
MFANVANGSSYNPDIRRNYQVVVAATHEMGIGKDGALPWKLPSDLNFFKELTMATSDPSKKNAVIMGRKTWESIPAKFRPLPGRLNVILTRSGSFDFATVENVVICGSLDSSLELLASTPYSLTIEKAFLIGGGQVLRDSLNAPACEAIHLTDIESTIECDTYIPPIDLSVFHPWYSSFPVVENNIRHSFVTFVRVRKPVTEVNDSNGNDAKKERFEIKNFSFLPKMIFERHDEYQYLNLVQDIIQSGARKNDRTGTGTLSKFGCQMRFNLRRNFPLLTTKRVFWRGVLEELLWFISGSTNAKVLQEKGIHIWDGNASREYLDSIGLSQREEGDLGPVYGFQWRHFGAEYTDMHADYTGKGYDQLIDVINKIRNNPDDRRIILSAWNPTDLKKMALPPCHMFAQFYVENGELSCQMYQRSADMGLGVPFNIASYSLLTCMIAQVCDLSPGDFVHVIGDAHVYSTHVRALEEQIKKQPKPFPILKINPVKKDIDSFVASDFELVCYDPHQKIEMKMAV

SEQ ID NO: 5441 - protein, 521 aa, Oryza sativa
MSTNVNNGNSESNLKRSYQVVVSATRDMGIGKDGTLPWKLPGDLKFFKDITVTTSDPSKKNAVVMGRKTWESIPLKFRPLPGRLNVILTRSGSFDFATAENVVICGSLDSALQLLATTPYCLTVEKTFIIGGGEILRQSLNAPACEAIHLTDIESSIECDTFIPPIDLSMFHPWYSSFPVVENGIKHSFISFVRVTKSIAEANDSSGKELTGNDSKKVKFEIENFSFLPKMIFERHEEYQYLNLVQDIIRNGAKKNDRTGTGTVSKFGCQMRFNLRRNFPLLTTKRVFWRGVLEELLWFISGSTNAKVLQEKGIHIWDGNASRQYLDSIGLTQREEGDLGPVYGFQWRHFGAEYTDMHADYVGKGFDQLMDVIDKIKNNPDDRRIILSAWNPTDLKKMALPPCHMFAQFYVENGELSCQMYQRSADMGLGVPFNIASYSLLTCMIAQVCDLSPGDFVHVIGDAHVYRTHVEALEEQMRKQPKPFPILKINPVKKDIDSFVTSDFKLVRYDPHHKIEMKMAV

SEQ ID NO: 5442 - protein, 525 aa, Cocos nucifera
MADDIPASISNGNTQHDPKRTFQVVVAATRDMGIGKDGKLPWKLPSDLKFFKEVTMTVSDPVKKNAVIMGRKTWESIPLQNRPLPGRLNVVLTRSGSFDIATAENVVICGSMNSALKLLAATPYCLSIEKVFVIGGGQVLRESLNAPECEAIHLTDIETNIECDTFIPPIDFSVFQPWYSSFPLVENNIRYSFVTYVRVRNSAAELHTLHDEDKTDVKLYLNKFEVEKFSFLPKMIHERHGEYMYLRLVQDIIANGAQKNDRTGTGTLSKFGCQMRFNLRRSFPLLTTKKVFWRGVVEELLWFIGGSTNAKVLQEKGIHIWDGNASREYLDSVGLSCREEGDLGPIYGFQWRHFGAKYTDMHADYTGKGFDQLLDVIDKIKSNPDDRRIILSAWNPSDLKKMALPPCHMLAQFYVENGELSCQMYQRSADMGLGVPFNIASYSLLTCMIAQVCDLLPGDFIHVIGDAHVYRTHVRPLEEQLQKQPKPFPILKVNPLKKDIDSFVASDFELVGYDPHYKIEMKMAV

SEQ ID NO: 5443 - protein, 445 aa, Echinochloa colona
MATAPTNGDSQSGPQRNYQVVVAATRDMGIGKDGVLPWKLVDDLKFFKELTLTTSDPAKKNAVIMGRKTWESIPVKSRPLPGRLNVILTRSGSFDFATVENVVICGSMKSSLELLASTPYCLSIEKVFVIGGGQVLREYLNGPACEAIHLTDIQSSIDCDTFIPPIDFSVFQPWCSSFPVVESNIRHSFVTFVRVRKSVPETHDSNGKESTEFNTKNDKFETENFSFLPKMIFDRHEEYHYLNLVEDIIRSGAQKNDRTGTGTLSKFGCQMRFNLRKNFPLLTTKRVFWRGVLEELLWFISGSTNAKVLQEKGIHIWDGNASREYLDSVGLAHREEGDLGPVYGFQWRHFGAEYTDMHADYTGKGFDQLMDVIDKIKNNPDDRRIILSAWNPSDLKKMALPPCHMFAQFYVENGELSCQMYQRSADMGLGVPFNIASYSLLTYMI

SEQ ID NO: 5444 - protein, 525 aa, Cocos nucifera
MADDIPASISNGNTQHDPKRTFQVVVAATRDMGIGKDGKLPWKLPSDLKFFKEVTMTVSDPVKKNAVIMGRKTWESIPLQNRPLPGRLNVVLTRSGSFDIATAENVVICGSMNSALKLLAATPYCLSIEKVFVIGGGQVLRESLNAPECEAIHLTDIETNIECDTFIPPIDFSVFQPWHSSFPLVENDIRYSFVTYVRVRHSATELHALHDGGKTDGKLYLNKFEVERFSFLPKMIHERHEEYVYLRLVQDIIANGAQKNDRTGTGTLSKFGCQMRFNLRRSFPLLTTKKVFWRGVVEELLWFIGGSTNAKVLQEKGIHIWDGNASREYLDSVGLSCREEGDLGPIYGFQWRHFGAKYTDMHADYTGKGFDQLLDVIDKIKSNPDDRRIILSAWNPSDLKKMALPPCHMLAQFYVENGELSCQMYQRSADMGLGVPFNIASYSLLTCMIAQVCDLLPGDFIHVVGDAHVYRTHVRPLEEQLQKQPKPFPILKVNPLKKDIDSFVASDFELVGYDPHYKIEMKMAV

SEQ ID NO: 5445 - protein, 525 aa, Cocos nucifera
MAGDIPTNISNGNTQHDPKRTFEVVVAATRNMGIGKDGKLPWKLPSDLNFFKEVTVTASDSVKKNAVIMGRKTWESIPLQNRPLPGRLNVVLTRSGSFDIATAENVVICGSMNSALKLLAATPYCLSIEKVFVIGGGQVLRESLNAPECEAIHLTDIETNIECDTFIPPIDFSVFQPWYSSFPLVENNIRYSFVTYVRVRNSAAELHTLHDEDKTDVKLYLNKFEVEKFSFLPKMIHERHGEYMYLRLVQDIIANGAQKNDRTGTGTLSKFGCQMRFNLRRSFPLLTTKKVFWRGVVEELLWFISGSTNAKVLQEKDIHIWDGNASREYLDSVGLSCREEGDLGPIYGFQWRHFGAEYTDMHADYTGKGFDQLLDVIDKIKNNPNDRRIILSAWNPSDLKKMALPPCHMFAQFYVENGELSCQMCQRSADMGLGVPFNIASYSLLTCMIAQVCDLLPGDFIHVIGDAHVYRTHVRPLEEQLQKQPKPFPILKINPLKKDIESFIASDIELVGYDPHYKIEMKMAI

SEQ ID NO: 5446 - protein, 526 aa, Ananas comosus
MAAEINRHYSNGNLQNQPQRNYQIVVAATRDLGIGKDGKLPWKLPSDLKYFKEVTVSTLDPSKKNAVIMGRKTWESIPLQYRPLPGRLNIILTRSGSFDIATLQNVICCASLSSALELLSSTPYSLSIEKVFVIGGGQVLRDALNAPECEAIHLTDIETSFDCDTFIPSIDFSVFQPWYSSIPTVENNIRYSFVTYVRVRSSAPDKLHASNGCEPTENNSHKDQFEVEKFSFLPKVIFERHEEYMYLKLVQDIIENGATKNDRTGTGTLSKFGCQMRFNLRRSFPLLTTKRIFWRGVVEELLWFISGSTNAKVLQDKGIYIWDGNASREYLDSAGLAHREEGDLGPIYGFQWRHFGAEYIDMHADYTGKGFDQLLDVIDKIKNNPNDRRIILSAWNPSDLKKMALPPCHMFAQFYVEKGELSCQMYQRSADMGLGVPFNIASYSLLTCIIAQVCGLSPGDFVHVIGDAHVYRTHVRPLEEQIQKQPKPFPILKINPLKNDIDSFVASDFKLIGYDPHHKIEMKMAV

SEQ ID NO: 5447 - protein, 693 aa, Zea mays
MGDSSVAGALVPSVPKPEPAPSGDTSAAAAATTAALAMPEEAGMRAASASPQGPAEEGEGPADRDLLCPICMAVIKDAFLTACGHSFCYMCIVTHLSNKSDCPCCGHYLTKAQLYPNFLLDKVLKKISAQQIAKTASPIDQFRCALQQGNEMGVKELDSLMTLIAEKKRQMEQQESETNMQILLVFLHCLRKQKLEELNEIQTDLQYIKEDISSVERHRAELYRTKERYSMKLRMLLDEPTAQKMWPSPIDKASCRFLPNSRTPLSGSCPGTLQNKKLDLKAQVSHQGFQRRDALTSSDPPNSPIQSGNVIARKRRVQAQFNELQEYYLQRRRTGAQARRQEERDIVAMNREGYHAGLQDFQSVLTTFTRYSRLRVIAELRHGDLFHSANIVSSIEFDRDDELFATAGVSKRIKVFEFSTVVNEPSDVHCPVVEMATRSKLSCLSWNKYSKNIIASSDYEGIVTVWDVQTRQSVMEYEEHEKRAWSVDFSRTDSSMLVSGSDDCKVKVWCTNQEASVINIDMKANICSVKYNPGSSFYVAVGSADHHIHYFDLRNPSSPVHIFGGHKKAVSYVKFLSNNELASASTDSTLRLWDVKDNCPVRTFRGHKNEKNFVGLSVNNEYIACGSETNEVFVYHKAISKPAASHRFVSSDLDDADDDPGSYFISAVCWKSDSPTMLTANSQGTIKVLVLAP

SEQ ID NO: 5448 - protein, 695 aa, Sorghum bicolor
MGDSSVAGALVPSVPKPEPARSGDTSVAAAATTAALALALPEEAGTRAASASPQGPPAEDEGPADRDLLCPICMALIKDAFLTACGHSFCYMCIVTHLSNKSDCPCCGHYLTKAQLYPNFLLDKVLKKISARQIAKTASPIDQFRCALQQGNEMGVKELDSLMTLIAEKKRQMEQQESETNMQILLVFLHCLRKQKLEELNEIQTDLQYIKEDISAVERHRKELYRTKERYSMKLRMLLDEPTAQKMWPSPIDKASCRFPPNSRTPLSASCPGTLQNKKLDLKAQVSHQGFQRRDALTSSDPPNPPIQSGNVIARKRRVQAQFNELQEYYLQRRRTGAQARRQEERDIVAMNREGYHAGLQDFQSVLTTFTRYSRLRVIAELRHGDLFHSANIVSSIEFDRDDELFATAGVSKRIKVFEFSTVVNEPSDVHCPVVEMATRSKLSCLSWNKYSKNVIASSDYEGIVTVWDVQTRQSVMEYEEHEKRAWSVDFSRTDPSMLVSGSDDCKVKVWCTKQEASVINIDMKANICSVKYNPGSNFYVAVGSADHHIHYFDLRNPSAPVHIFGGHKKAVSYVKFLSNNELASASTDSTLRLWDVKDNCPVRTFRGHKNEKNFVGLSVNNEYIACGSETNEVFVYHKAISKPAASHRFVSSDLDDADDDPGSYFISAVCWKSDSPTMLTANSQGTIKVLVLAP

SEQ ID NO: 5449 - protein, 687 aa, Panicum virgatum
MGDSSVAGALVPSVPKPEAAPSGDASAAALALAEEAGTRAASASPQGPAEEGEGPADRDLLCPICMAVIKDAFLTACGHSFCYMCIVTHLSHKSDCPCCGHYLTKAQLYPNFLLDKVLKKISARQIAKTASPIDQFQYALQQGNEMGVKELDSLMTLISEKKRQMEQQESETNMQILLVFLHCLRKQKLEELNEIQTDLQYIKEDIGAVERHRLELYRTKERYSMKLRMLLDDPAAQKMWPSPIDKASSLFLPNSRTPLSASCPGSLQNKKLDLKAQVSHQGFQRRDALTCSDPPNSPIQSGNIIARKRRVQAQFNELQEYYLQRRRTGAQARRQEERDIVAMNREGYHAGLQDFQSVLTTFTRYSRLRVIAELRHGDLFHSANIVSSIEFDRDDELFATAGVSKRIKVFEFSSVVNEPSDVHCPAVEMATRSKLSCLSWNKYSKNVIASSDYEGIVTVWDVQTRQSVMEYEEHEKRAWSVDFSRTEPSMLVSGSDDCKVKVWCTKQEASVINIDMKANICSVKYNPGSSFYVAVGSADHHIHYFDLRNPSAPVHVFGGHKKAVSYVKFLSNNELASASTDSTLRLWDVKDHCPVRTFRGHKNEKNFVGLSVNSEYIACGSETNEVFVYHKAISKPAASHRFVSSDLGDAEDDPGSYFISAVCWKSDSPTMLTANSQGTIKVLVLAP

SEQ ID NO: 5450 - protein, 697 aa, Setaria italica
MGDSSVAGALVPSVPKPEAAPSGDASTAAAATTAALALALAEEAGARAASASASPQGPAAEGEGPADRDLLCPICMAVIKDAFLTACGHSFCYMCIVTHLSRKSDCPCCRHYLTKAQLYPNFLLDKVLKKISARQIAKAASPIDQFRYALQQGNEMGVKELDSLMTLISEKKRQMEQQESETNMQILLVFLHCLRKQKLEELNEIQTDLQYIKEDISAVERHRLELHRTKERYSMKLRVLLDDPAAQKMWPSPIEKASSLFLPNPRTPLSASCPGSLQNKKLDLKAQVSHQGFQRRDALTCSDPPNSPIQSGNVIARKRRVQAQFNELQEYYLQRRRTGAQSRRQEERDIVAMNREGYHAGLQDFQSVLTTFTRYSRLRVIAELRHGDLFHSANIVSSIEFDRDDELFATAGVSKRIKVFEFSSVVNEPSDVHCPVVEMATRSKLSCLSWNKYSKNVIASSDYEGIVTVWDVQTRQSVMEYEEHEKRAWSVDFSRTEPSMLVSGSDDCKVKVWCTKQEASVINIDMKANICSVKYNPGSNFYVAVGSADHHIHYFDLRNPSAPVHIFGGHKKAVSYVKFLSNNELASASTDSTLRLWDVKDNCPVRTFRGHKNEKNFVGLSVNNEYIACGSETNEVFVYHKAISKPAASHRFVSSDLDDADDDPGSYFISAVCWKSDSPTMLTANSQGTIKVLVLAP

SEQ ID NO: 5451 - protein, 693 aa, Panicum virgatum
MGDSSVAGALVPSVPKPEAAPSGDASTAAAATTAALALAEEAGTRAASASPQGPAAEGEGPADRDLLCPICMAVIKDAFLTACGHSFCYMCIVTHLSHKSDCPCCGHYLTKAQLYPNFLLDKVLKKISARQIAKTVSPIDQFRYALQQGNEMGVKELDSLMTLIAEKKRQMEQQESETNMQILLVFLHCLRKQKLEELNEIQTDLQYIKEDIGAVERHRLELYRTKERYSMKLRMLLDDSAAQKLWPSPIDKASSLFLPNSRTPLSASCPGSLQNKKLDLKAQVSHQGFQRRDALTCSELPNSTIQSGNVIARKRRVQAQFNELQEYYLQRRRTGAQSLRQEERDIVAMNREGYHAGLQNFQSVLTTFTRYSRLRVIAELRHGDLFHSVNIVSSIEFDRDDELFATAGVSKRIKVFEFSSVVNEPSDVHCPVVEMATRSKLSCLSWNKYSKNVIASSDYEGIVTVWDVQTRQSVMEYEEHEKRAWSVDFSRTEPSMLVSGSDDCKVKVWCTKQEASVINIDMKANICSVKYNPGSSFYVAVGSADHRIHYFDLRNPSAPVHVFDGHKKTVSYVKFLSNNELASASTDSTLRLWDVKDNCPVRTFRGHKNEKNFVGLSVNNEYIACGSETNEVFVYHKAISKPAASHRFISSDLDDADDDPGSYFISAVCWKSDSPTMLTANSQGTIKVLVLAP

SEQ ID NO: 5452 - protein, 686 aa, Zea mays
MGDSSVAGALVPSVPKPETAPSGDNSTAALALPEEAGTRAASASPQGPAEEEGPADRDLLCPICMAVIKDAFLTACGHSFCYMCVVTHLSNKSDCPCCGHYLTKAQLYPNFLLDKVLKKISARQIAKTASPVDQFRCALQQGNEMGVKELDSLMTLIAEKKRQMEQQESETNMQILLVFLHCLRKQKLEELNEIQSDLQYIKEDISAVERHRVELYRTKERYSMKLRMLLDEPTAQKMWPSPMDKASCRFPPNSRTPLGGSCPGTLQNKKLDPKAQVSHQGFQRRDALTSSDPPNSSIQSGNVIARKRRVQAQFNELQEYYLQRRRTGAQARRQEERETVAMNREGYHAGLQDFQSVLTTFTRYSRLRVIAELRHGDLFHSANIVSSIEFDRDDELFATAGVSKRIKVFEFSTVVNEPSDVHCPVVEMATRSKLSCLSWNKYSKNIIASSDYEGIVTVWDVQTRQSVMEYEEHEKRAWSVDFSRTEPSMLVSGSDDCKVKVWCTKQEASVINIDMKANICSVKYNPGSSFYVAVGSADHHIHYFDLRNPSAPVHVFGGHKKAVSYVKFLSNNELASASTDSTLRLWDVKDNLPVRTFRGHKNEKNFVGLSVNNEYIACGSETNEVFVYHKAISKPAASHRFVSSDLDDADDDPGSYFISAVCWKSDSPTMLAANSQGTIKVHVLAP

SEQ ID NO: 5453 - protein, 712 aa, Secale cereale
AIIPPSHPAAAPPPPHPHGRLLGRPRRRARAVGAQAGARAVRGGRGGPAPGPGGGGDGRRVRGRGRLAVDVAGGAAAEGAEAQGDRDLLCPICMGLIKDAFLTACGHSFCYMCIVTHLNHKSDCPCCANYLTKAQLYPNFLLDKVVKKMSARQVAKTASPIDQFRHVVQQGNDMTVKELDSLMTLIAEKKRQMEQQESETNMQILLVFLHCLRKQKLEELNEIQTDLQYIKDDISSVERHRLDLHRTKERYSMRLRMLLDEPAASKMWPSPMDKPSSPFVPNSRAPPSTSSPGGLNNRRFDLRAPAIHQGHQRRDALASSDPPNPPIQSANVIARKRRVQAQFNELQEYYLQRRRTGAQSHRQEDVTMNREGYHEGLEDFQSVLTTFTRYSRLRVIAELRHGDLFHSANIVSSIEFDRDDELFATAGVSKRIKVFEFSTVVNEPSDVHCPVVEMATRSKLSCLSWNKYSKNVIASSDYEGIVTVWDVQTRQSVMEYEEHEKRAWSVDFSRTEPKMLVSGSDDCKVKVWCTNQEASAINIDMKANICSVKYNPGSSYYVAVGSADHHIHYFDLRNPSAPLHVFGGHKKAVSYVKFLSNNELASASTDSTLRLWDVKDNLPLRTFRGHKNEKNFVGLSVNNEYIACGSETNEVFVYHKAISKPASSHRFLSTDLDDAEDDPGSYFISAVCWKSDSPTMLTANSQGTIKVLVLAP

SEQ ID NO: 5454 - protein, 653 aa, Avena sativa
RRRRPRRGEQQDEEDGDGAEAAAAADRELLCPICMALIKDAFLTACGHSFCYMCIVTHLTHKSDCPCCSNYLTKAQLYPNFLLDKVLKKMSARQVAKTASPIEQLRHVVQQGNDMSVKELDSLMTLIAEKKRQMEQQESETNMQILLVFLHCLRKQKLDELNEIQTDLQYIKDDINSVERHRLDLYRTKERYSMKLRMLLDEPAASKMWPSPMDKPSSLFLPNSRAPLNASSPGGLNNRKLDLRGQVSHQGYQRRDALACPDPPNPPIQSSNVIARKRRVQAQFNELQEYYLQRRRTGAQSRRQEDVTMNREGYHEGLEDFQSVLTTFTRYSRLRVIAELRHGDLFHTANIVSSIEFDRDDELFATAGVSKRIKVFEFSTVVNEPSDVHCPVVEMATRSKLSCLSWNKYSKNIIASSDYEGIVTVWDVQTRQSVMEYEEHEKRAWSVDFSRTEPSMLVSGSDDCKVKVWCTKQEASAINIDMKANICSVKYNPGSSYYVAVGSADHHIHYFDLRNPSAPLHVFGGHKKAVSYVKFLSNNELASASTDSTLRLWDVKDNCPVRTFRGHKNEKNFVGLSVNNEYIACGSETNEVFVYHKAISKPASSHRFVSSDLDDADDDPGSYFISAVCWKSDSPTMLTANSQGTIKVLVLAP

SEQ ID NO: 5455 - protein, 628 aa, Triticum aestivum
RDLLCPICMALIKDAFLTACGHSFCYMCIVTHLNHKSDCPCCANYLTKAQLYPNFLLDKVVKKMSARQVAKTASPIDQFRHVVQQGNDMTVKELDSLMTLIAEKKRQMEQQESETNMQILLVFLHCLRKQKLEELNEIQTDLQYIKDDISSVERHRLDLYRTKERYSMRLRMLLDEPAASKMWPSPMDKPSSPFVPNSRAPPSTSSPGGLNNRRFDLRAPASHQGHQRRDALASSDPPNPPIQSGNVIARKRRVQAQFNELQEYYLQRRRTGAQSHRQEDVVTMNREGYHEGLEDFQSVLTTFTRYSRLRVIAELRHGDLFHSANIVSSIEFDRDDELFATAGVSKRIKVFEFSTVVNEPSDVHCPVVEMATRSKLSCLSWNKYSKNVIASSDYEGIVTVWDVQTRQSVMEYEEHEKRAWSVDFSRTEPKMLVSGSDDCKVKVWCTNQEASAINIDMKANICSVKYNPGSSYYVAVGSADHHIHYFDLRNPSAPLHVFGGHKKAVSYVKFLSNNELASASTDSTLRLWDVKDNCPLRTFRGHKNEKNFVGLSVNNEYIACGSETNEVFVYHKAISKPASSHRFLSTDLDDAEDDPGSYFISAVCWKSDSPTMLTANSQGTIKVLVLAP

SEQ ID NO: 5456 - protein, 635 aa, Festuca arundinacea
AAASTPDRELLCPICITLIKDAFLTACGHSFCYMCIVTHLTHKSDCPCCSNYLTKAQLYPNFLLDKVLKKMSARQVAKTASPIDQLRHVVQQGNDMSVKELDNLMTLIAEKKRQMEQQESETNMQILLVFLHCLRKQKLDELNEIQTDLQYIKDDISSVERHRLDLYRTKERYSMKLRMLLDEPAASKMWPSPMDKPSSPFLPNSRAPLNASSPGGLNNRKHDLRAQVSQQGYQRRDALVCPDPPNPPIQSGNVIARKRRVQAQFNELQEYYLQRRRTGGQSRRQDDIVAMNREGYHEGLEDFQSVLTTFTRYSRLRVIAELRHGDLFHTANIVSSIEFDRDDELFATAGVSKRIKVFEFSTVVNEPSDVHCPVVEMATRSKLSCLSWNKYSKNIIASSDYEGIVTVWDVQTRQSVMEYEEHEKRAWSVDFSRTEPSMLVSGSDDCKVKVWCTKQEASAINIDMKANICSVKYNPGSSYFVAVGSADHHIHYFDLRNPSAPLHVFGGHKKAVSYVKFLSNNELASASTDSTLRLWDVKDNCPVRTFRGHKNEKNFVGLSVNNEYIACGSETNEVFVYHKAISKPASSHRFVSSDLDDAEDDPGSYFISAVCWKSDSPTMLTANSQGTIKVLVLAP

SEQ ID NO: 5457 - protein, 483 aa, Sorghum bicolor
MGSTGRDPEVTRADFPDGFVFGVATSAYQIEGARREGGKGDSIWDVFTDDKERVLDKSNAEIAVDHYHRYKEDIELMASLGFSAYRFSISWARIFPDGLGEKVNEQGVAFYNDLINFMISKGIEPYATLYHWDLPNNLQKTLGGWISDKIVEYFALYAEACFANFGDRVKRWITINEPLQTAINGYGIGIFAPGGCQGETARCYLAAHHQILAHAAAVDVYRRKFKAAQGGEVGFVVDCEWAEPFSEKAEDQIAAQRRIDFQLGWYLDPIYFGDYPESMRQRLGSDLPTFSEKDKEFIRNKIDFIGLNHYTSRLIAHHQNPDDVYFYQVQQMERIEKWNSGEKIGERAASEWLFIVPWGLRKVLNYIVKKYNNPVIYITENGMDDEDDQSATLDQVLNDTTRVGYFKGYLNSVAQAIKDGADIRGYFAWSFLDNFEWAMGYTKRFGIVYVDYKNGLSRHPKASALWFSRFLKGEAAENKPDTN

SEQ ID NO: 5458 - protein, 480 aa, Zea mays
MGSTGREPEVTRADFPDGFVFGVATSAYQIEGARREGGKGDSIWDVFTDDKEHVLDRSNGEIAVDHYHRYKEDIELMASLGFSAYRFSISWARIFPDGLGGKVNDQGVAFYNDLINFMISKGIEPYATLYHWDLPNNLQKTLGGWISDKIVEYFALYAEACFANFGDRVKHWITINEPLQTAINGYGIGIFAPGGCQGETARCYLAAHHQILAHAAAVDVYRRKFKAAQGGEVGLVVDCEWAEPFSENVEDQIAAQRRLDFQLGWYLDPIYFGDYPESMRQRLGSDLPTFSEKDKEFMRNKIDFVGVNHYTSRLIAHLQNPNDVYFYQVQQMERIEKWNSGEKIGERAASEWLFIVPWGLHKSLNYIAKKYNNPAIYVTENGMDEEDDQSATLDQVLNDTTRVGYFKGYLNSVAQAIKDGADVRGYFAWSFLDNFEWAMGYTKRFGIVYVDYKNGLSRHPKASALWFSRLLRGEAGTGTS

SEQ ID NO: 5459 - protein, 480 aa, Echinochloa colona
MGSTGREAEVARADFPDGFVFGVATSAYQIEGARREGGKGDSIWDVFTEDKERVLDKSNADVAVDHYHRYKEDIELMASLGFGAYRFSISWARIFPDGLGEKVNEQGVAFYNDLINFMISKGIEPYATLYHWDLPNNLQKTLGGWLSDKIVDYFALYAEACFANFGDRVKRWITINEPLQTAVNGYGIGVFAPGGCEGETARCYLAAHHQILAHAAAVDVYRRKFKAAQGGEVGLVVDCEWAEPFSDKVEDQIASQRRIDFQLGWYLDPIYFGDYPESMRERLGSDLPTFSEKDKEFIRNKIDFVGLNHYTSRFIAHHQNPEDIYFYQVQQVERIEKWNSGEKIGERAASEWLFIVPWGLHKLLNYIAKKYNNPAIYVTENGMDEEDDQSATLEEVLNDTTRVGYFKGYLSSVAQAIKDGADVRGYFAWSFLDNFEWAMGYTKRFGIVYVDYKNGLSRHPKASALWFSRFLKGEAAENKS

SEQ ID NO: 5460 - protein, 483 aa, Setaria italica
MGSTGGEAEVARADFPDGFVFGVATSAYQIEGARREGGKGDSIWDVFTEDKERVLDRSNGDVAVDHYHRYKEDIELMASLGFAAYRFSISWARIFPDGLGGKVNEQGVAFYNNLINFMIAKGIEPYATLYHWDLPNHLQKTLGGWLSDKIVDYFALYAEACFANFGDRVKRWITINEPLQTAFNGYGIGVFAPGGCEGETARCYLAAHHQILAHAAAVDVYRRKFKVAQGGEVGLVVDCEWAEPFSEKVEDQIAAQRRIDFQLGWYLDPIYFGDYPESMRQRLGSDLPTFSEKDKEFIRNKIDFVGLNHYTSRFIAHHQNPEDIYFYQVQQVERIEKWNSGEKIGERAASEWLFIVPWGLRKVLNYVAKKYNNPTIYVTENGMDEEDDQSATLDQVLNDTTRVGYFKGYLASVAQAIKDGADVRGYFAWSFLDNFEWAMGYTKRFGIVYVDYKNGLSRHPKASALWFSRFLKGEAAENKADTN

SEQ ID NO: 5461 - protein, 483 aa, Setaria italica
MGSTGGEAEVARADFPDGFVFGVATSAYQIEGARREGGKGDSIWDVFTEDKERVLDRSNGDVAVDHYHRYKEDIELMASLGFAAYRFSISWARIFPDGLGGKVNEQGVAFYNNLINFMIAKGIEPYATLYHWDLPNHLQKTLGGWLSDKIVDYFALYAEACFANFGDRVKRWITINEPLQTAFNGYGIGVFAPGGCEGETARCYLAAHHQILAHAAAVDVYRRKFKVAQGGEVGLVVDCEWAEPFSEKVEDQIAAQRRVDFQLGWYLDPIYFGDYPESMRQRLGSDLPTFSEKDKEFIRNKIDFVGLNHYTSRFIAHHQNPEDIYFYQVQQVERIEKWNSGEKIGERAASEWLFIVPWGLRKILNYIAKKYNNPTIYVTENGMDEEDDQSATLDQVLNDTTRVGYFKGYLASVAQAIKDGADVRGYFAWSFLDNFEWAMGYTKRFGIVYVDYKNGLSRHPKASALWFSRFLKGEAAENKADTN

SEQ ID NO: 5462 - protein, 483 aa, Oryza sativa
MGSTGRDAEVTRGDFPDGFVFGVATSAYQIEGARREGGKGDNIWDVFTENKERILDGSSGEVAVDHYHRYKEDIELMASLGFRAYRFSISWPRIFPDGLGKNVNEQGVAFYNDLINFMIEKGIEPYATLYHWDLPHNLQQTVGGWLSDKIVEYFALYAEACFANFGDRVKHWITINEPLQTAVNGYGIGHFAPGGCEGETARCYLAAHYQILAHAAAVDVYRRKFKAVQGGEVGLVVDCEWAEPFSEKTEDQVAAERRLDFQLGWYLDPIYFGDYPESMRQRLGDDLPTFSEKDKEFIRNKIDFVGINHYTSRFIAHHQDPEDIYFYRVQQVERIEKWNTGEKIGERAASEWLFIVPWGLRKLLNYAAKRYGNPVIYVTENGMDEEDDQSATLDQVLNDTTRVGYFKGYLASVAQAIKDGADVRGYFAWSFLDNFEWAMGYTKRFGIVYVDYKNGLSRHPKASARWFSRFLKGDDAENKADMN

SEQ ID NO: 5463 - protein, 470 aa, Echinochloa colona
MGSTGREAEVARADFPDGFVFGVATSAYQIEGARREGGKGDSIWDVFTEDKERVLDKSNADVAVDHYHRYKEDIDLMASLGFGAYRFSISWARIFPDGMGEKINEQGVAFYNDLINFMISKGIEPYATLYHWDLPNNLQKTLGGWLSDKIVDYFALYAEACFANFGDRVKRWITINEPLQTAVNGYGIGVFAPGGCEGETARCYLAAHHQILAHAAAVDVYRRKFKAAQGGEVGLVVDCEWAEPFSDKVEDQIASQRRIDFQLGWYLDPIYFGDYPESMRERLGSDLPIFSEKDKEFIRNKIDFVGLNHYTSRFIAHHQNPEDIYFYQVQQVERIEKWNSGEKIGERAASEWLFIVPWGLHKLLNYIAKKYDNPAIYVTENGMDEEDDQSATLEQVLNDTTRVGYFKGYLASVAQAIKDGADVRGYFAWSFLDNFEWAMGYTKRFGIVYVDYKNGLSRHLKHRPCGSHAS

SEQ ID NO: 5464 - protein, 489 aa, Brachypodium distachyon
MGSTGRDEEAVAAAEVTRADFPEGFIFGVATSAYQIEGARKEGGKGDSIWDVFADNKEHILDGTSGEVAVDHYHRYKEDIELMAKLGFGAYRFSISWSRIFPDGLGKEINEQGVAFYNNLIDFMIEKGIQPYATLYHWDLPHNLQQTMGGWLSDKIVEYFALYAEACFANFGDRVKHWMTINEPLQTSVNGYGIGIFAPGVCEGAAAEPFLAAHHQILAHAASVDVYRRKFKAVQGGQVGFVIDCEWAEPFSDKMEDQAAAARRIDFQLGWYLDPIYFGDYPESMRQRLGDHLPKFSEKERELIRNKIDFIGLNHYTSRFIAHQQDPQAIHFYQVQQMERIEKWNTGEGIGERAASEWLLIVPWGLRKAINYIVKKYNNPVIYVTENGMDDEDDQSAPLDQVLNDTKRVGFFKGYVGAVAQAIKDGADIRGYFAWSFLDNFEWAMGYTKRFGLVYVDYKDGLSRHPKASAMWFSRFLNGEAADIKPDTN

SEQ ID NO: 5465 - protein, 143 aa, Sorghum bicolor
MALAAIYNLFIINKSGGLIYYKDYGSAGRMDTNDSLRLASLWHSMHAISQQLSPTPGCNGIDLLQAHNFDLHCFQSLTGTKFFVVCETGAPNMEMLLKVIYELYTDFVLKNPFYEMEMPIRCELFDHNLAQVIQKDRVALLGR

SEQ ID NO: 5466 - protein, 143 aa, Zea mays
MALAAIYNLFIINKSGGLIYYKDYGSAGRMDTNDSLRLASLWHSMHAISQQLSPTTGCTGIDLLQAHNFDLHCFQSLTGTKFFVVCETGAPNMEMLLKAIYELYTDFVLKNPFYEMEMPIRCELFDHNLAQVIQKDRVALLGR

SEQ ID NO: 5467 - protein, 143 aa, Panicum virgatum
MALAAIYSLFIINKSGGLIYYKDYGSAGRMDTNDSLRLASLWHSMHAISQQLSPTPGCTGIDLLQAHNFDLHCFQSLTGTKFFVVCETGAPNMEMLLKVIYELYTDFVLKNPFYEMEMPIRCELFDLNLAQVIQKDRVALLGR

SEQ ID NO: 5468 - protein, 143 aa, Setaria italica
MALAAIYSLFIINKSGGLIYYKDYVSAGRMDTNDSLRLASLWHSMHAISQQLSPTPGCTGIDLLQAHNFDLHCFQSLTGTKFFVVCETGAPNMEMLLKVIYELYTDFVLKNPFYEMEMPIRCELFDLNLAQLIQKDRVALLGR

SEQ ID NO: 5469 - protein, 143 aa, Saccharum officinarum
MALAAIYNLFIINKSGGLIYYKDYGSAGRMDTNDSLRLASLWHSMHAISQQLSPTPGCTGIDLLQAHNFDLHCFQSLTGTKFFVVCETGAPNMEMLLKVIYELYTDSVLKNPFYEMEMPIRCELFDHNLAHVIQKDRVALLCR

SEQ ID NO: 5470 - protein, 143 aa, Echinochloa colona
MALAAIYSLFIINKSGGLIYYKDYGSAGRMDTNDSLRLASLWHSMHAISQQLSPIPGCTGIDLLQAHNFDLHCFQSLTGTKFFAVCETGAPNMEMLLKVIYELYTDFVLKNPFYEMEMPIRCELFDLNLAQVIQKDRVALLGR

SEQ ID NO: 5471 - protein, 143 aa, Pennisetum glaucum
MALAAIYSLFIINKSGGLIYYKDYGSSGRMDTNDSLRLASLWHSMHAISQQLSPIPGCTGIDLLQAHNFDLHCFQSLTGTKFFVVCETGAPNMEMLLKVIYELYTDFVLKNPFYEMEMPIRCELFDLNLAQVIQKDRVALLGR

SEQ ID NO: 5472 - protein, 143 aa, Panicum virgatum
MALAAIYSLFIINKSGGLIYYKDYGSAGRMDTNDSLRLASLWHSMHAISQQLSPTPGCNGIDLLQAHNFDLHCFQSLTGTKFFVVCETGAPNMEMLLKVIYELYTDFVSKNPFYEMEMPIRCELFDLNLAQVIQKDRVALLGR

SEQ ID NO: 5473 - protein, 143 aa, Setaria italica
MALAAIYSLFIINKSGGLIYYKDYCSAGRMDTNDSLRLASLWHSMHAISQQLSPIPGCTGIDLLQAHNFNLHCFQSLTGTKIFVVCETGAQNMETLLKVIYELYTDFVLKNPFYEMEMPIRCELFDLNLAQVIQKDRVALLGR

SEQ ID NO: 5474 - protein, 143 aa, Panicum virgatum
MAQAAIYSLFIINKSGGLIYYKDYGSAGRMDTNDSLRLASLWHSMHAISQQLSPIPGCTGIDLLQAHNFDLHCFQSLTGTKFFVVCETGAQNMETLLKAIYELYTDFVLKNPFYEMEMPIRCELFDLNLAQVIQKDRLALLGR

SEQ ID NO: 5475 - protein, 143 aa, Oryza sativa
MALAAIYSLFIINKSGGLIYYKDYGSAGRTDTNDSLRLASLWHSMHAISQQLSPTPGCEGIDLLQAHNFDLHCFQSLTGTKFFAVCETGAQNIETLLKVIYELYTDFVLKNPFYEMEMPIRCELFDLNLAQVIQKDRVTLLGR

SEQ ID NO: 5476 - protein, 101 aa, Panicum virgatum
MAQAAICSLFIINKSGGLIYYKEYGSAGRMDTNDSLRLASLWHSMHAISQQLSPIPGCTGIDLLQAHNFDLHCFQSLTGTKIFCCMRNRRAKYGDSAESNI

SEQ ID NO: 5477 - protein, 143 aa, Hordeum vulgare
  Sequence also found in Organisms: Brachypodium distachyon
MGTVAIYSLFIINKSGGLIYYKDYGSAGRMDTNDSLRLASLWHSMHAISQQLSPTTGCTGIDLLQAHNFDLHCFQSLTGTKFFVVCETGAQNMEILLKTIYELYTEFVLKNPFYEMEMPIRCELFDLNLAQVIQKDRVALLGR

SEQ ID NO: 5478 - protein, 143 aa, Avena sativa
MGTVAIYSLFIINKSGGLIYYKDYGSAGRMDTNDSLRLASLWHSMHAISQQLSPTTGCTGIDLLQAHNFDLHCFQSLTGTKFFVVCETGAQNMEILLKTIYELYTEFVLKNPFYEMEMPIRCELFDLNLAQVIQKDRVALMGR

SEQ ID NO: 5479 - protein, 143 aa, Oryza sativa
MASAAIYSLFIINKSGGLIYYKDYGSAGRTDTNDSLRLASLWHSMHAISQQLSPTHGCEGIDLLQAHNFDLHCFQSLTGTKFFAVCETGAQNIETLLKVIYELYTDFVLKNPFYEMEMPIRCELFDLNLAQVIQKDRVTLLGR

SEQ ID NO: 5480 - protein, 143 aa, Secale cereale
  Sequence also found in Organisms: Triticum aestivum
MGTVAIYSLFIINKSGGLIYYKDYGSAGRMDTNDSLRLASLWHSMHAISQQLSPTTGCTGIDLLQAHNFDLHCFQSLTGTKFFVVCETGAQNMEILLKTIYELYTEFVLKNPFYEMEMPIRCELFDLNLAHVIQKDRVALLGR

SEQ ID NO: 5481 - protein, 143 aa, Festuca arundinacea
MATVAIYSLFIINKSGGLIHYKDYGSAGRMDTNDSLRLASLWHSMHAISQQLSPTPGCNGIDLLQAHNFDLHCFQSLTGTKFFVVCEKGAPNMELLLRAIYELYTEFALKNPFYEMEMPIRCELFDFNLAQVIQKDRVALLGR

SEQ ID NO: 5482 - protein, 143 aa, Lolium multiflorum
MGTVAIYSLFIINKSGGLIYYKDYGSAGRMDTNDSLRLASLWHSMHAISQQLSPTTGCTGIDLLQANNFDLHCFQSLTGTKFFVVCETGAQNMEILLKTIYELYTEFVLKNPFYEMEMPIRCELFDLNLAQVIQKDRVALMGR

SEQ ID NO: 5483 - protein, 143 aa, Triticum aestivum
MGTVAIYSLFIINKSGGLIYYKDYGSAGRMDTNDSLRLASLWHSMHAISQQLSPTTGCTGIDLLQAHNFDLHCFQSLTGTKFFVVCETGTQNMEILLKTIYELYTEFVLKNPFYEMEMPIRCELFDLNLAHVIQKDRVALLGR

SEQ ID NO: 5484 - protein, 143 aa, Avena sativa
MGTVAIYSLFIINKSGGLIYYKDYGSAGRMDTNDTLRLASLWHSMHAISQQLSPTLGCNGIDLLQAQNFDLHCFQSLTGTKFFVVCETGAQNMEILLRTIYELYTDFVLKNPFYEMEMPIRCELFDVNLAQVIQKDRVALLGR

SEQ ID NO: 5485 - protein, 143 aa, Avena sativa
MGTVAIYSLFIINKSGGLIYYKDYGSAGRMDTNDTLRLASLWHSMHAISQQLSPTLGCNGIDLLQAHNFDLHCFQSITGTKFFVVCETGAQNMEILLRTIYELYTDFVLKNPFYEMEMPIRCELFDVNLAQVIQKDRVALLGR

SEQ ID NO: 5486 - protein, 143 aa, Avena sativa
MGTVAIYSLFIINKSGGLIYYKDYGSAGRMDTNDSLRLASLWHSMHAISQQLSPTTGCTGIDLLQAHNFDLHCFQSLTGTKFFVVCEIGAQNMEILLKTIYELYTEFVLKNPFYEMEMPIRCELFDLNLAQVIPKDRVALMGR

SEQ ID NO: 5487 - protein, 143 aa, Secale cereale
MGTVAIYSLFIINKSGGLIYYKDYGSAGRMDTNDSLRLASLWYSMHAISQQLSPTTGCTGIDLLQAHNFDLHCFQSLTGTKFFVVCETGTQNMEILLKTIYELYTEFVLKNPFYEMEMPIRCELFDLNLAHVIQKDRVALLGR

SEQ ID NO: 5488 - protein, 96 aa, Avena sativa
MGTVAIYSLFIINKSGGLIYYKDYGSAGRMDTNDTLRLASLWHSMHAISQQLSPTLAVMALTSYKLTTLISIVSNLSQGQSFSLYAKQAPRTWRFC

SEQ ID NO: 5489 - protein, 143 aa, Avena sativa
MGTVAIYSLFIINKSGGLIYYKDYGSAGRMDTNDTLRLASLWHSMHAISQQLSPTLGCNGIDLLQAHNFDLHCFQSITGTKFFVVCETGAQNMEILLRTIYELYTDFVLKNPFYEMEMPIRCELFDLNLAQVIQKDRVALMGR

SEQ ID NO: 5490 - protein, 141 aa, Musa acuminata
MAAIYSLFIINKSGGLIFYKDYGSAGRMDTNDSLRLASLWHSMHAISQQLSPTTGCAGIELLQAHTFDLHCFQSLTGTKFFVVCEPGTLHMEALLKVIYELYTDYVLKNPFYEMEMPIRCELFDLNLSQVIQKDRVALLGR

SEQ ID NO: 5491 - protein, 142 aa, Aquilegia formosa
MAAAIYSLFIINKSGGLIFYKDYGSTGRMDTNDSLRLASLWHSMHAISQQLSPTVGCSGIELLQADTFDLHCFQSLTGTKFFVVCEPGAQHMESLLKVIYGLYTDYVLKNPFYEMEMPIRCELFDLNLSQATQKDRVALLGR

SEQ ID NO: 5492 - protein, 141 aa, Ananas comosus
MAAIYSLFIINKSGGLIFYKDYGSAGRMDTNDSLRLASLWHSMHAISQQLSPIVGCTGIELLQADTFDLHCFQSLTGTKFFVVCEPGTQHMEVLLKVIYELYTDYVLKNPFYEMEMPIRCELFDLNLSQAIQKDRVSLLGR

SEQ ID NO: 5493 - protein, 141 aa, Elaeis guineensis
MAAIYSLFIINKSGGLIFYKDYGSAGRMDTNDSLRLASLWHSMHAISQQLSPTLGCNGIELLQADTFDLHCFQSLTGTKFFVVCEPGAQHMEGLLKVIYELYTDYVLKNPFYEMEMPIRCELFDMNLSQAIQKDRVSLFGR

SEQ ID NO: 5494 - protein, 94 aa, Lippia dulcis
MAAIYSLYIINKSGGLIFYKDYGSAGRMDTNDSLRLASLWHSMHAISQQLSPVSGCSGIELLQADTFDLHCFQSLTGTNSLWCVSQEHRIWRVC

SEQ ID NO: 5495 - protein, 141 aa, Cocos nucifera
MAAIYSLFIINKSGGLIFYKDYGSAGRMDTNDSLRLASLWHSMHAISQQLSPTLGCNGIELLQADTFDLHCFQSLTGTKFFVVCEPGTQHMEGLLKVIYELYTDYVLKNPFYEMEMPIRCELFDMNLSQAIQKDRVSLFGR

SEQ ID NO: 5496 - protein, 142 aa, Zostera marina
MAAAINCLFIINKSGGLIFYKDCGSAGRMDTNDSLRLASLWHSMHAISQQLSPVNGCSGIQLLQADTFDLHCFQSLTGTKFFVVSEPGAQHMEPLLKVIYELYTDYVLKNPFYEMEMPIRCELFDINLSQAIQRDRVALLGR

SEQ ID NO: 5497 - protein, 141 aa, Allium cepa
MAAIYSLFIINKSGGLIFYKDYGSTGRMDTNDSLRLASLWHSMHAISQQLSPVVGCNGIELLQADNFDLHCFQSLTGTKFFVVCEPGTPQMENLLKLIYELYTDYVLKNPFYEMEMPIRCELFDLHLSQAIQKDRVSLLGR

SEQ ID NO: 5498 - protein, 141 aa, Amsonia hubrichtii
MAAIYSLYIINKSGGLIFYKDYGSAGRMDTNDSLRLASLWHSMHAISQQLSPVTNCTGIELLQADSFDLHCFQSLTGTKFFVVCEPGTQHMESLLKHTYELYTDFVLKNPFYEMEMPIRCELFDINLAQAVQKDRVALLGR

SEQ ID NO: 5499 - protein, 141 aa, Aristolochia fimbriata
MAAIYSLFIINKSGGLIFYKDYGSAGRMDTNDSLRVASLWHSMHAISQQLSPMAGCTGIELLEADTFDLHCFQSLTGTKFFVVCEPGSLHMGALLKHIYELYTDFVLKNPFYEMEMPIRCELFDLNLAQAIQKDRVALMGR

SEQ ID NO: 5500 - protein, 141 aa, Manihot esculenta
MAAIYSLYIINKSGGLIFYKDYGSAGRMDTNDSLRVASLWHSMHAISQQLSPTVGCSGIELLEADTFDLHCFQSLTGTKFFVVCEPGTSHMEGLLKVIYELYTDYVLKNPFYEMEMPIRCELFDINLTQAIQKDRVALLGR

SEQ ID NO: 5501 - protein, 141 aa, Vitis vinifera
MAAIYSLYIINKSGGLIFYKDYGSAGRMDTNDSLRLASLWHSMHAISQQLSPTLGCSGIELLEADTFDLHCFQSLTGTKFFVVCEPGTQHMEGLLKVIYELYTDYVLKNPFYEMEMPIRCELFDINLSQAVQKDRVALLGR

SEQ ID NO: 5502 - protein, 142 aa, Papaver somniferum
MAAAIYSLFIINKSGGLIFYKDYGSAGRMDTNDSLRLASLWHSMHAISQQLSPVLGCQGIELLEADTFDLHCFQSLTGTKFFVVCEPGTQHMDTLLKIIYELYTDYVLKNPFYEMEMPIRCELFDINLIQGIQKDGVALLGR

SEQ ID NO: 5503 - protein, 141 aa, Sesamum indicum
MAAIYSLYIINKSGGLIFYKDYGSAGRMDTNDSLRLASLWHSMHAISQQLSPVSGCSGIELLQADTFDLHCFQSLTGTKFFVVCEPGTLHMENLLKHIYELYTDYVLKNPFYEMEMPIRCELFDINLAQAVQKDRVALLGR

SEQ ID NO: 5504 - protein, 141 aa, Tabernaemontana elegans
MAAIYSLYIINKSGGLIFYKDYGSAGRMDTNDSLRLASLWHSMHAISQQLSPVPNCSGIELLQADTFDLHCFQSLTGTKFFVVCEPGIQHMEGLLKHIYELYTDYVLKNPFYEMEMPIRCELFDINLAQAVQKDRVALLGR

SEQ ID NO: 5505 - protein, 141 aa, Citrullus lanatus
MAAIYSLYIINKSGGLIFYKDYGSAGRMDTNDSLRVASLWHSMHAISQQLSPIAGCSGIELLEADTFDLHCFQSLTGTKFFVVCEPGAQHMEGLLKYIYELYTDFVLKNPFYEMEMPIRCELFDINLAQAVQKDRVALLGR

SEQ ID NO: 5506 - protein, 119 aa, Amorphophallus konjac
MAAGPASNAAIYSLFIINKSGGLIFYKDYGSAGRMDTNDSLRLASLWHSMHAISQQLSPHAGCTGVELLQADTFDLHCFQSLTGTKFFCVCEPGRQHMEALLKVIYELYTDYVLKNPFL

SEQ ID NO: 5507 - protein, 81 aa, Allium cepa
MAAIYSLFIINKSGGLIFYKDYGSTGRMDTNDSLRLASLWHSMHAISQQLSPVVGCNGIELLQADNFDLHCFNHLQEQNSL

SEQ ID NO: 5508 - protein, 108 aa, Papaver somniferum
MAAAIYSLFIINKSGGLIFYKDYGSAGRMDTNDSLRLASLWHSMHAISQQLSPVLGCQGIELLEADTFDLHCFQSLTGTKFFVVCEPGTQHMDALLKIIYELYTDYVL

SEQ ID NO: 5509 - protein, 151 aa, Tripterygium wilfordii
MAAIYSLYIINKSGGLIFYKDYGSAGRMDTNDSLRVASLWHSMHAISQQLSPTVGCSGIELLEADTFDLHCFQSLTGTKFFVVCEPGTPHMESLLKVIYELYTDYVLKNPFYEMEMPIRCELFDIHLTQAIHEGLVLPCWGDKFTDSEYCC

SEQ ID NO: 5510 - protein, 94 aa, Utricularia gibba
QAAIYSLYIINKSGGLIFYKDYGSAGRMDTNDSLRLASLWHSMHAISQQLSPVSGCSGIELLQADTFDLHCFQSLTGTKFLWYASPVAFTWRAC

SEQ ID NO: 5511 - protein, 141 aa, Ricinus communis
MAAIYSLYIINKSGGLIFYKDYGSGGRMDTNDSLRVASLWHSMHAISQQLSPVVGCSGIELLQADTFDLHCFQSLTGTKFFVVCEPGTPHMEALLKVIYELYTDYVLKNPFYEMEMPIRCELFDINVTQIIQKDRVALLGR

SEQ ID NO: 5512 - protein, 141 aa, Petroselinum crispum
MPAIYSLYIINKSGGLIYYKDYGSAGRMDTNDSLRLASLWHSMHAISQQLSPVAGCTGIELLEADTFDLHCFQSLTGTKFFVVAEPGMQNMESLLKYIYELYTDYVLKNPFYEMEMPIRCELFDINLSQAVQKDRVALLGR

SEQ ID NO: 5513 - protein, 141 aa, Gossypium hirsutum
  Sequence also found in Organisms: Gossypium raimondii
MAAIYSLYIINKSGGLIFYKDYGSKGRMDTNDSLRVASLWHSMHAISQQLSPINGCSGIELLEADTFDLHCFQSLTGTKFFVVCETGTQHMEALLKVIYELYTDYVLKNPFYEMEMPIRCELFDINLTQAIQKDRVALLGR

SEQ ID NO: 5514 - protein, 141 aa, Glycyrrhiza uralensis
MAAIYSLYIINKSGGLIYYKDYGSAGRMDTNDSLRVASLWHSMHAISQQLSPVSGCSGIELLQADTFDLHCFQSLTGTKFFVVCEPGTQQMESLLKFIYELYTDYVLKNPFYEMEMPIRCELFDINLTQAVQKDRVALLGR

SEQ ID NO: 5515 - protein, 141 aa, Mimulus guttatus
MAAIYSLYIINKSGGLIYYKDYGSAGRMDTNDTLRLASLWHSMHAISQQLSPVNGCSGIELLQADHFDLHCFQSLTGTKFFVVSEPGSVHMESLLKNIYELYTDYVLKNPFYEMEMPIRCELFDINLAQTVQKDRVALLGR

SEQ ID NO: 5516 - protein, 141 aa, Nicotiana benthamiana
MAAIYSLYIINKSGGLIFYKDYGSAGRMDTNDSLRLASLWHSMHAISQQLSPVNGCAGIELLQADNFDLHCFQSLTGTKFFVVCEPGSLHMESLLKYVYELYTDYVLKNPFYEMEMPIRCELFDINLSQAVQKDRVALLGR

SEQ ID NO: 5517 - protein, 141 aa, Elaeis guineensis
MAAIYSLFIINKSGGLIFYKDYGSAGRMDTNDSLRLASLWHSMHAISQQLSPTVGCNGIELLQADTFYLHCFQSLTGTKFFVVCEPGIQHMEGLLKVIYELYTDYVLKNPFYEMEMPIRCELFNLNLSQAIQKDRVSLFGR

SEQ ID NO: 5518 - protein, 142 aa, Arachis hypogaea
MAAAIYSLYIINKSGGLIYYKDYGSAGRMDTNDSLRVASLWHSMHAISQQLSPVSGCSGIELLQADTFDLHCYQSLTGTKFFVVCEPGTQHMESLLKYIYELYTDYVLKNPFYEMEMPIRCELFDINLTQAVQKDRVAFLGR

SEQ ID NO: 5519 - protein, 141 aa, Populus trichocarpa
MAAIYSLYIINKSGGLIFYKDYGSSGRMDTNDSLRVASLWHSMHAISQQLSPTVGCLGIELLEADTFDLHCFQSLTGTKFFVVCEPGTQHMEGLLKVIYELYTDYVLKNPFYEMEMPIRCELFDINLSQAIQKDRVALLGR

SEQ ID NO: 5520 - protein, 141 aa, Nicotiana tabacum
MAAIYSLYIINKSGGLIFYTDYGSAGRMDTNDSLRLASLWHSMHAISQQLSPVNGCAGIELLQADNFDLHCFQSLTGTKFFVVCEPGSLHMESLLKYIYELYTDYVLKNPFYEMEMPIRCELFDINLSQAVQKDRVALLGR

SEQ ID NO: 5521 - protein, 139 aa, Utricularia gibba
AIYSLYIINKSGGLIFYKDYGSAGRMDTNDSLRLASLWHSMHAISQQLSPVSGCSGIELLQADTFDLHCFQSLTGTKFFVVCEPGSLHMESLLKQIYELYTDYVLKNPFYEMEMPIRCELFDVNLAQAVQKDRVALLGR

SEQ ID NO: 5522 - protein, 94 aa, Amaranthus tuberculatus
MAAIYSLYIINKSGGLIFYKDYGSAGRMDTNDTLRLASLWHSMHAISQQLSPISGCSGIELLEADNFDLHCFQSLTGTKFFVVCEPGTHHMEHL

SEQ ID NO: 5523 - protein, 141 aa, Amaranthus tuberculatus
MAAIYSLYIINKSGGLIFYKDYGSAGRMDTNDTLRLASLWHSMHAISQQLSPISGCSGIELLEADNFDLHCFQSLTGTKFFVVCEPGTQHMEHLLKYIYELYSDYVLKNPFYEMEMPIRCELFDINLAQAVQKDRVALLGR

SEQ ID NO: 5524 - protein, 141 aa, Acacia harpophylla
MAAIYSLYIINKSGGLIYYKDYGSAGRMDTNDSLRVASLWHSMHAISQQLSPVSGCSGIELLQADTFDLHCFQSLTGTKFFVVCEPGTQHMESLLKFIYELYTDYVLKNPFYEVEMPIRCELFDINLSQAVQKDRVALLGR

SEQ ID NO: 5525 - protein, 142 aa, Aquilegia formosa
MTAAIYSLFIINKSGGLIFYKDYGSAGRMDTNDSLRLASLWHSMHAISQQLSPIVACSGIELLQADTFDLHCFQSLTGTKFFVVCEPGAQHMESLLKLIYELYTDYVLKNPFYEMEMPIRCELFDLNLSQATQKNHVALLGR

SEQ ID NO: 5526 - protein, 141 aa, Ocimum basilicum
MAAIYSLYIINKSGGLIFYKDYGSAGRMDTNDSLRLASLWHSMHAISQQLSPISGCSGIELLQADTFDLNCFQSLTGTKFFVVCEPGTLHMENLLKHIYELYTDYVLKNPFYEMEMPIRCELFDINLAQAVQKDRVAMLGR

SEQ ID NO: 5527 - protein, 141 aa, Vigna unguiculata
MAAIYSLYIINKSGGLIYYKDYGSAGRMDTNDSLRVASLWHSMHAISQQLSPVLGCLGIELLQADTFDLHCFQSLTGTKFFVVCEPGAQHMENLLKFVYELYTDYVLKNPFYEMEMPIRCELFDINLTQAVQKDRVAFLGR

SEQ ID NO: 5528 - protein, 141 aa, Cucumis sativus
MAAIYSLYIINKSGGLIFYKDYGSAGRMDTNDSLRVASLWHSMHAISQQLSPIAGCSGVELLEADTFDLHCFQSLTGTKFFVVCEPGTQHMESLLKYIYELYTDFVLKNPFYEMEMPIRCELFDINLAQAVQKDRVALLGR

SEQ ID NO: 5529 - protein, 141 aa, Taraxacum officinale
MAAIYSLYIINKSGGLIFYKDYGLAGRMDTNDSLRLASLWHSMHAISQQLSPISGCSGIELLEADTFDLHCFQSLTGTKFFVVSEPGTQNMENLLKHIYELYTDYVLKNPFYEMEMPIRCELFDINLAQAIQKDRVAYLGR

SEQ ID NO: 5530 - protein, 141 aa, Eucalyptus grandis
MAAVYSLFIINKSGGLIFYKDYGSSGRMDTNDSLRVASLWHSMHAISQQLSPTVGCSGIELLEADTFDLHCFQSLTGTKFFVVCEPGTQHMEALLKVIYELYTDYVLKNPFYEMEMPIRCELFDLNLSQAVQKDRVALLGR

SEQ ID NO: 5531 - protein, 141 aa, Heritiera littoralis
MAAIYSLYIINKSGGLIFYKDYGSKGRMDTNDSLRVASLWHSMHAISQQLSPTTGCSGIELLEADTFDLHCFQSLTGTKFFVVCEPGTQNMEALLKIIYQLYTDYVLKNPFYEMEMPIRCELFDINLTQAIQKDRVALLGR

SEQ ID NO: 5532 - protein, 141 aa, Lupinus angustifolius
MAAIYSLYIINKSGGLIYYKDYGSSGRMDTNDSLRVASLWHSMHAISQQLSPVSGCTGIELLQADTFDLHCFQSLTGTKFFVVCEPGTQHMESLLKFSYELYTDYVLKNPFYEMEMPIRCELFDINLAQAVQKDRVAFLGR

SEQ ID NO: 5533 - protein, 141 aa, Medicago truncatula
MAAVYSLYIINKSGGLIYYKDYGSSGRMDTNDSLRVASLWHSMHAISQQLSPVSGCTGIELLQADTFDLHCFQSLTGTKFFVVCEPGTQQMESLLKFVYELYTDYVLKNPFYEMEMPIRCELFDINLAQAVQKDRVALLGR

SEQ ID NO: 5534 - protein, 141 aa, Citrus sinensis
MAAIYSLYIINKSGGLIFYKDYGSAGRMDTNDSLRVASLWHSMHAISQQLSPTTGCSGIELLEADTFDLHCFQSLTGTKFFVVCEPGTQHMESLLKVIYELYTDYVLKNPFYEMEMPIRCELFDINLSQAVQKDRVAMLGR

SEQ ID NO: 5535 - protein, 141 aa, Cajanus cajan
MAAIYSLYIINKSGGLIYYKDYGSAGRMDTNDSLRVASLWHSMHAISQQLSPVSGCLGIELLQADTFDLHCFQSLTGTKFFVVCEPGAQHMENLLKFVYELYTDYVLKNPFYEMEMPIRCELFDINLTQAVQKDRVAFLGR

SEQ ID NO: 5536 - protein, 141 aa, Solanum tuberosum
  Sequence also found in Organisms: Solanum phureja
MAAIYSLYIINKSGGLIFCKDYGSAGKMDTNDSLRLASLWHSMHAISQQLSPVNGCAGIELLQADTFDLHCFQSLTGTKFFVVCEPGALHMESLLKYIYELYTDYVLKNPFYEMEMPIRCELFDINLSQAVQKDRVALLGR

SEQ ID NO: 5537 - protein, 141 aa, Silene vulgaris
MAAIYCLYIINKSGGLIFYKDYGSAGRMDTNDTLRLASLWHSMHAISQQLSPVSGCNGIELLEADNFDLHCFQSLTGTKFFVVCEPGTQHMENLLKFIYELYTDYVLKNPFYEMEMPIRCELFDINLSQAVQKDRVALLGR

SEQ ID NO: 5538 - protein, 141 aa, Vinca minor
MAAINSLYIINKSGGLIYYKDYGTAGRMDTNDSLRLASLWHSMHAISQQLSPIPNCTGIELLQADTFDLHCFQSLTGTKFFVVCEPGTQHMEVLLKHTYELYTDYVLKNPFYEMEMPIRCELFDINLAQSVQKDRVALLAR

SEQ ID NO: 5539 - protein, 143 aa, Bupleurum chinense
MPAIYSLYIINKSGGLIYYKDYGSAGRMDTNDSLRLASLWHSMHAISQQLSPVAGCSGIELLEADTFDLHCFQSLTGTKFFVVAEPGTQNMESLLKHIYELYTDYVLKILFMKWRCLLGVSFLISTCHRQYRKTVLHCLGDER

SEQ ID NO: 5540 - protein, 141 aa, Amborella trichopoda
MAAIYSLFIINKSGGLIFYKDYGSAGRMDTNDSLRLASLWHSMHAISQQLSPTIGCTGIELLEADTFDLHCFQSLTGTKFFVVCEPGIQHMEALLKHIYELYTDYVLKNPFYEMEMPIRCELFELNLSQAIRKDRIGLVGR

SEQ ID NO: 5541 - protein, 141 aa, Phaseolus vulgaris
MAAIYSLYIINKSGGLIYYKDYGSAGRMDTNDSLRVASLWHSMHAISQQLSPVSGCLGIELLQADTFDLHCFQSLTGTKFFVVCEPGAQHMENLLKFVYELYTDYVLKNPFYEMEMPIRCELFDINLTQAVQKDRVVFLGR

SEQ ID NO: 5542 - protein, 141 aa, Theobroma cacao
MAAIYSLYIINKSGGLIFYKDYGSKGRMDTNDSLRVASLWHSMHAISQQLSPTTGCSGIELLEADTFDLHCFQSLTGTKFFVVCEPGTQHMEALLKAIYELYTDYVLKNPFYEMEMPIRCELFDINLTQAIQKDRVVLLGR

SEQ ID NO: 5543 - protein, 141 aa, Manihot esculenta
MAAIYSLYIINKSGGLIFYKDYGSAGRMDTNDSLRVASLWHSMHAISQQLSPTVGCSGIELLEADTFELYCFQSLTGTKFFVVCEPGTPHVEGLLTVIYELYTDYVLKNPFYEMEMPIRCELFDINLTQVIQKDRVALLGR

SEQ ID NO: 5544 - protein, 141 aa, Gossypium hirsutum
  Sequence also found in Organisms: Gossypium raimondii
MAAIYSLYIINKSGGLIFYKDYGSKGRMDTNDSLRVASLWHSMHAISQQLSPTTGCSGIELLEADTFDLHCFQSLTGTKFFVVCEPGTQHMEALLKVVYELYTDYVLKNPFYEMEMPIRCELFDINLTQAVQKDRVALLGR

SEQ ID NO: 5545 - protein, 141 aa, Solanum melongena
MAAIYSLYIINKSGGLIFCKDYGSAGKMDTNDSLRLASLWHSMHAISQQLSPVNGCAGIELLQADTFDLHCFQSLTGTKFFVVCEPGSLHMESLLKYIYELYTDYVLKNPFYEMEMPIRCELFDINLSQAVQKDRVALLGR

SEQ ID NO: 5546 - protein, 141 aa, Euonymus alatus
MAAIYSLYIINKSGGLIFYKDYGSAGRMDTNDTLRVASLWHSMHAISQQLSPTVGCSGIELLEADTFDLHCFQSLTGTKFFVVCEPGIPHMESLLKVIYELYTDYVLKNPFYEMEMPIRCELFEIHLTQAVQKDRVALLGR

SEQ ID NO: 5547 - protein, 141 aa, Fagopyrum esculentum
MAAIYSLYIINKSGGLIFYKDYGSAGRMDTNDSLRLASLWHSMHAISQQLSPVTGCTGIELLEADTFDLHCFQSLTGTKFFVVCEPGTQHMDNLLKHIYELYTDYVLKNPFYEMEMPIRCELFDINLATAVQKDRVPLLGR

SEQ ID NO: 5548 - protein, 141 aa, Flaveria ramosissima
MAAIYSLYIINKSGGLIFYKDYGLQGRMDTNDSLRLASLWHSMHAISQQLSPIPGCSGIELLEADTFDLHCFQSLTGTKFFVVSEPGTQNMENLLKHIYELYTDYVLKNPFYEMEMPIRCELFDINLAQAIQKDRVSYLGR

SEQ ID NO: 5549 - protein, 141 aa, Cucumis melo
MAAIYSLYIINKSGGLIFYKDYGSAGRMDTNDSLRVASLWHSMHAISQQLSPIAGCSGVELLEADTFDLHCFQSLTGTKFFVVCEPGTQHMESLLKYIYELYTDFVLKNPFYEMEMPIRCELFDINLAQAVQKERVALLGR

SEQ ID NO: 5550 - protein, 141 aa, Prunus persica
  Sequence also found in Organisms: Prunus mume
MAAIYSLYIINKSGGLIFYKDYGSSGRMDTNDSLRVASLWHSMHAISQQLSPISGCFGIELLQADTFDLHCFQSLTGTKFFVVCEPGTQHMEGLLKHIYELYTDYVLKNPFYEMEMPIRCELFDINLTQAIQKDRVALLAR

SEQ ID NO: 5551 - protein, 141 aa, Sarracenia psittacina
MAAIYSLYIINKSGGLIFYKDYGSAGRMDTNDSLRLASLWHSMHAISQQLSPVPGCSGIELLEADTFDLHCFQSLTGTKFFVVSEPGTQHMDGLLKHIYELYTDYVLKNPFYEMEMPIRCELFDINLAQAVQKERVALLGR

SEQ ID NO: 5552 - protein, 141 aa, Euphorbia esula
MASICSLYIINKSGGLIFYKDYGTHGRMDTNDSLRVASLWHSMHAISQQLSPTLGCSGIELLEADTFDLHCFQSLTGTKFFVVCEPGTPNMESLLRVIYELYTDYVLKNPFYEMEMPIRCELFDMNLTQTIQKDRVALLGR

SEQ ID NO: 5553 - protein, 141 aa, Fragaria vesca
MAAIYSLYIINKSGGLIFYKDYGSTGRMDTNDSLRVASLWHSMHAISQQLSPVPGCAGIELLQADTFDLHCFQSLTGTKFFVVSEPGTQHMEGLLKHIYELYTDYVLKNPFYEMEMPIRCELFDINLTQAIQKDRVALLAR

SEQ ID NO: 5554 - protein, 141 aa, Tripterygium wilfordii
MAAIYSLYIINKSGGLIFYKDYGSAGRMDTNDSLRVASLWHSMHAISQQRSPTVGCSGIELLEADTFDLHCFQPLTGTKFFVVCEPGTPHMESLLKVIYELYTDYVLKNPFYEMEMPIRCDLFDIHLTQAIQKDRVALLGR

SEQ ID NO: 5555 - protein, 145 aa, Allium cepa
IFGVIASVCSLFIINKSGGLIFYKDYGSTGRMDTNDSLRLASLWHSMHAISQQLSPVVGCNGIELLQADNFDLHCFQSLTGTKFFVVCEPGTPQMENLLKLIYELYTDYVLKNPFYEMEMPIRCELFDLNLSQAIQKDRVPLLGR

SEQ ID NO: 5556 - protein, 317 aa, Cirsium arvense
MSRGNDNSSKLNSVFYATSYHPIQAGSIDGTDILPHDNAVYRALLCSSAGLYDPFGDPNVIGEDPYCTVFVGHLSQFTTEDTLRKAMSNYGTVKNLRLVRHIVTGASQGYAFVEFESEREMRRAYEKAHHSVIDDSEIIVDYNRQQLMPGWIPRRLGGGLGGKKESGQLRFGGRERPFRAPLRPIPLDDLKRLGIPPPPEGNYMSRFEVPSPPRRKADYADREDRRNRRRERRSSSRDRLHDPRRSVDNDDGSRKSHSRNYSERSSRDRYDEREDDTRKRYKDSHRRDRTSTSHDHQSDTRRSSDREQRSRKRHKHE

SEQ ID NO: 5557 - protein, 160 aa, Sarracenia psittacina
RAELDQGTRSVLQLDTKGKIGRHLQSVHHYKSGGLIFYKDYGSAGRMDTNDSLRLASLWHSMHAISQQLSPVPGCSGIELLEADTFDLHCFQSLTGTKFFVVSEPGTQHMDGLLKHIYELYTDYVLKNPFYEMEMPIRCELFDINLAQAVQKERVALLGR

SEQ ID NO: 5558 - protein, 141 aa, Castanea mollissima
  Sequence also found in Organisms: Quercus alba
MAAIYSLYIINKSGGLIFYKDYGSAGRMDTNDSLRVASLWHSMHAISQQLSPVAGCSGIELLEADTFDLHCFQSLTGTKFFVVCEPGTQHMEALLKVIYELYTDYVLKNPFYEMEMPIRCELFDINLSLTVQKERVALLGR

SEQ ID NO: 5559 - protein, 141 aa, Castanea mollissima
  Sequence also found in Organisms: Quercus alba
MAAIYSLYIINKSGGLIFYKDYGSAGRMDTNDSLRVASLWHSMHAISQQLSPVAGCSGIELLEADTFDLHCFQSLTGTKFFVVCEPGTQQMEALLKVIYELYTDYVLKNPFYEIEMPIRCELFDFNLSQTVQKDCVALLGR

SEQ ID NO: 5560 - protein, 141 aa, Chrysanthemum coronarium
MAAIYSLYIINKSGGLIFYKDYGLQGRMDTNDTLRLASLWHSMHAISQQLSPVSGCTGIELLEADTFDLHCFQSLTGTKFFVVSEPGTQHMENLLKHIYELYTDYVLKNPFYEMEMPIRCELFDINLAQAIQKDRVAYLGR

SEQ ID NO: 5561 - protein, 141 aa, Cichorium intybus
  Sequence also found in Organisms: Lactuca sativa
MAAIYSLYIINKSGGLIFYKDYGLAGRMDTNDSLRLASLWHSMHAISQQLSPISGCSGIELLEADTFDLHCFQSLTGTKFFVVSEPGTHHMDNLLKHIYELYTDYVLKNPFYEMEMPIRCELFDINLAQAIQKDRVAYLGR

SEQ ID NO: 5562 - protein, 141 aa, Centaurea maculosa
MAAIYSLYIINKSGGLIFYKDYGLAGRMDTNDSLRLASLWHSMHAISMQLSPISGCTGIELLEADTFDLHCFQSLTGTKFFVVSEPGTQHMEHLLKHIYELYTDYVLKNPFYEMEMPIRCELFDINLSQAIQKDRVAYLGR

SEQ ID NO: 5563 - protein, 141 aa, Cirsium arvense
MAAIYSLYIINKSGGLIFYKDYGLAGRMDTNDSLRLASLWHSMHAISQQLSPISGCTGIELLEADTFDLHCFQSLTGTKFFVVSEPGTQHMENLLKYIYEQYTDYVLKNPFYEMEMPIRCELFDINLSQAIQKDRVAYLGR

SEQ ID NO: 5564 - protein, 141 aa, Citrus clementina
MAAIYSLYIINKSGGLIFYKDYGSAGRMDTNDSLRVASLWHSMHVISQQLSPTTGCSGIELLEADTFDLHCFQSLTGTKFFVVCEPGTQHMESLLKDIYELYTDYVLKNPFYEMEMPIRCELFDINLSQAVQKDRVAMLGR

SEQ ID NO: 5565 - protein, 141 aa, Gossypium hirsutum
MAAIYSLYIINKSGGLIFYKDYGSKGRMDTNDSLRVASLWHSMHAISQQLSPTTGCSGIELLEADTFDLHCFQSLTGTKFFVVCEPGTQHMEALLKVVYELYTDYVLKNPFYEMEMPIRCELFDINLTQAVQKDRVVLLGR

SEQ ID NO: 5566 - protein, 141 aa, Cucurbita pepo
MAAIYSLYIINKSGGLIFYKDYGSAGRMDTNDSLRVASLWHSMHAISQQLSPISGCSGTELLEADTFDLHCFQSLTGTKFFVVCEPGTVHMEGLLKYIYELYTDYVLKNPFYEMEMPIRCELFDINLVQAVQKDRVALLGR

SEQ ID NO: 5567 - protein, 141 aa, Euonymus alatus
MAAIYSLYIINKSGGLIFYKDYGSAGRMDTNDTLRVASLWHSMHAISQQLSPTVGCSGIELLEADTFDLHCFQSLTGTKFFVVCEPGTPHMESLLKVIYELYTDYVLKNPFYEMEMPIRCELFEIHLTQAVQKDRVASLGR

SEQ ID NO: 5568 - protein, 141 aa, Panax ginseng
MPAICSLYIINKSGGLIYYKDYGSAGRMDTNDSLRLASLWHSMHAISQQLSPVNGCTGIELLEADTFDLHCFQSLTGTKFFVISEPGTQHMEGLLKHIYELYTDYVLKNPFYEMEMPIRCELFDINLSQAVQKDRVALLGR

SEQ ID NO: 5569 - protein, 141 aa, Gnetum gnemon
MASIYNLFIINKSGGLIFYKDYGSAGRMDTNDSLRLASLWHSMHAISQQLSPVLGCTGIELLEADTFDLHCFQSLTGTKFFVVTEPGTQGMEYLLKTIYELYTDYVLKNPFYEMEMPIRCELFDLNLAQAIRKDKIPFLGR

SEQ ID NO: 5570 - protein, 141 aa, Guizotia abyssinica
MAAIYSLYIINKSGGLIFYKDYGLQGRMDTNDSLRLASLWHSMHAISQQLSPIPGCAGIELLEADTFDLHCFQSLTGTKFFAVSEPGTQNMENLLKHIYELYTDYVLKNPFYEMEMPIRCELFDINLAQSIQKDRVSYLGR

SEQ ID NO: 5571 - protein, 140 aa, Lotus japonicus
MAAVYSLYIINKSGGLIYYKDYGSGRMDTNDTLRVASLWHSMHAISQQLSPVSGCFGIELLQADTFDLHCFQSLTGTKFFVVSEPGAQYMESLLKFIYELYTDYVLKNPFYEMEMPIRCELFDINLTQAVQKDRVALLGR

SEQ ID NO: 5572 - protein, 141 aa, Tropaeolum majus
MAAIYSLYIINKSGGLIFYKDYGSRGRMDTNDSLRVASLWHSMHAISQQLSPTTGCSGIELLEADTFDLHCFQSLTGTKFFVVCEPGTQLMENLLKIIYELYTDYVLKNPFYEMEMPIRCELFDINLTQAIQKERVAMLGR

SEQ ID NO: 5573 - protein, 141 aa, Primula obconica
MAAIYSLYIINKSGGLIFYKDYGSAGRMDTNDSLRMASLWHSMHAISQQLSPVLGCSGIELLEADSFDLHCFQSLTGTKFFVVSEPGTLHMDGLLKHIYELYTDYVLKNPFYEMEMPIRCELFDINLAQAVQKDRVALLGR

SEQ ID NO: 5574 - protein, 141 aa, Chenopodium quinoa
MAAIYSLYIINKSGGLIYYKDYGSAGRMDTNDTLRLASLWHSMHAISQQLSPVSGCFGVELLEADTFDLHCFQSLTGTKFFVVCEPGTQHMELLLKYVYELYTDYVLKNPFYEMEMPIRCELFDINLTQAVQKDRVALLGR

SEQ ID NO: 5575 - protein, 141 aa, Carthamus tinctorius
MAAIYSLYIINKSGGLIFYKDYGLAGRMDTNDSLRLASLWHSMHAISQQLSPISGCSGIELLEADTFDLHCFQSLTGTKFFVVSEPGTQHMEHLLKHIYELYTDYVLKNPFYEMEMPIRCELFDINLSQAIQKDRVAYLGR

SEQ ID NO: 5576 - protein, 141 aa, Glycine max
MAAICSLYIINKSGGLIYYKDYGSAGRMDTNDSLRVASLWHSMHAISQQLSPVSGCLGIELLQADTFDLHCFQSLTGTKIFVVCEPGAQYMESLLKFVYELYTDYVLKNPFYEMEMPIRCELFDINLTQAVQKDRVAFLGR

SEQ ID NO: 5577 - protein, 145 aa, Allium cepa
IFGVIASVCSLFIINKSGGLIFYKDYGSTGRMDTNDSLRLASLWHSMHAISQQLSPVVGCNGIELLQADNFDLHCFQSLTGTKFFVVCEPGTPQMENLLKLIYELYTDYVLKNPFYEMEMPIRCELFDLNLSQAIQKDRLPLLGR

SEQ ID NO: 5578 - protein, 77 aa, Vaccinium corymbosum
MAAIYSLYIINKSGGLIFYKDYGSAGRMDTNDSLRLASLWHSMHAISQQLSPVSGCSGIELLEPILSISIAFSLLLD

SEQ ID NO: 5579 - protein, 67 aa, Flaveria ramosissima
MDTNDSLRLASLWHSMHAISQQLSPIPGCSGIELLEADTFDLHCFQSLTGTKFSWYLSLEHKIWRIC

SEQ ID NO: 5580 - protein, 589 aa, Panax ginseng
MAPPGTVAGGGGRQQQEQQQPGFGKSIQGIIRIAIFWYFASKFFSPKKPSTGSEPSLQISNLFPKAEPLDMWLYLSEYEKLNDFGSEGVLVWHETNIPYAVWGSESTRSLSMKYYPSEALKHNGSLYAHVFFARSGYPPDPKDPEYQPNAAFGRTHPVVTYLPKSRADKKRSLLANSDGSSEAVPEVVEDSQVDSKDVGPVEWISYWKPNITINLVDDFTRYSYNAIPPNIAPYLNVEPGTQGYYPTIFFNEFWLLRDKLIPINETVTELPLLLEVGPISMTKWQLFLQIDQSFQIHRSYGSMLEGEADELKRVFLEGNPYILMITMVVSLLHSVFDFLAFKNDIQFWNKNKSMEGLSAKSVIVNFFCQLIVFLYLLDNDTSWMILASSGVGCCIEFWKIGKAMHIEVDRSGNIPRLRFRDHESYAGNKTKEYDDLAMKYLSYVLFLLVAGSSAYSLKYERHKSWYSWILSSLTSCVYMFGFIMMCPQLFINYKLKSVAHLPWRQMTYKFLNTIIDDLFAFVIKMPLLHRLSVFRDDVIFLIYIYQRWVYPVDKKRVNEFGFGGEDADQASGSGSTDVTTVNEEEKKTK

SEQ ID NO: 5581 - protein, 94 aa, Humulus lupulus
MAAIYSLYIINKSGGLIFYKDYGSAGRMDTNDSLRVASLWHSMHAISQQLSPVSGCFGIELLQADTFDLHCFQSLTGTNSLWSQSLGHNTWKIS

SEQ ID NO: 5582 - protein, 141 aa, Daucus carota
MPAVYSLYIINKSGGLIYHKDYGSAGRMDTNDSLRLASLWHSMHAISQQLSPVAGCTGIELLEADTFDLHCFQSLTGTKFFVVAAPGTQNMESLLKHIYELYTDYVLKNPFYEMEMPIRCELFDINLTQAIQNDRFALLGR

SEQ ID NO: 5583 - protein, 141 aa, Cichorium intybus
MAAIYSLYIINKSGGLIFYKDYGLAGRMDTNDSLRLASLWHSMHAISQQLSPISGCSGIELLEADTFDLHCFQSLTGTKFFVVSEPGTHHMDNLLKHIYELYTDYVLKNPFYEMEMPIRCELFDINLAQATQKDRVAYLGR

SEQ ID NO: 5584 - protein, 141 aa, Malus domestica
MAAIYSLYIINKSGGLIYYKDYGSAGRMDTNDTLRVASLWHSMHAISQQLSPVSGCFGIELLQADTFDLNCFQSLTGTKFFVVSEPGTQHMEGLLKHIYELYTDYVLKNPFYEMEMPIRCELFDTNLTQAVQKDRVALLAR

SEQ ID NO: 5585 - protein, 141 aa, Artemisia annua
MAAIYSLYIINKSGGLIFYKDYGLQGRMDTNDTLRLASLWHSMHAISQQLSPVSGCTGIELLEADTFDLHCFQSLTGTKFFVVSEPGTQHMDNLLKHIYELYTDYVLKNPFYEMEMPIRCELFDINLAQAIQKDRVAYLGR

SEQ ID NO: 5586 - protein, 141 aa, Cannabis sativa
MAAIYSLYIINKSGGLIFYKDYGSAGRMDTNDSLRVASLWHSMHAISQQLSPVLGCFGIELLQADTFDLHCFQSLTGTKFFVVSEPGTQHMEDLLKSIYELYTDYVLKNPFYEMEMPIRCELFDMNLTQAVQKDRVSLFGR

SEQ ID NO: 5587 - protein, 141 aa, Cynara scolymus
MAAIYSLYIINKSGGLIFYKDYGLAGRMDTNDSLRLASLWHSMHAISQQLSPISGCSGIELLEADTFDLHCFQSLTGTKFFVVSEPGTQHMEHLLKHIYELYTDYVLKNPFYEMEMPIRCELFDIHLSQAIQKDRVAYLGR

SEQ ID NO: 5588 - protein, 141 aa, Echinacea purpurea
MAAIYSLYIINKSGGLIFYKDYGLQGRMDTNDSLRLASLWHSMHAISQQLSPIQGCSGIELLEADTFDLHCFQSLTGTKFFVVSEPGTQNMENLLKHIYELYTDYVLKNPFYEMEMPIRCELFDINLAQAVQKDRVSYLGR

SEQ ID NO: 5589 - protein, 141 aa, Eschscholzia californica
MAAIYSLFIINKSGGLIFYKDYGSTGRIDTNDSLRLASLWHSMHAISQQLSPVLGCSGIELLEADTFDLHCFQSLTGTKFFVVSEPGTQHMEDLLKVIYELYTDYVLKNPFYQREMPIRCESFDFNLLQAIQKDRVALLGR

SEQ ID NO: 5590 - protein, 141 aa, Fagopyrum esculentum
MAAVYSLYIINKSGGLIFYKDYGSAGRMDTNDSLRLASLWHSMHAISQQLSPVTGCTGIELLEADTFDLHCFQSLTGTKFFVVCEPGTQHMDNLLKHIYELYTDYVLKNPFYEMEMPIRCELFDINLATAVQKDRLPLLGR

SEQ ID NO: 5591 - protein, 141 aa, Linum usitatissimum
MAAIYSLYIINKSGGLIFYKDYGSSGRMDTNDSLRVASLWHSMHAISQQLSPIVGCTGIELLEADNFDLHCFQSLTGTKFFVVSEPGTLYMENLLKYIYEQYTDYVLKNPFYEMEMPIRCELFDINMSQAIQKDLVALLGR

SEQ ID NO: 5592 - protein, 141 aa, Panax ginseng
MPVIYSLYIINKSGGLIFYKDYGSAGRMDTNDSLRLASLWHSMHAISQQLSPITGCLGIELLEADTFDLHCFQSLTGTKFFVVSEPGTQHMEGLLKHIYELYTDYVLKNPFYEMEMPIRCELFDINLSQAVQKDRVALLGR

SEQ ID NO: 5593 - protein, 141 aa, Liriodendron tulipifera
MAAIYSLFIINKSGGLIFYKDYGSAGRMDTNDSLRLASLWHSMHAISQQLSPTVGCSGVELLEADTFDLNCFQTLTGTKFFVVCEPGAQHMDSLLKLIYELYTDYVLKNPFYEMEMPIRCELFDLNLMQAVQKDRVLLMGR

SEQ ID NO: 5594 - protein, 141 aa, Lotus japonicus
MAAIYSLYIINKSGGLIYYKDYGSAGRMDTNDTLRVASLWHSMHAISQQLSPVSGCAGIELLQADTFDLHCFQSLTGTKFFVVSEPGTQQMESLLKFVYELYTDYVLKNPFYEMEMPIRCELFDINLTQAVQKDRVALLAR

SEQ ID NO: 5595 - protein, 141 aa, Lupinus angustifolius
MAAICSLYIINKSGGLIYYKDYGSSGRMDTNDSLRVASLWHSMHAISQQLSPVSGCAGIELLQADTFDLHCFQSLTGTKFFVVCEPGTQHMETLLKFVYELYTDYVLKNPFYEMEMPIRCELFDINLTQAVQKDRVAFLGR

SEQ ID NO: 5596 - protein, 141 aa, Tropaeolum majus
MAAIYSLYIINKSGGLIFYKDYGSRGRMDTNDSLRVASLWHSMHAISQQLSPTTGCSGIELLEADTFDLHCFQSLTGTKFFVVCEPGTQLMENLLKIIYERYTDYVLKNPFYEMEMPIRCELFDINLTQAIQKERVAMLGR

SEQ ID NO: 5597 - protein, 141 aa, Carica papaya
MAAIYSLYIINKSGGLIFYKDYGSEGRMDTNNSLRVASLWHSMHAISQQLSPVTGCSGIELLEADKFDLHCFQSLTGTKFFVICEPGAQHMENLLKFIYELYTDYVLKNPFYEMEMPIRCELFDVNLTQAIQKDRVALLSR

SEQ ID NO: 5598 - protein, 141 aa, Glycine max
MAAIYSLYIINKSGGLIYYKDYGSAGRMDTNDSLRVASLWHSMHAISQQLSPVSGCLGIELLQADTFDLHCFQSLTGTKFFAVSEPGAQHMESLLKFVYELYTDYVLKNPFYEMEMPIRCELFDINLTQAVQKDRVTFLGR

SEQ ID NO: 5599 - protein, 141 aa, Glycine max
MAAIYSLYIINKSGGLIYYKDYGSAGRMDTNDSLRVASLWHSMHAISQQLSPVSGCLGIELLQADTFDLHCFQSLTGTKFFVVSEPGAQHMESLLKFVYELYTDYVLKNPFYEMEMPIRCELFDINLTQAVQKDHVTFLGR

SEQ ID NO: 5600 - protein, 141 aa, Zinnia violacea
MAAIYSLYVINKSGGLIFYKDYGLQGRMDTNDSLRLASLWHSMHAISQQLSPIPGCSGIELLEADTFDLHCFQSLTGTKFFVVSEPGTQNMENLLKHIYELYTDYVLKNPFYEMEMPIRCELFDINLAQAVQKDRVAYLGL

SEQ ID NO: 5601 - protein, 140 aa, Nicotiana benthamiana
YSLYIINKSGGLIFYKDYGSAGRMDTNDSLRLASLWHSMHAISQQLSPLSPVNGCAGIELLQADNFDLHCFQSLTGTKFFVVCEPGSLHMESLLKYIYELYTDYALKNPFYEMEMPIRCELFDINLSQAVQKDRVALLGR

SEQ ID NO: 5602 - protein, 172 aa, Cucurbita pepo
MAAIYSLYIINKSGGLIFYKDYGSAGRMDTNDSLRVASLWHSMHAISQQLSPISGCSGTELLEADTFDLHCFQSLTGTKFFVVCEPGTLHMEGLLKYIYELYTDYVLKNPFYEMEMPIRCELFDINLVQACKGSCCFAWSMSFRLSFICQYTIHNSRKKAHDIVSKYLIICL

SEQ ID NO: 5603 - protein, 84 aa, Panax ginseng
MPVIYSLYIINKSGGVIFYKDYGSAGRMDTNDSLRLASLWHSMHAISQQLSPITGCLGIELLEADTFDLHCFQSLTGTKFFRSF

SEQ ID NO: 5604 - protein, 141 aa, Trifolium pratense
MAAIYSLYIINKSGGLIYYKDYGSAGRMDTNDTLRVASLWHSMHAISQQLSPVSGCSGIELLQADTFDLHCFQSLTGTKFFAVCEPGTQQIESLLKYIYELYTDYVLKNPFYEIEMPIRCELFDINLTQSVQKDRVALLGQ

SEQ ID NO: 5605 - protein, 141 aa, Cephalotaxus harringtonia
MASIYNLFIINKSGGLIFYKDYGSAGRMDTNDSLRLASLWHSMHAISQQLSPTIGCMGIELLEADTFDLHCFQSLTGTKFFVVAEPGAQGMELLLKSIYELYTDYVLKNPFYELEMPIRCELFELNLAQAIRKDKPVFGGR

SEQ ID NO: 5606 - protein, 141 aa, Raphanus sativus
MAAIYSLYIINKSGGLIFYKDCGTKGRMDTNDSLRVASLWHSMHAISQQLSPVNGCSGIDLLQADTFDLHCFQSLPGTKFFVVCEPGTPHMESLLRYIYELYTDFVLKNPFYEIEMPIRCELFDINLSQAVQSDRVALLGR

SEQ ID NO: 5607 - protein, 141 aa, Helianthus annuus
MAAIYSLYIINKSGGLIFYKDYGLQGRMDTNDSLRLASLWHSMHAISQQLSPIQGCSGIELLEADTFDLHCFQSLTGTKFFVVSEPGTQNMENLLKHIYELYTDYVLKNPFYEMEMPIRCELFDINLAQAVQKERVSYLGR

SEQ ID NO: 5608 - protein, 141 aa, Valeriana officinalis
MAAIYSLYIINKSGGLIFYKDYGTKGRMDTNDSLRLASLWHSMHAISQQLSPVIGCMGIELLEADTFDLHCFQSLTGTKIFVVSEPGTQYMESLLKQIYELYTDYVLKNPFYEMEMPIRCELFDINLNQAIQKDRVSLLGR

SEQ ID NO: 5609 - protein, 573 aa, Setaria italica
MAASLLPPAATLAKKYPTLLHPSGARPHAQRLIFRCGATSDAADDGWASFVDELKSSLQDPSDTVASDAAGAGAAPDDLVTALPLDASADPAGVGDTTNAIAGAANELMGVDASGAAASSDSIPDGLLSVLHLDASNPAVRAAGGALSRLDALTAGLSDAQRWALLGFLGVTWLYLTARPGVLSGAVDTYVLAPLQLALDSVLGRRSLKMSDFVVGERIGEGSFGVVYAGAVVPKNGAVVEERSGRARTSLQNDDRYKEKVILKKIKVGTVGAKECGDYEEWFNYRMARAAPESCADFLGSFVADKTKSEFIKGGKWLVWKFEGDRTLADYLGDRAFPSNLEQLMFGRALRGLGTLERDALVVKQVMRQLVTSLKRIHGTGIVHRDIKPSNLVVTRRGQVKLIDFGAATDLRIGKNYVPDRALLDPDYCPPELYVLPEETPEPPPEPIAAILSPILWQLNNPDLFDMYSAGIVLMQMAIPTLRTQSGLKNFNAELRSAGYDLNRWRQSTRRRPDLQILDLDSGRGWDLATKLISERGANGGGRLSAAAALRHPYFLLGGDQAAAVLSKLSLIK

SEQ ID NO: 5610 - protein, 575 aa, Panicum virgatum
MAASLLPPATLAKQYPTLLHPFAAKLHAQRLIFRCGATTDGTDYSWASFLDELKSSLQVGPTDTVGSDAGAGATPDDLVTSLPLDASAAPAVGDATNAAAGAANELLGVDASGAAASSDAGAGAIPDGLLSALHLDASNPAVRAAGGALSRLDALTAGLSDAQRWALLGFLGVTWLYLTARPGVLSGAVDAYVLAPLQLALDSALGRRSLKMSDFVVGERIGEGSFGVVFFGAVVPKNGAVVEERSGRARTSLQNDDRYKEKVILKKIKVGTVGAKECGDYEEWFNYRVARAAPETCADFLGSFVADKTKSEFVRGGKWLVWKFEGDRTLANYLNDRGFPSNLEQLMFGRALRGLGTLERDALVVKQVMRQLVTSLKRIHGTGIVHRDIKPSNLVVTRRGQVKLIDFGAATDLRIGKNYVPDRALLDPDYCPPELYVLPEETPEPPPEPIAAILSPILWQLNNPDLFDMYSAGIVLMQMAIPTLRTQSGLKNFNSELRSAGYDLNKWRQSTRRRPDLQILDLDAGRGWDLATKLISQRGANGGGRLSAAAALRHPYFLLGGDQAAAVLSKLSLSK

SEQ ID NO: 5611 - protein, 579 aa, Panicum virgatum
MAASLLPPPTLAKKYPTLLHPSGAKPHAQRLIFRCAATTDGADDSWASFLDELKSSLQVGPPDTVASDAGAGAATPDDLVTALPLDPSAAGPTIGDTTNAAVGAASELLGADASGAAASSNAGAATGAIPDGLLSALHLDASSPAARAAGGALSRLEALTAGLSDAQRWALLGFLGATWLYLTARPGVLSGAVDAYVLAPLQLALDSALGRRSLKMSDFVVGERIGEGSFGVVFFGAVVPRNGAAVEERSGRARTSLQNDDRYKEKVILKKIKVGTVGAKECGDYEEWFNYRVARAAPETCADFLGSFVADKTKSEFVKGGKWLVWKFEGDRTLGNYLNDRGFPSNLEQLMFGRALRGLGTLERDALVVKQVMRQLVTSLKRIHGTGIVHRDIKPSNLVVTRRGQVKLIDFGAATDLRIGKNYVPDRALLDPDYCPPELYVLPEETPQPPPEPIAAILSPILWQLNSPDLFDMYSAGIVLMQMAIPTLRTQSGLKNFNSELRSAGYDLNKWRQSTRRRPDLRILDQDAGRGWDLATKLISQRGANGGGRLSAAAALRHPYFLLGGDQAAAVLSKLSLSK

SEQ ID NO: 5612 - protein, 338 aa, Triticum aestivum
MAWRRVLSQAARNQSAYAIYNELAASSPLRSLRSDISAGGALRNLHERYHSSYFGGLSRSMRDLGSQSEASMIKEIYRSDPERVIKIFESQPLLHSNPSALSEYVKALVKVDRLDDSTLLKTLQRGLAASERSEGSLGSVPALKSAGQVTKDGIIGTANAPIHMVTAETGQFKDQLWRTFRSIALTFLLISGIGALIEDRGISKGLGLNEEVQPSMESSTKFSDVKGVDEAKAELEEIVHYLRDPKRFTRLGGKLPKGVLLVGPPGTGKTMLARAIAGEASVPFFSCSGSEFEEMFVGVGARRVRDLFAAAKNDRLVSYSLMKLMQLVGVEIRRISSI

SEQ ID NO: 5613 - protein, 704 aa, Triticum aestivum
MAWRRVLSQAARNQSAYAIYNELAASSPLRSLRSDISAGGALRKLHERYHSSYFGGLSRSMRDLGSQSEGSMLKEIYRSDPERVIKIFESQPLLHSNPSALSEYVKALVKVDRLDDSTLLKTLQRGLAASERSEGSLGSVPALKSAGQVTKDGIIGTANAPIHMVTAETGQFKDQLWRTFRSIALTFLLISGIGALIEDRGISKGLGLNEEVQPSMESSTKFSDVKGVDEAKAELEEIVHYLRDPKRFTRLGGKLPKGVLLVGPPGTGKTMLARAIAGEASVPFFSCSGSEFEEMFVGVGARRVRDLFAAAKKRSPCIIFIDEIDAIGGSRNPKDQQYMKMTLNQLLVELDGFKQNEGIIVIAATNFPESLDKALVRPGRFDRHIVVPNPDVEGRRQILEVHMSKVLKGDDVDLMIIARGTPGFSGADLANLVNVAALRAAMDGAKSVSMNDLEYAKDRIMMGSERKSAVISDECRKLTAYHEGGHALVAMHTDGAHPVHKATIVPRGMALGMVAQLPDKDETSVSRKQMLARLDVCMGGRVAEELIFGDSEVTSGASSDFEQATLMARAMVTQYGMSKQVGLVSYNYEEDGKTMSSETRLLIEEEVKNFLEKAYNNAKAILTKHNKELHALANALLEHETMSGTQIKNLLAQVDNKQPQGHAVEAPQKTPASPPSPAAAAAAAAAAAAQQAAAQAKGVVGIGS

SEQ ID NO: 5614 - protein, 704 aa, Triticum aestivum
MAWRRVLSQAARNQSAYAIYNELAASSPLTSLRSDISAGGTLRNLHERYHSSYFGGLSRSMRDLGSQSEASMLKEIYRSDPERVIKIFESQPLLHSNPSALSEYVKALVKVDRLDDSTLLKTLQRGLAASERSEGSLGSVPALKSAGQVTKDGIIGTANAPIHMVTAETGQFKDQLWRTFRSIALTFLLISGIGALIEDRGISKGLGLNEEVQPSMESSTKFSDVKGVDEAKAELEEIVHYLRDPKRFTRLGGKLPKGVLLVGPPGTGKTMLARAIAGEASVPFFSCSGSEFEEMFVGVGARRVRDLFAAAKRRSPCIIFIDEIDAIGGSRNPKDQQYMKMTLNQLLVELDGFKQNEGIIVIAATNFPESLDKALVRPGRFDRHIVVPNPDVEGRRQILEVHMSKVLKGDDVDLMIIARGTPGFSGADLANLVNVAALRAAMDGAKSVSMNDLEYAKDRIMMGSERKSAVISDECRKLTAYHEGGHALVAMHTDGAHPVHKATIVPRGMALGMVAQLPDKDETSVSRKQMLARLDVCMGGRVAEELIFGDSEVTSGASSDFEQATLMARAMVTQYGMSKQVGLVSYNYEEDGKTMSSETRLLIEEEVKNFLEKAYNNAKAILTKHNKELHALANALLEHETMSGTQIKNLLAQVDNKQPQGHAVEAPQKTPASPPSPAAAAAAAAAAAAQQAAAQAKGVAGIGS

SEQ ID NO: 5615 - protein, 704 aa, Secale cereale
MAWRRVLSQAARNQSAYAIYNELAAFSPLRSLRSDISAGGTLRNLHERYHSSYFGGLSRSMRDLGSQSEASMLKEIYRSDPERVIKIFESQPLLHSNSSALSEYVKALVKVDRLDDSTLLKTLQRGLAASERSEGSLGSVPALKSAGQVTKDGIIGTANAPIHMVTAETGQFKDQLWRTFRSIALTFLLISGIGALIEDRGISKGLGLNEEVQPSMESSTKFSDVKGVDEAKAELEEIVHYLRDPKRFTRLGGKLPKGVLLVGPPGTGKTMLARAIAGEASVPFFSCSGSEFEEMFVGVGARRVRDLFAAAKKRSPCIIFIDEIDAIGGSRNPKDQQYMKMTLNQLLVELDGFKQNEGIIVIAATNFPESLDKALVRPGRFDRHIVVPNPDVEGRRQILEAHMSKVLKDDDVDLMIIARGTPGFSGADLANLVNVAALRAAMDGAKSVSMNDLEYAKDRIMMGSERKSAVISDECRKLTAYHEGGHALVAMHTDGAHPVHKATIVPRGMALGMVAQLPDKDETSVSRKQMLARLDVCMGGRVAEELIFGDSEVTSGASSDFEQATLMARAMVTQYGMSKQVGLVSYNYEEDGKTMSSETRLLIEEEVKNFLEKAYNNAKTILTKHNKELHALANALLEHETMSGTQIKNLLAQVNNIEPQGHAVEAPQKTPASPPSPAAAAAAAAAAAAQQAAAQAKGVAGIGS

SEQ ID NO: 5616 - protein, 704 aa, Lolium multiflorum
MAWRRVLSLAARNRSAYAIYNQSAASSPLRSIGSDIFAGGARRNLHDRFHSSYFGGLSRSMRDLGSQSEASLLKEIYRSDPERVIQIFESQPLLHSNSSALSEYVKALVKVDRLDDSTLLKTLQRGLAASERAEGSLGSVPASKSAGQVTKDGIIGTANAPIHMVTAETGQFKDQLWRTFRSIALTFLLISGIGALIEDRGISKGLGLNEEVQPSMESSTKFSDVKGVDEAKAELEEIVHYLRDPKRFTRLGGKLPKGVLLVGPPGTGKTMLARAIAGEASVPFFSCSGSEFEEMFVGVGARRVRDLFAAAKKRSPCIIFMDEIDAIGGSRNPKDQQYMKMTLNQLLVELDGFKQNEGIIVIAATNFPESLDKALVRPGRFDRHIVVPNPDVEGRRQILEVHMTKVLKGDDVDLMTIARGTPGFSGADLANLVNVAALRAAMDGAKSVTMTDLEYAKDRIMMGSERKSAVISDESRKLTAYHEGGHALVAIHTDGAHPVHKATIVPRGMALGMVAQLPDKDETSVSRKQMLASLDVCMGGRVAEELIFGESEVTSGASSDFEQATSMARAMVTQYGMSKQVGLVSYNYEDDGKTMSSETRLLIEEEVKNFLERAYNNAKTILTKHNKELHTLANALLEHETLSGAQIKNLLAQADNKQPQEHGVEAPQKTPASPPSPAAAAAAAAAAAAQKAAAQATGVAGIGS

SEQ ID NO: 5617 - protein, 704 aa, Brachypodium distachyon
MAWRRVLSQAARNQSAYAIYNELAAPSPLRSLRSNISAGGTLRNLHERYYSSYFGSLSRSARDLGSPSEASLLKEIYRSDPERVIQIFEGQPSLHSNPSALSEYVKALVKVDRLDESILLKTLQRGVAASERAEGSLSSVPALKSAGQVTKDGIIGTANAPIHMVTAETGQFKEQLWRTFRSIALTFLLISGIGALIEDRGISKGLGLNEEVQPSMESSTKFSDVKGVDEAKAELEEIVHYLRDPKRFTRLGGKLPKGVLLVGPPGTGKTMLARAIAGEASVPFFSCSGSEFEEMFVGVGARRVRDLFAAAKKRSPCIIFMDEIDAIGGSRNPKDQQYMKMTLNQLLVELDGFKQNEGIIVIAATNFPESLDKALVRPGRFDRHIVVPNPDVEGRRQILESHMSKVLKSEDVDLMIIARGTPGFSGADLANLVNVAALKAAMDGAKSVTMNDLEYAKDRIMMGSERKSAVISDECRKLTAYHEGGHALVAMHTDGAHPVHKATIVPRGMSLGMVAQLPEKDETSVSRKQMLARLDVCMGGRVAEEIIFGDSEVTSGASSDFQQATSMARAMVTKYGMSKQVGLVSYNYEDDGKTMSSETRLLIEEEVKSFLEKAYNNAKTILTKHNKELHVLANALLEHETLSGAQIKKILAQVNNKQPQEHAIEAPQKTQTSPSSPAAAAAAAAAAAAQQAAAKAQGVAGIGS

SEQ ID NO: 5618 - protein, 710 aa, Setaria italica
MAWRRVLTQIAKHRPTKAIYNELVASSPLGTLRTEVTAGARIRNLQERNQSSYIGSLARRVRDLDAPSETSLLKEIYRSDPERVIQIFESQPSLHSNPAALSEYVKALVRVDRLDESTLLKTLQRGVAASTRGEESFGSIPALIGAGQATKDGVLGTANAPIHMVTAETGQFKDQLWRTFRSIALTFLLISGIGALIEDRGISKGLGLNEEVQPSIESNTKFSDVKGVDEAKSELEEIVHYLRDPKRFTRLGGKLPKGVLLVGPPGTGKTMLARAIAGEAGVPFFSCSGSEFEEMFVGVGARRVRDLFAAAKKRSPCIIFIDEIDAIGGSRNPKDQQYMKMTLNQLLVELDGFKQNEGIIVIAATNFPESLDKALVRPGRFDRHIVVPNPDVEGRRQILDSHMSKVLKGDDVDLMIIARGTPGFSGADLANLVNVAALKAAMDGAKAVTMNDLEYAKDRIMMGSERKSAVISDECRKLTAYHEGGHALVAIHTDGAHPVHKATIVPRGMALGMVAQLPEKDETSVSRKQMLANLDVCMGGRVAEELIFGDTEVTSGASSDFQQATATARAMVTKYGMSKQVGLVSYNYEDDGKSMSSETRLLIEQEVKNFLENAYNNAKTILTKHNKELHALANALLEHETLTGAQIKNILAQVNNKQQQEHAIEAPQKTPAAPASPASPAASAAAAAAAAAAAAQQAAAKAKGVAGIGS

SEQ ID NO: 5619 - protein, 715 aa, Oryza sativa
MAWRRVLSQVARNRSAYAICNEIIASNPSRILRGDTIAGGTLRNLHERYQSSYVGSFARRMRQMDSPSEASLLKEIYRSDPERVIQIFESQPSLHSNPSALAEYVKALVRVDRLEDSTLLKTLQRGIAASAREEENLGSVSENLGSVSAVRSAGQVTKDGILGTANAPIHMVTAETGQFKEQLWRTFRSIALTFLLISGIGALIEDRGISKGLGLNEEVQPSMESNTKFSDVKGVDEAKAELEEIVHYLRDPKRFTRLGGKLPKGVLLVGPPGTGKTMLARAIAGEAGVPFFSCSGSEFEEMFVGVGARRVRDLFAAAKKRSPCIIFMDEIDAIGGSRNPKDQQYMKMTLNQLLVELDGFKQNEGIIVIAATNFPESLDKALVRPGRFDRHIVVPNPDVEGRRQILESHMSKVLKSDDVDLMIIARGTPGFSGADLANLVNVAALKAAMDGAKAVTMNDLEYAKDRIMMGSERKSAVISDESRKLTAYHEGGHALVAIHTEGAHPVHKATIVPRGMALGMVAQLPDKDETSVSRKQMLARLDVCMGGRVAEELIFGDSEVTSGASSDFQQATAVARAMVTKYGMSKQLGFVSYNYEDDGKSMSTETRLLIEKEVKCFVENAYNNAKNILIKHNKELHALANALLEHETLTGAQIKNILAQVNNKQQQEHAIEAPQKTPAVPSSPAASAAAAAAAAAAAAQQAAAKAKGEIAGIGS

SEQ ID NO: 5620 - protein, 710 aa, Sorghum bicolor
MAWRRVLTQIARHRPTKAIYNELVASSPLGTLRSDITAGARIKNLQERNQSSYIGSLARRVRDLESPSETSLLKEIYRSDPERVIQIFESQPSLHSNPAALSEYVKALVRVDRLDESALLKTLQRGAASSTRGEESFGSIPALIGAGQVTKDGALGTANAPIHMVTAETGQFKDQLWRTFRSIALTFLLISGIGALIEDRGISKGLGLNEEVQPSMESTTKFSDVKGVDEAKSELEEIVHYLRDPKRFTRLGGKLPKGVLLVGPPGTGKTMLARAIAGEAGVPFFSCSGSEFEEMFVGVGARRVRDLFAAAKKRSPCIIFIDEIDAIGGSRNPKDQQYMKMTLNQLLVELDGFKQNEGIIVIAATNFPESLDKALVRPGRFDRHIVVPNPDVEGRRQILESHMSKILKSDDVDLMIIARGTPGFSGADLANLVNVAALKAAMDGAKAVTMNDLEYAKDRIMMGSERKSAVISDECRKLTAYHEGGHALVAIHTEGAHPVHKATIVPRGMALGMVAQLPDKDQTSVSRKQMLAKLDVCMGGRVAEELIFGDTEVTSGASSDFQQATAMARAMVTKYGMSKQVGLVSYNYEDDGKSLSSETRLVIEQEVKNFLENAYNNAKTILTKHNKELHALANALLEHETLTGAQITNILAQVHNKQQQEHTIEAPQKTPAAPASPASPAASAAAAAAAAAAAAQQAAAKAKGVAGMGS

SEQ ID NO: 5621 - protein, 710 aa, Saccharum officinarum
MAWRRVLTQIARHRPTKAIYNELVASSPLGALRSDITAGARIRNLQERNQSSYIGSLARRVRDLESPSETSLLKEIYRSDPERVIQIFESQPSLHSNPAALSEYVKALVRVDRLDESALLKTLQRGVASSTRGEESFSSIPALIGAGQVTKDGALGTANAPIHMVTAETGQFKDQLWRTFRSIALTFLLISGIGALIEDRGISKGLGLNEEVQPSMESSTKFSDVKGVDEAKSELEEIVHYLRDPKRFTRLGGKLPKGVLLVGPPGTGKTMLARAIAGETGVPFFSCSGSEFEEMFVGVGARRVRELFAAAKKRSPCIVFIDEIDAIGGSRNPKDQQYMKMTLNQLLVELDGFKQNEGIIVIAATNFPESLDKALVRPGRFDRHIVVPNPDVEGRRQILESHMSKILKSDDVDLMIIARGTPGFSGADLANLVNVAALKAAMDGAKAVTMNDLEYAKDRIMMGSERKSAVISDECRKLTAYHEGGHALVAIHTEGAHPVHKATIVPRGMALGMVAQLPDKDQTSVSRKQMLAKLDVCMGGRVAEELIFGDTEVTSGASSDFQQATAMARAMVTKYGMSKQVGLVSYNYEDDGKSLSSETRLVIEQEVKNFLENAYNNAKTILTKHNKELHALANALLEHETLTGAQITNILAQVHNKQQQEHTIEAPQKTPAAPASPASPAASAAAAAAAAAAAAQQAAAKAKGVAGMGS

SEQ ID NO: 5622 - protein, 720 aa, Zea mays
MLVALADPGLCVFCVVLTQIARHRPAKAIYNELVASSPLGVLRSDITSGARIRHLQERNQSSYIGSLARRVRDLESPSGTSLLKEIYRSDPERVIQIFESQPSLHSNPAALSEYVKALVRVDRLDESALLKTLQRGVASSTRGEESFSSIPALIGAGQVTKDGALGTANAPIHMVTAETGQFKDQLWRTFRSIALTFLLISGIGALIEDRGISKGLGLNEEVQPSIESKTKFSDVKGVDEAKSELEEIVHYLRDPMRFTCLGGKLPKGVLLVGPPGTGKTMLARAIAGEAGVPFFSCSGSEFEEMFVGVGARRVRDLFAAAKKRSPCIIFIDEIDAIGGSRNPKDQQYMKMTLNQLLVELDGFKQNEGIIVIAATNFPESLDKALVRPGRFDRHIVVPNPDVEGRRQILESHMSKILKGDDVDLMIIARGTPGFSGADLANLVNVAALKAAMDGAKAVTMDDLEYAKDRIMMGSERKSAVISDECRKLTAYHEGGHALVAIHTEGAHPVHKATIVPRGMALGMVAQLPDKDQTSVSRKQMLAKLDVCMGGRVAEELIFGDTEVTSGASSDFQQATAMARAMVTKYGMSKQVGLVSYNYEDDGKSMSSETRLAIEQEVKNFLENAYSNAKTILTKHNKELHALANALLEHETLTGAQIKNILAQVHNKQQHEHTIEAPQKASVAPASPASPAASAAAAAAAAAAAAQQAAAKAKGVAGMGS

SEQ ID NO: 5623 - protein, 691 aa, Zea mays
MAWRRVLTQIARHRPTKAIYNELVASSPLGAFQSDITAGARIKNLQERNQSSYIGSLARRVRDLESPSQTSLLKEIYRSDPERVIQIFESHPSLHSNPAALSEYVKALVRVDRLDESALLKTLQRGVVSLTRGEESFSSIPALIGAGQLTKDGALGTANAPIHMVTAETGQFKDQLWRTFRSIALTFLLISGIGALIEDRGISKGLGLNEEVQPSIESTTKFSDVKGVDEAKSELEEIVHYLRDPKRFTRLGGKLPKGVLLVGPPGTGKTMLARAIAGEAGVPFFSCSGSEFEEMFVGVGARRVRDLFAAAKKRSPCIIFIDEIDAIGGSRNPKDQQYMKMTLNQLLVELDGFKQNQGIIVIAATNFPESLDKALIRPGRFDRHIVVPNPDVEGRRQILESHMSKILKGDDVDLMIIARGTPGFSGADLANLVNVAALKAAMDGAKSVTMNDLEYAKDRIMMGSERKSAVISDECRKLTAYHEGGHALVAIHTEGAHPVHKATIVPRGVALGMVAQLPDKDQTSVSRKQMLAKLDVCMGGRVAEELIFGDTEVTSGASSDFQQATAMARAMVTKYGMSKHVGLVSYNYEDDGKSVSSETRLVIEQEVKNFLENAYNNAKTILTKHNKELHALANALLEHETLTGAQITNILAQVRNKQQQEHTVEAPQRAPASPAAQQAAAKAKGVAGMGS

SEQ ID NO: 5624 - protein, 547 aa, Panicum virgatum
MVTAETGQFKDQLWRTFRSIALTFLLISGIGALIEDRGISKGLGLNEEVQPSMESNTKFSDVKGVDEAKSELEEIVHYLRDPKRFTRLGGKLPKGVLLVGPPGTGKTMLARAIAGEAGVPFFSCSGSEFEEMFVGVGARRVRDLFAAAKKRSPCIIFIDEIDAIGGSRNPKDQQYMKMTLNQLLVELDGFKQNEGIIVIAATNFPESLDKALVRPGRFDRHIVVPNPDVEGRRQILESHMSKVLKSDDVDLMIIARGTPGFSGADLANLVNVAALKAAMDGAKAVTMTDLEYAKDRIMMGSERKSAVISDECRKLTAYHEGGHALVAIHTEGAHPVHKATIVPRGMALGMVSQLPEKDETSVSRKQMLANLDVCMGGRVAEELIFGDIEVTSGASSDFQQATATARAMVTKYGMSKQVGLVSYNYEDDGKSLSSETRLLIEQEVKNFLENAYNNAKTILTKHNKELHALANALLEHETLTGAQIKNILAQVNNKQQQEHAIEAPQKNPAAPASPASPAASAAAAAAAAAAAAQQAAAKAKGVAGIGS

SEQ ID NO: 5625 - protein, 709 aa, Oryza sativa
MAWRRVLSQLARSRPASTIYNELITSRPSWLLRGDVNGGGTLKNLNERYQSSFVGSLARRVQNLDVPSEASLLKEIYKSDPERVIQIFESQPWLHSNRLALSEYVKALVKVDRLDDSTLLKTLRRGMAVSGGEGERVGSSSALKSAGQATKDGILGTANAPIHMVTSETGHFKDQIWRTFRSLALTFLVISGIGALIEDRGISKGLGLSQEVQPIMDSKTKFSDVKGVDEAKAELEEIVHYLRDPKRFTHLGGKLPKGVLLVGPPGTGKTMLARAVAGEAGVPFFSCSGSEFEEMFVGVGARRVRDLFAAAKKRSPCIIFMDEIDAIGGSRNPKDQQYMRMTLNQLLVELDGFKQNEGIIVIAATNFPQSLDKALVRPGRFDRHIVVPNPDVEGRRQILESHMLKVLKSDDVDLMIIARGTPGFSGADLANLVNVAALKAAMDGAKAVTMNDLEYAKDRIMMGSERKSAVISDESRKLTAYHEGGHALVAIHTEGARPVHKATIVPRGRTLGMVSQLPEKDETSFSRKQMLAWLDVSMAGRVAEELIFGDSEVTSGASSDFQNATKMARAMVTKYGMSKQLGFVSYNYEDDGKSMSTETRLLIEQEVKSLLENAYNNAKTILTKHSKEHHVLAQALLEHETLTGAQIKKILAQANSTQQQQEHAVEAPRKTPAAPSSPAASAAAAAAATAAAAAKQAAAKAKGVAGIGS

SEQ ID NO: 5626 - protein, 707 aa, Secale cereale
MAWRLALSKAGRRSSSVIYNELASTSAFRTPANGTGGVLKALQERYRSSYVGSFARRLRDFDTPSEASLLKEIYRSNPERVVQIFESQPSLHNNSSALSQYVKALVALDRLDESPLLKTLQRGIANSAREEEGFSGIPAFQSVGRTTKDGALGTAGAPIHMVASETGQFKEQLWRTFRSIALTFLVISGIGALIEDRGISKGLGLHEEVQPSLDSSTKFSDVKGVDEAKAELEEIVHYLRDPKRFTRLGGKLPKGVLLVGPPGTGKTMLARAIAGEAGVPFFSCSGSEFEEMFVGVGARRVRDLFSAAKKRSPCIIFIDEIDAIGGSRNPKDQQYMKMTLNQLLVELDGFKQNDGIIVIAATNFPQSLDKALVRPGRFDRHIVVPNPDVEGRRQILETHMSKVLKADDVDLMTIARGTPGFSGADLANLVNVAALKAAMDGAKSVSMTDLEFAKDRIMMGSERKSAVISDESRKMTAYHEGGHALVAIHTAGAHPVHKATIVPRGMALGMVTQLPEKDQTSVSRKQMLARLDVCMGGRVAEELIFGESEVTSGASSDLSQATRLAKAMVTKYGMSKRVGLVAYNYDDDGKTMSTQTRGLVEQEVKELLETAYNNAKTILTTHNKELHALANALIERETLTGAQIKNLLSQVDSSSDSQQQPQAAEVPQQTPAAPASPQSPAAAAAAAAAAAAQQAAAQAKGVAGIGS

SEQ ID NO: 5627 - protein, 706 aa, Triticum aestivum
MAWRLALSKAGRRSSSVVYNELVSTSAFRTPANGTGGVLKALQERYRSSYVGSFARRLRDFDTPSDASLLKEIYRSNPERVVQIFESQPSLHNNSSALSQYVKALVALDRLDESPLLKTLQRGIVNSAREEEGFSGIPAFQSVGRTTKDGALGTAGAPIHMVASETGQFKEQLWRTFRSIALTFLVISGIGALIEDRGISKGLGLHEEVQPSLDSSTKFSDVKGVDEAKAELEEIVHYLRDPKRFTRLGGKLPKGVLLVGPPGTGKTMLARAIAGEAGVPFFSCSGSEFEEMFVGVGARRVRDLFSAAKKRSPCIIFIDEIDAIGGSRNPKDQQYMKMTLNQLLVELDGFKQNDGIIVIAATNFPQSLDKALVRPGRFDRHIVVPNPDVEGRRQILETHMSKVLKADDVDLMTIARGTPGFSGADLANLVNVAALKAAMDGAKSVSMTDLEFAKDRIMMGSERKSAVISDESRKMTAYHEGGHALVAIHTAGAHPVHKATIVPRGMALGMVTQLPEKDQTSVSRKQMLARLDVCMGGRVAEELIFGESEVTSGASSDLSQATRLAKAMVTKYGMSKRVGLVAYNYDDDGKTMSTQTRGLVEQEVKELLETAYNNAKTILTTHNKELHALANALIERETLTGAQIKNLLSQVNSSSDTQQPQAAEVPQQTPAAPASPQSPAAAAAAAAAAAAQQAAAQAKGVAGIGS

SEQ ID NO: 5628 - protein, 706 aa, Triticum aestivum
MAWRLALSKAGRRSSSVVYNELVSTSAFRTPANGTGGVLKTLQERYRSSYVGSFARRLRDFDTPSEASLLKEIYRSNPERVVQIFESQPSLHNNSSALSQYVKALVALDRLDESPLLKTLQRGIVNSAREEEGLSGIPAFQSVGRTTKDGALGTAGAPIHMVASETGQFKEQLWRTFRSIALTFLVISGIGALIEDRGISKGLGLHEEVQPSLDSSTKFSDVKGVDEAKAELEEIVHYLRDPKRFTRLGGKLPKGVLLVGPPGTGKTMLARAIAGEAGVPFFSCSGSEFEEMFVGVGARRVRDLFSAAKKRSPCIIFIDEIDAIGGSRNPKDQQYMKMTLNQLLVELDGFKQNDGIIVIAATNFPQSLDKALVRPGRFDRHIVVPNPDVEGRRQILETHMSKVLKADDVDLMTIARGTPGFSGADLANLVNVAALKAAMDGAKSVSMTDLEFAKDRIMMGSERKSAVISDESRKMTAYHEGGHALVAIHTAGAHPVHKATIVPRGMSLGMVTQLPEKDQTSVSRKQMLARLDVCMGGRVAEELIFGESEVTSGASSDLSQATRLAKAMVTKYGMSKRVGLVAYNYDDDGKTMSTQTRGLVEQEVKELLETAYNNAKTILTTHNKELHVLANALIERETLTGAQIKNLLSQVNSSGDTQQPQAAEVPQQTPAAPASPQSPAAAAAAAAAAAAQQAAAQAKGVAGIGS

SEQ ID NO: 5629 - protein, 552 aa, Ananas comosus
MAWRRLLTKVVKNQLEHPYIHGLGGHPRLSTLTAGASGSKRLRNLSERYQSSYVGGFSRKLRDVDGSNEVSLLKELYRSDPERVIRIFESQPSLHANPSALAEYVKALVKVDRLDESSLLKTLQRGIASSPREEDSLNSIPALKNVGQITKDGVLGTASAPIHMVTAETSNFKEQLWRTFRSIALTFLLISGVGALIEDRGISKGLGLHEEVQPSIDSGTKFTDVKGVDEAKAELEEIVHYLRDPKRFTRLGGKLPKGVLLVGPPGTGKTMLARAIAGEAGVPFFSCSGSEFEEMFVGVGARRVRDLFAAAKKRSPCIIFIDEIDAIGGSRNPKDQQYMKMTLNQLLVELDGFKQNEGIIVIAATNFPESLDKALVRPGRFDRHIVVPNPDVEGRRQILDSHMSKVLKADDVDLMIIARGTPGFSGADLANLVNVAALKAAMDGAKAVSMADLEYAKDRIMMGSERKSAVISEENRKLTAYHEGGHALVAIHTDGALPVHKATIVPRGMSLGMVAQLPEKDETSISRKQMLARLDVCMGGGLLRSSSMGRTR

SEQ ID NO: 5630 - protein, 712 aa, Musa acuminata
MAWRRLLTKLRKQQFLGHPQLFGSGQFHHVGHKVEGGLGSKLGNLHGRFQSSYVGTFARRVRDTDVSNDVTLLKELYRSDPERVIRLFESQPSLHSNPSALAEYVKALVKVDRLEQSTLLKTLQRGIANSAREEDSIDSISSIPALKNVGQSTKDGILGTASAPIHMVTAETSNFKEQLWRTFRTIAVSFLVLSGVGALIEDRGLSKGLGLHEEVQPSMDSSTKFSDVKGVDEAKAELEEIVHYLRDPKRFTRLGGKLPKGVLLVGPPGTGKTMLARAIAGEAGVPFFSCSGSEFEEMFVGVGARRVRDLFTAGKKRSPCIIFIDEIDAIGGSRNPKDQQYMKMTLNQLLVELDGFKQNEGIIVIAATNFPESLDKALVRPGRFDRHIVVPNPDVEGRRQILESHMSKVLKADDVDLMIIARGTPGFSGADLANLVNVAALKAAMDGAKAVTMADLEYAKDKIMMGSERKSAVISDESRKLTAYHEGGHALVAIHTDGALPVHKATIVPRGMSLGMVAQLPDKDETSISKKQMLARLDVCMGGRVAEELIFGENEVTSGASSDLQQATSVARAMVTKYGMSKQVGLVSHNYDDNGKSMSTETRLLIEEEVKGFLERAYHNAKTILITNNKELHALANALLEHETLSGVQIKNLLAQVNSQQQQPQLVAAPHVSTPPVPTAPPSAAAAAAAAAAAAAQAAAKAKGVAQPAVGS

SEQ ID NO: 5631 - protein, 709 aa, Cocos nucifera
MALRHLLTKIAKQQLEPPFLYQLSGRSCLASHLVEGCGGSRLRNFHQRFQSSYVGSFARRARDADGTNDVALLKELYRSDPERVIRLFESQPSLHSNPSALAEYVKALVQVDRLDESSLLKTLQRGIVNSAREGESISSIPALRNVGQTTKEGILGTANAPIHMVTAETGQFKEQLWRTFRTIALTFLLISGVGALIEDRGISKGLGLHEEVQPSMDSSTKFNDVKGVDEAKAELEEIVHYLRDPKRFTRLGGKLPKGVLLVGPPGTGKTMLARAIAGEAGVPFFSCSGSEFEEMFVGVGARRVRDLFAAAKKRSPCIIFIDEIDAIGGSRNPKDQQYMKMTLNQLLVELDGFKQNEGIIVIAATNFPESLDKALVRPGRFDRHIAVPNPDVEGRRQIMESHMSKVLKADDVDLMIIARGTPGFSGADLANLVNIAALKAAMDGAKAVSMSDLEYAKDRIMMGSERKSAVISDESRRLTAYHEGGHALVAVHTDGALPVHKATIVPRGMSLGMVAQLPEKDETSISRKQMLARLDVCMGGRVAEELIFGENEVTSGASSDLEQATYLARAMVTKYGMSKQVGLVAHDYDDNGKSMSTETRLLIEEEVKNFLERAYNNAKTILTTHGKELHALANALLEHETLSGAQIKKLLAQVNTQQQQQVVTAPQTTTPAVPTAPPSAASAAAAAAAAAAAQAAAKAKGVAQPVVGS

SEQ ID NO: 5632 - protein, 709 aa, Cocos nucifera
MALRRLLTKIAKQKLEHSYLYQLSGRSRPASYFVEGSGGNRLRNFHQRFQSSYVGSFARRARDADGTNDVALLKELYRSDPERVIRLFESQPSLHSNPSALAEYVKALVQVDRLDESSLLKTLQRGIVNSAREGESISSIPALRNVGQTTKEGILGTANAPIHMVTAETGQFKEQLWRTFRTIALTFLLISGVGALIEDRGISKGLGLHEEVQPSMDSSTKFNDVKGVDEAKAELEEIVHYLRDPKRFTRLGGKLPKGVLLVGPPGTGKTMLARAIAGEAGVPFFSCSGSEFEEMFVGVGARRVRDLFAAAKKRSPCIIFIDEIDAIGGSRNPKDQQYMKMTLNQLLVELDGFKQNEGIIVIAATNFPESLDKALVRPGRFDRHIAVPNPDVEGRRQIMESHMSKVLKADDVDLMIIARGTPGFSGADLANLVNIAALKAAMDGAKAVSMSDLEYAKDRIMMGSERKSAVISDESRRLTAYHEGGHALVAVHTDGALPVHKATIVPRGMSLGMVAQLPEKDETSISRKQMLARLDVCMGGRVAEELIFGENEVTSGASSDLEQATYLARAMVTKYGMSKQVGLVAHDYDDNGKSMSTETRLLIEEEVKNFLERAYNNAKTILTTHGKELHALANALLEHETLSGAQIKKLLAQVNTQQQQQVVTAPQTTTPAVPTAPPSAASAAAAAAAAAAAQAAAKAKGVAQPVVGS

SEQ ID NO: 5633 - protein, 709 aa, Cocos nucifera
MALRRLLTKIAKQKLEHSYLYQLSGRSRPASYFVEGSGGSRLRNFHQRFQSSYVGSFARREWDADGPNDVALLKELYRSDPERVIRLFESQPSLHSNPSALAEYVKALVKVDRLDESSLLKTLQRGIAKSAREEESISSIPASRNVGQMTKEGILGTASAPIHMVTAETGHFKEQLWRTFRTIALTFLLISGVGALIEDRGISKGLGLHEEVQPSMDSSTKFNDVKGVDEAKAELEEIVHYLRDPKRFTRLGGKLPKGVLLVGPPGTGKTMLARAIAGEAGVPFFSCSGSEFEEMFVGVGARRVRDLFAAAKKRSPCIIFIDEIDAIGGSRNPKDQQYMKMTLNQLLVELDGFKQNEGIIVIAATNFPESLDKALVRPGRFDRHIAVPNPDVEGRRQIMESHMSKVLKADDVDLMIIARGTPGFSGADLANLVNIAALKAAMDGAKAVSMSDLEYAKDRIMMGSERKSAVISDESRRLTAYHEGGHALVAVHTDGALPVHKATIVPRGMSLGMVAQLPEKDETSISRKQMLARLDVCMGGRVAEELIFGENEVTSGASSDLEQATYLARAMVTKYGMSKQVGLVAHDYDDNGKSMSTETRLLIEEEVKNFLERAYNNAKTILTTHGKELHALANALLEHETLSGAQIKKLLAQVNTQQQQQVVTAPQTTTPAVPTAPPSAASAAAAAAAAAAAQAAAKAKGVAQPVVGS

SEQ ID NO: 5634 - protein, 710 aa, Musa acuminata
MAWRRVLTRVRSVPFRLPRFLSFLFFVTFCMFSLLAGNRLGNFHERFQSSYVGSFARRARDTDGPNDVMLLKELYRSDPERVIRLFESQPSLHSNPSALAEYVKALVKVDRLDQSTLFKTLQRGVSNSAMEESINSISSVPALKNVGQSTKDGILGTASAPIHMVTAETSNFKEQLWRTFRTIAVSFLVISGVGALIEDRGLSKGLGLHEEVQPSMDSSTKFSDVKGVDEAKAELEEIVHYLRDPKRFTRLGGKLPKGVLLVGPPGTGKTMLARAIAGEASVPFFSCSGSEFEEMFVGVGARRVRDLFTAAKKRSPCIIFIDEIDAIGGSRNPKDQQYMKMTLNQLLVELDGFKQNEGIIVIAATNFPESLDKALVRPGRFDRHIVVPNPDVEGRRQILESHMSKVLKADDVDLMIIARGTPGFSGADLANLVNVAALKAAMDGAKAVTMADLEYAKDKIMMGSERKSAVISDESRRLTAYHEGGHALVAIHTDGALPVHKATIVPRGMSLGMVAQLPDKDETSISKKQMLARLDVCMGGRVAEELIFGESEVTSGASSDLQQATSVARAMVTKYGMSKQVGLVSHNYDDNGKSMSTETRLLIEKEMKDFLERAYNNAKTILTTHNKELHALANALLEHETLSGAQIKNLLAQVNSQQQQPQVVVAPQVNTPAVPPTPPSAAATAAAAAAAAAAQAAAKAKGVAQPAVGT

SEQ ID NO: 5635 - protein, 723 aa, Setaria italica
MAWRLSISKVARHRSANAICSQLQASFPFRAPRSDTGAGSTLRNLHERYHSSYASSFPRWIRDFDSRSEASLLKEIYRSDPERVVQIFERHPSLHSNSSALSEYIKALVSLDRLEDSPLLKTMQRGLASSATEGERRTGLAAFASVGRQTKDGALGTANAPIHMVTAETGQFKEQLWKTFRSIALTFIVISGIGALIEDKGISKGLGLNEEVQPSTNSTTKFSDVKGVDEAKAELEEIVHYLRDPKRFTRLGGKLPKGVLLVGPPGTGKTMLARAIAGEAGVPFFSCSGSEFEEMFVGVGARRVRDLFNAAKKRSPCIIFIDEIDAIGGSRNPKDQQYMKMTLNQLLVELDGFKQNDGIIVIAATNFPQSLDKALVRPGRFDRHIVVPNPDVEGRRQILETHMSKVLKADDVDLMIIARGTPGFSGADLANLVNVAALKAAMDGAKAVTMQDLEFAKDRIMMGSERKSAVISQECRKMTAYHEGGHALVAIHTDGANPVHKATIVPRGMALGMVTQLPEKDQHSVSRKQMLARLDVCMGGRVAEELIFGESEVTSGASSDLRQATRLARAMVTKYGMSERVGLVSYSDDNGSMSAQTRGMIDREVKDILERAYNNAKTILTEHDKELHALANALLEHETLSGAQIKKLLAQVKNSDNKQKKVAKVPKKTPVAPPSPQSPAAAAAAAAAAAAQEAAAKAKGVAGTAAAAQEAAVNAEGVAGIGS

SEQ ID NO: 5636 - protein, 178 aa, Triticum aestivum
MAELLFAPAVAGLVHLPEVLERLAAADADHRDHAHHHTAHGHGHGHPRAQIGGVGGGAPVDIVETPAEYAFLLDVPGLSKSDIQVTLEEDNVLVMKSASNGGGGANGKRKREEEEADCRYIRLERRASPRSFVRKFRLPEDADAGAVAARCENGVLTVTVKKQPPPEKKTKSVQVAIA

SEQ ID NO: 5637 - protein, 179 aa, Pseudoroegneria spicata
MAELLFPPAVAGLVHLPEVLERLAAADADHRDHAHHHAAHGHGHGHPRAQIGGGGGGGAPVDIVETPGEYAFVLDVPGLSKSDIQVTLEEDNVLVMKSASNGGGGANGKRKREEEEGDCRYIRLERRASPRSFVRKFRLPEDADAGAVAARCENGVLTVTVKKQPPPEKKTKSVQVAIA

SEQ ID NO: 5638 - protein, 180 aa, Secale cereale
MAELLFAPAVAGLAHLPEVLERLAAADADHRDHAHHHHAAHGHGHGHPRAQIGGVGGGAPVDIVETPGEYAFVLDVPGLSKSDIQVTLEEDNVLVMKSASNGGGGGANGKRKREEEEADCRYIRLERRSSPRSFVRKFRLPEDADAGAVAARCENGVLTVTVKKQPPPEKKTKSVQVAIA

SEQ ID NO: 5639 - protein, 180 aa, Leymus cinereus x Leymus triticoides
MAELLFAPAVAGLVHLPEVLERLAAADADHRDHAHHHAAHGHGHGHPRAQIGGGGVGGGAPVDIVETPGEYAFVLDVPGLSKSDIQVTLEEDNVLVMKSANNGGGGANGKRKREEEEGDCRYIRLERRASPRSFVRKFRLPEDADAGAVAARCENGVLTVTVKKQPPPEKKTKSVQVAIA

SEQ ID NO: 5640 - protein, 178 aa, Secale cereale
MAELLFAPASAAGHVPECSSALPPRTPTTATTPTTTTPRTGTATATPRADRGVGGGAPVDIVETPGEYAFVLDVPGLSKSDIQVTLEEDNVLVMKSASNGGGGGANGKRKREEEEADCRYIRLERRASPRSFVRKFRLPEDADAGAVAARCENGVLTVTVKKQPPPEKKTKSVQVAIA

SEQ ID NO: 5641 - protein, 86 aa, Secale cereale
MKSATNGNGGGGANGKRKREEEEADCRYIRLERRASPRSFVRKFRLPEDADAGAVAARCENGVLTVTVKKQPPPEKKTKSVKVAIA

SEQ ID NO: 5642 - protein, 363 aa, Triticum aestivum
MATISAALSVSLLPPAARRAVSTATSSPPRVKRAARFRCCAEPPSPEQQETSAPSPPPPELPSSLWGVSTSAWTAGVAGLGLLETGYLSYLKLTGSEAFCPVAGGGCGDVLDSDYSVVFGIPLPLVGMVTYGVVTALSLQENGEELLPGLDDLDIRLTLLLLATSLATASAYFLFILNTKFVGTSCLYCLSSAFISFTLFFIRLKDIGLARIQKFVGLQLAVAVIVALALTNSYSSATTQLKGTGDFVLEPYKTEVTSESTPFAISLARHLHSIGAKMYGAFWCTHCNDQKQLFGREAMEILDYVECFPNGAGKGKKMANECVATGLEGFPTWVINGKLLSGDQELSVLAEESGFVSESPEQS

SEQ ID NO: 5643 - protein, 360 aa, Avena sativa
MATISAALSISFLPPATRLAVSTVSSTRVKRAAQFRCCAEPPSPEQESPAPLPTPPAPPSSLWGVSTSTWTAGVAGLGLLETGYLSYLKLTGSEAFCPVGGGGCGDVLDSDYSVVFGIPLPLVGMVAYGLVAALSLQENGEDLLPGLDDLDIRLTLLLMATSLATASAYFLFILNTKFVGTSCVYCLSSAFISFTLFFIRIKDIGLARIQKFVGLQLAVAVIVALALTNSYSSATTELKGTDDFVLEPYKVEVTTESTPFAISLAKHLHSIGAKMYGAFWCSHCNDQKQMFGREAMEILDYVECFPNGAGKGKKMANECAATGLEGFPTWVINGKLLSGDKELSVLAEESGFASEVPEQS

SEQ ID NO: 5644 - protein, 366 aa, Brachypodium distachyon
MATISAALSIPFLPSPTRFAVSTYFSPRVKRASRFRCCAEPPSPEQETPAPTPPIPPPGEHPASPSSLWGVYTSTWSAGVAGLGFLETSYLSYLKLTGSEAFCPVGGGGCGDVLDSDYSVIFGIPLPLVGLVAYGLVAALSLQENGKELLPGLDDLDIRLVLLLIATSLATASAYFLFILSTKFVGTSCLYCLSSALISFTLFSIRVKDFGLARIQKFVGLQLAVAVIVALALTNSYSSATTQLKGTGDFVLEPYETEITTESTPFAISLARHLHSIGAKMYGAFWCSHCNEQKQMFGREAMEILDYVECFPNGAGKGKKMAAECAVTGLEGFPTWFINGKVLSGDQELSVLAEASGFVSKAPEQS

SEQ ID NO: 5645 - protein, 350 aa, Gossypium raimondii
MPSSPKFFHARTSPPATPHTRSTLLIFASLLTFAIVSFLFALSSFLSSGGSGYRCRNSDPRSVRVIWDKTGHGNNGLSAAGDDDGTKRHKIMGFVGIQTGFGSTGRRQSLRKTWMPSDRQGLQRLEEATGLAFRFVIGRTNDKSKMAELKKEVAEYDDFLLLDIEEEYSKLPYKTLAFFKAAYALFDSEFYVKADDDIYLRPDRLSLLLVKERSHSQTYLGCMKKGPVFTDPKLKWYEPLSFLLGKEYFLHAYGPIYALSADVVASLVALRNDSFRMFSNEDVTIGAWMLAMNVNHEDNRALCEPECTQSSVAVWDIPKCSGLCNPETKMLELHQIDACSKSPTLPSDDD

SEQ ID NO: 5646 - protein, 505 aa, Zea mays
MGLRVAATAPAPAGVRVLGRGAARVTPRPWAAVGGRRRFSVRMSVATTEATTTIAVGASEDQALEARNSKTVVAVILGGGAGTRLFPLTRRRAKPAVPIGGAYRLIDVPMSNCINSGINKVYILTQFNSQSLNRHLSRAYDFSNGVAIGDGFVEVLAATQRPGTEGKRWFQGTADAVRQFDWLFDDAKSKDIEDVLILSGDHLYRMDYMDFVQSHRQRGAGISICCLPIDGSRASDFGLMKIDDTGRVISFSEKPKGDELKAMQVDTTVLGLSKEEAENKPYIASMGIYIFKKDILLNLLRWRFPTANDFGSEIIPASAKEIDVKAYLFNDYWEDIGTIKSFFEANLALAEQPPRFSFYDADKPMYTSRRNLPPSMVNNSKITDSIISHGCFLDNCRIEHSVVGVRSRIGSNVHLKDTVMLGADYYETAVERGELLAEGKVPIGIGENTTIQKCIIDKNARIGKKVVISNSEGVDEADRTSEGFYIRSGITVVLKNAIIADGLVI

SEQ ID NO: 5647 - protein, 504 aa, Brachypodium distachyon
MDLRVAAPASAAAAARRGVPGGGVVRLRALAAGGRQRRLSVRVSVATTEAATAAVGASEDADTETRNARTVVAVILGGGAGTRLFPLTKRRAKPAVPIGGAYRLIDVPMSNCINSGINKVYVLTQFNSASLNRHLSRAYNFSNGVGFGDGFVEVLAATQRPGLEGKRWFQGTADAVRQFDWLFDDAKAKDIEDVIILSGDHLYRMDYMDFVQSHRQRDAGISICCLPIDDSRASDFGLMKIDDTGRVISFSEKPKGDDLKAMQVDTTVLGLSKEEAEEKPYIASMGVYIFKKEILLNLLRWRFPTANDFGSEIIPAAAKEINVKAYLFNDYWEDIGTIKSFFEANLALAEQPPRFSFYDASKPMYTSRRNLPPSMISSSKITDSIISHGCFLDNCRVEHSVVGVRSRVGSNVHLKDTVMLGADFYETDVERSDQLAEGKVPIGIGENTTIQNCIIDKNARIGKNVTIANSEGVQEADRTSEGFHIRSGITVVLKNSVIADGLVI

SEQ ID NO: 5648 - protein, 508 aa, Oryza sativa
MDLRVAAPASVAAAARCGTSLARPWPARAVGGGGGGGGRGRRLSVRTSVATTEAAAAAVGASEDAALEARDSKTVVAVILGGGAGTRLFPLTKRRAKPAVPIGGAYRLIDVPMSNCINSGINKVYILTQFNSASLNRHLSRAYNFSNGVAFGDGFVEVLAATQTPGSEGKRWFQGTADAVRQFDWLFDDAKAKDIDDVLILSGDHLYRMDYMDFVQSHRQRGADISICCLPIDDSRASDFGLMKIDDTGRVIAFSEKPKGDDLKAMQVDTTVLGLPQDEAKEKPYIASMGVYIFKKEILLNLLRWRFPTANDFGSEIIPASAKEINVKAYLFNDYWEDIGTIKSFFEANLSLAEQPPRFSFYDANKPMYTSRRNLPPSMINNSKITDSIISHGCFLDSCRIEHSVVGIRSRIGSNVHLKDTVMLGADFYETDLERGELLAEGKVPIGIGENTKIQNCIIDKNARIGKNVTISNSEGVQEADRTSEGFYIRSGITIVLKNSIIADGLVI

SEQ ID NO: 5649 - protein, 503 aa, Avena sativa
MDLRVAAPASAAAAARRGVLGGGGASLRVPVGRRRSLSVRTSVATTESAATAAVGALEDDDVETRNARTVVAVILGGGAGTRLFPLTKRRAKPAVPIGGAYRLIDVPMSNCINSGINKVYVLTQFNSASLNRHLSRSYNFSNGVGFGDGFVEVLAATQRPGLEGNRWFQGTADAVRQFAWLFDDAKSKDIEDVLILSGDHLYRMDYMDFVQSHRQRDAGISICCLPIDDSRASDFGLMKIDDTGRVISFSEKPKGADLKAMQVDTTILGLPKEEAEKKPYIASMGVYLFKKELLLNLLRWRFPTANDFGSEIIPAAAKEINVKAYLFNDYWEDIGTIKSFFEANLALAEQPPGFSFYDASKPMYTSRRNLPPSMISSSKVTDSIISHGCFLDSCRIEHSVVGIRSRVGSNVHLKDTVMLGADFYETDAERGDQLAEGKVPIGIGENTSIQKCIIDKNARIGKNVIIANSEGVQEADRTSEGFHIRSGITVVLKNSVIADGLVI

SEQ ID NO: 5650 - protein, 503 aa, Avena sativa
MDLRVAAPASAAAAARRGVLGGGGASLRVPVSRRRSLSVRTSVATTEPAATAAVGALEDEDVETRNARTVVAVILGGGAGTRLFPLTKRRAKPAVPIGGAYRLIDVPMSNCINSGINKVYVLTQFNSASLNRHLSRSYNFSNGVGFGDGFVEVLAATQRPGLEGNRWFQGTADAVRQFAWLFDDAKSKDIEDVLILSGDHLYRMDYMDFVQSHRQRDAGISICCLPIDDSRASDFGLMKIDDTGRVISFSEKPKGADLKAMQVDTTILGLPKEEAEKKPYIASMGVYLFKKELLLNLLRWRFPTANDFGSEIIPAAAKEINVKAYLFNDYWEDIGTIKSFFEANLALAEQPPGFSFYDASKPMYTSRRNLPPSMISSSKVTDSIISHGCFLDSCRIEHSVVGVRSRVGSNVHLKDTVMLGADFYETDAERGDQLAEGKVPIGIGENTSIQKCIIDKNARIGKNVIIANSEGVQEADRTSEGFHIRSGITVVLKNSVIADGLVI

SEQ ID NO: 5651 - protein, 247 aa, Saccharum officinarum
MSESSESATEKIMSSIMDTIADNLPKQKSGHFDPGSVSDKVKNKLFGRQKTLHGVLGGGKSADVLLWRNKKISSSVLALATAIWVFFEWLDYHFLTIVSFALVLGMVIQFVWSNFSNMLSGSPSQVPRVELPDELFVNIAVAIGAQVNKFLCFLQDVSCERNLKHFVVAIAGLWAAAVIGSWCNFLTVIYIGFVCVHTLPVLYEKYEDQVDDFLYNLLGLLRDQYQKLDQGVLSKIPKGNMKAKKNE

SEQ ID NO: 5652 - protein, 247 aa, Sorghum bicolor
MSERSESATEKIMSSIMDTIADNLPKQKSGHFDPGSVSDKVKNKLFGRQKTLHGVLGGGKPADVLLWRNKKISSSVLALATAIWVFFEWLDYHFLTIVSFALVLGMVVQFIWSNFSNMLSGSPSQVPRVELPEELFVNIAIAIGAQVNKFMCFLQDVSCERNLKHFVVAIAGLWAAAVIGSWCNFLTVIYIGFVCVHTLPVLYEKYEDQVDDFLYNLLGLLRDQYQKLDQGVLSKIPKGNMKAKKNE

SEQ ID NO: 5653 - protein, 247 aa, Pennisetum glaucum
MSERSESATEKIMSSIIDTIADNLPKQKSGQFDPGSVSDKVKNKLFGRQKTLHGALGGGKPADVLLWRNKKISSSVLAVATAIWVFFEWLDYHFLTIISFALVLGMVGQFVWSNFSNMLNGSPSKVPRVELPDELFVNIAVAIGAQVNKFLNFLQDVSCERNLKHFVVAIAGLWAAAVIGSWCNFLTVIYIGFVCAHTLPVLYEKYEDQVDDFLYNLLGLLRDQYQKLDQGVLSKIPKGNLKAKKNE

SEQ ID NO: 5654 - protein, 247 aa, Setaria italica
MSERSESATEKIMSSIIDTIADNLPKQKSGQFGPGSVSDKVKNKLFGRQKTLHGALGGGKPADCLLWRNKKISSSVLAVATAIWVFFEWLDYHFLTIVSFALVLGMVVQFVWSNFSNMLSGSPSQVPRVELPDELFVNIAVAIGAQINKFLSFLQDLSCERNLKHFVVAIAGLWAAAVIGSWCNFLTVIYIGFVCAHTLPVLYEKYEDQVDNFLYSLLGLLQDQYQKLDQGVLSKIPKGNLKAKKNE

SEQ ID NO: 5655 - protein, 247 aa, Panicum virgatum
MSERSGSATEKIMSSIIDSIADNLPKQKSGQFDPGAVSEKVKNKLFGRQKTLHGVLGGGKPADVLLWRNKKISSSVLALATAIWVFFEWLDYHFLTIVSFALVLGMVVQFVWSNFSNMLSGSPSQVPRVELPDEMFVNIAVAIGAQVNKFLSFLQDVSCERNLKHFLVSIAGLWAAAVIGSWCNFLTVIYIGFVCAHTLPVLYEKYEDQIDDFLYNLLGLLRDQYQKLDQGVLSKIPKGNMKAKKNE

SEQ ID NO: 5656 - protein, 118 aa, Panicum virgatum
MSERSGSATEKIMSSIIDSIADNLPKQKSGQFDPGAVSEKVKNKLFGRQKTLHGVLGGGKSADVLLWRNKKISSSVLALATAIWVFFEWLDYHFLTIVSLPLFLECLSSLFGPISQTC

SEQ ID NO: 5657 - protein, 247 aa, Oryza sativa
MLEHSESATEKIMSSIMDTIAENLPKQKSGKFDVGAASDKMKEKLFGRQKTIHRVLGGGKPADVLLWRNKKISSSVLALATAIWVFFEWLDYHFLTIVSFALVLGMVVQFVWSNFSSALSGSPSKVPRVELPEELFVNIAVAVGTQVNKFLSFLQDVSCERNLKHFVLAIVGLWAAAVIGGWCNFLTVIYIGFVSAHTLPVLYEKYEDQVDDFLYNILGLLRDQYQKLDQGVLSKIPKGNMKFKKSE

SEQ ID NO: 5658 - protein, 265 aa, Echinochloa colona
MEYLAYVTASRATIYRHHLCLSVLHLSLLSVCSIMDTIADNLPKQKSGHFDPSSVSDKVKNKLFGRQKTLHGVLGGGKPADVLLWRNKKISSSVMALATAIWVFFEWLDYHFLTIVSFALVLGMVVQFVWSNFSNMLSGSPSQVPRVELPDELFVNIAVAIGAQVNKFLSFLQDVSCERNLKHFVVAIAGLWAAAVIGSWCNFLTVIYIGFVCAHTLPVLYEKYEDQVDDFLYNLLGLLRDQYQKLDQGVLSKIPKGNMKAKKNE

SEQ ID NO: 5659 - protein, 516 aa, Sorghum bicolor
METSAPPNAAAPPAQQPRRRLPDFQQSVRLKYVKLGYHYLISHGMYLLLSPLMALVAVQLSTVSPRDLADLWEQLRFNLLSVVACSTLLVFLSTVYFLTRPRPVYLLDFACYKPEPERKCTRQTFMHCSNLTGSFTDDNLEFQRKILERSGLGEDTYLPPAVLRVPPNPCMDEARKEARAVMFGAIDQLLEKTGVRPKDIGVLVVNCSLFNPTPSLSAMVVNHYKLRGNIVSYNLGGMGCSAGLLSIDLAKDLLQVHPNSYALVISMENITLNWYFGNNRSMLVSNCLFRMGGAAILLSNRRSDRRRSKYELVHTVRTHKGADDKCFGCVTQEEDEIGKIGVSLSKDLMAVAGDALKTNITTLGPLVLPLSEQLLFMGTLIAKKVLKMKIKPYIPDFKLAFEHFCIHAGGRAVLDELEKNLELTDWHMEPSRMTLYRFGNTSSSSLWYELAYTEAKGRIRKRDRIWQIAFGSGFKCNSAVWKALRTVNPAKEKSPWMDEIDNFPVDVPKISKVGGA

SEQ ID NO: 5660 - protein, 521 aa, Panicum virgatum
MGTSAAEPNAAPAPPAAEPAQPRRRMPDFQQSVRLKYVKLGYHYLISHGMYLLLSPLMALVAVQLSTVSPRDLADLWEQLRFNLLSVVACSTLLVFLSTVYFLTRPRPVYLLDFACYKPEPERKCTRETFMHCSKLTGSFTDDNLEFQRKILERSGLGEDTYLPAAVLRVPPNPCMDEARKEARAVMFGAIDQLLEKTGVRPKDIGVLVVNCSLFNPTPSLSAMVVNHYKLRGNIVSYNLGGMGCSAGLLSIDLAKDLLQVHPNSYALVISMENITLNWYFGNNRSMLVSNCLFRMGGAAILLSNKRSDRRRSKYELVHTVRTHKGADDKCFGCVTQEEDEIGKIGVSLSKDLMAVAGDALKTNITTLGPLVLPLSEQLLFMATLVAKKLLKMKIKPYIPDFKLAFEHFCIHAGGRAVLDELEKNLELTDWHMEPSRMTLYRFGNTSSSSLWYELAYSEAKGRIRKRDRIWQIAFGSGFKCNSAVWKALRTVNPAKEKNPWMDEIDNFPVDVPRISKVGNA

SEQ ID NO: 5661 - protein, 521 aa, Panicum virgatum
MGTSAAEPNAAPAPPAAEPAQPRRRMPDFQQSVRLKYVKLGYHYLISHGMYLLLSPLMALVAVQLSTVSPRDLADLWEQLRFNLLSVVACSTLLVFLSTVYFLTRPRPVYLLDFACYKPEPERKCTRETFMHCSKLTGSFTDENLEFQRKILERSGLGEDTYLPPAVLRVPPNPCMDEARKEARAVMFGAIDQLLKKTGVRPKDIGVLVVNCSLFNPTPSLSAMVANHYKLRGNIVSYNLGGMGCSAGLLSIDLAKDLLQVHPNSYALVISMENITLNWYFGINRSMLVSNCLFRMGGAAILLSNKRSDRRRSKYELVHTVRTHKGADDKCFGCVTQEEDEIGKIGVSLSKDLMAVAGDALKTNITTLGPLVLPLSEQLLFMATLVAKKVLKMKIKPYIPDFKLAFEHFCIHAGGRAVLDELEKNLELTDWHMEPSRMTLYRFGNTSSSSLWYELAYSEAKGRIRKRDRIWQIAFGSGFKCNSAVWKALRTVNPAKEKNPWMDEIDNFPVDVPRISKVGNA

SEQ ID NO: 5662 - protein, 521 aa, Setaria italica
MGTSAAEPNAAPAPPAPEPARPRQRLPDFQQSVRLKYVKLGYHYLISHGMYLLLSPLMALVAVQLSTVSPRDLADLWEQLRFNLLSVVACSTLLVFLSTVYFLTRPRPVYLLDFACYKPEPERKCTRETFMHCSKLTGSFTDENLEFQRKILERSGLGEDTYLPPAVLRVPPNPCMDEARNEARAVMFGAIDQLLEKTGVRPKDIGVLVVNCSLFNPTPSLSAMVVNHYKLRGNIVSYNLGGMGCSAGLLSIDLAKDLLQVHPNSYALVISMENITLNWYFGNNRSMLVSNCLFRMGGAAILLSNKRSDRRRSKYELVHTVRTHKGADDKCFGCVTQEEDEIGKIGVSLSKDLMAVAGDALKTNITTLGPLVLPLSEQLLFMATLVAKKVLKMKIKPYIPDFKLAFEHFCIHAGGRAVLDELEKNLELTDWHMEPSRMTLYRFGNTSSSSLWYELAYSEAKGRIRKRDRIWQIAFGSGFKCNSAVWKALRTVNPTKEKSPWMDEIDNFPVDVPKISKVGNA

SEQ ID NO: 5663 - protein, 519 aa, Oryza sativa
METSAAAAPNGGAAAAEQQQRRRLPDFQQSVRLKYVKLGYHYLISHGMYLLLSPLMALVAVQLSTVSPGDIADLWEQLRFNLLSVVACSTLLVFLSTLYFLTRPRPVYLLDFACYKPDPQRKCTRETFMRCSSLTGSFTDANLDFQRKILERSGLGEDTYLPPAVLRVPPNPCMDEARKEARTVMFGAIDQLLEKTGVKPKDIGVVVVNCSLFNPTPSLSAMVVNHYKLRGNVISYNLGGMGCSAGLLSVDLAKDLLQVHPNSYALVVSMENITLNWYFGNNRSMLVSNCLFRMGGAAILLSNRRSDRRRSKYELVHTVRTHKGANDKCFGCVTQEEDEIGKIGVSLSKDLMAVAGDALKTNITTLGPLVLPLSEQLLFMATLVAKKVLKMKIKPYIPDFKLAFEHFCIHAGGRAVLDELEKNLELTDWHMEPSRMTLYRFGNTSSSSLWYELAYTEAKGRIRKRDRIWQIAFGSGFKCNSAVWKALRTVNPAKEKNPWMDEIDNFPVEVPKISKVGNA

SEQ ID NO: 5664 - protein, 522 aa, Hordeum vulgare
MDTPAPNAANTPAQAAAEPAAQPRLLPDFLQSVRLKYVKLGYHHLISHGMYLLLSPLMALVAVQLSTVSPSDLADLWEQLRFNLVSVVVCSTLLVFLSTVYFLTRPRPVYLVDFACYKPGPERRCTRQTFMRCSEATGSFTDANLDFQRKILERSGLGEDTYLPPAVLRVPPNPCMDEARKEASTVMFGAIDQLLEKTGVRPKDIGILVVNCSLFNPTPSLSAMVVNHYRLRGNVVSYNLGGMGCSAGLLSIDLAKDLLQVHPNSYALVISMENITLNWYFGNDRSMLVSNCLFRMGGAAILLSNKRSDRRRSKYELVHTVRTHKGADDKCFGCVTQQEDDAGKVGVSLSKDLMAVAGDALKTNITTLGPLVLPLSEQLLFMATLVAKKAFKVKIKPYIPDFKLAFEHFCIHAGGRAVLDELEKNLGLTEWHMEPSRMTLYRFGNTSSSSLWYELAYSEAKGRIGRRDRVWQIAFGSGFKCNSAVWRALRAVAPEAEGTNPWMDEIDRFPVEVPRVSRVGTA

SEQ ID NO: 5665 - protein, 520 aa, Brachypodium distachyon
METSPSAPPNAATPPSPAPEPRRLPDFLQSVRLKYVKLGYHHHLISHGKYLLLSPLMALAAVQLSTVSPGALWLQLRFINLLSLLACSTLLFSLSTAYFLTRPRPVYLLDFACYKPEPERRCTRRTFMRCSEATGVFNAANLDFQRKILERSGLGEHTYLPPAVLRVPPNPSMAEARKEARAVMLGAIDQLLEKTGVRPKDIGILVVNCSLFNPTPSLSAMVVNHYKLRSNVASYNLGGMGCGAGLLSVDLAKDLLQVRPDSYALVVSMENITLNWYFGNDRSMLVSNCLFRMGGAAILLSNRQADRRRLAKYELVHTVRTHKGADDRCFGCVTQEEDEAGKVGVSLSKDLMAVAGDALKTNITTLGPLVLPFSEQLLFMATLAAKKLLKVKRMKPYIPDFKLAFEHLCIHAGGRAVLDELEKNLELTEWHMEPSRMTLYRFGNTSSSSLWYELAYSEAKGRISRGDRVWQIAFGSGFKCNSAVWKALRTVNPAEEKNPWMDEIDDFPVEVPKISKVGNA

SEQ ID NO: 5666 - protein, 519 aa, Brachypodium distachyon
MDNDAAPPADAAAGERAASPSRRLPDFLQSVRLKYVKLGYHYLITHGMYLLLTPLIVLVAVHLSTLSPGEVADLWAHLRFNLVSVVACSTLLVFLSTVYFLTRPRPVYLVDFACYKPEPERRCTRDTFMRCSKLTGNFTDANLEFQRKILERSGLGEDTYLPPSLVSVPPNPSMDEARKEAQLCMFGAIDDMLAKTGVKPKDIGILVVNCSLFNPTPSLSAMVVNHYKLRGNIISYNLGGMGCSAGLLSIDLAKDLLQVHPNSYALVVSTENMTLNWYFGNNRSMLVSNCLFRMGAAAILLSNKRSDRWRSKYELVHTVRTHKGADDKCFSCVTQEEDDDGKVGVALSKDLMAVAGDALKTNITTLGPLVLPFSEQLLFMLTLVGKKLLKMKIKPYIPDFKLAFEHFCIHAGGRAVLDEIEKNMDLTDWHMEPSRMTLFRFGNTSSSSLWYELAYSEAKGRIRRRDRIWQIAFGSGFKCNSAVWKALRSVNPAKEKNPWMDEIDTFPVDVPKVSKVSSV

SEQ ID NO: 5667 - protein, 517 aa, Zea mays
MENPAPPTNPASATPSPSRQLPDFQQSVRLKYVKLGYHYLITHGMYLLLTPLMVLVAVYLSTLSPRDVADLWAHLRLNLISVLACSTLLVFLGTAYFLTRPRPVYLVDFACYKPGPERRCTRDTFMRCSRLTGCFTDASLEFQRKILERSGLGEDTYLPPAVTRVPPNPSMDEARAEAREVMFGAVDELLAKTGVKPKDIGILVVNCSLFNPTPSLSAMVVNHYKLRGNVVSYNLGGMGCSAGLLSVDLAKDLLQTHPGSYALVISTENITLNWYSGNDRSKLVSNCLFRMGGAAVLLSNRRSDRRRAKYELVHTVRTHKGADDRCFGCVTQEEDGEGVVGVSLSRDLMAVAGDALKTNITTLGPLVLPLSEQLLFMATLVAKKLLKMKKVKPYIPDFKLAFEHFCIHAGGRAVLDELESNLALTDWHMEPSRMTLHRFGNTSSSSLWYELAYSEAKGRIRRRHRVWQIAFGSGFKCNSAVWRALRSVNPAEETNPWMDEIDRFPVDVPKVSKVSSD

SEQ ID NO: 5668 - protein, 518 aa, Ananas comosus
MAEPNPPSTTAGGNGANANASSSRRLPDFQQSVRLKYVKLGYHYLISHGMYLLLSPLIGLVAVQLSTFSVEDLQELYRHLRFNLISVVLCSAALVFLSTLYFLTRPRPVYLVDFSCYKPDPARKCTRAIFMERSALTGSFTPDNLDFQRKILERSGLGESTYLPDAVLNVPPNPSMAEARKEAGAVMFGAVDELLAKTNVRPKDIGVLVVNCSLFNPTPSLSAMVINHYKLRGNVVSYNLGGMGCSAGLISVDLAKDLLRVHPNSYALVISMENITLNWYFGNSRSMLVSNCLFRMGGAAILLSNRRSDRRRSKYELVHTVRTHKGADDKCFSCVTQEEDSVGKIGVSLSKDLMVVAADALKTNITTLGPLVLPVSEQLIFLATLIAKKVFKMKIKPYIPDFKLAFEHFCIHAGGRAVLDELEKNLQLSDWHMEPSRMTLYRFGNTSSSSLWYELAYTEAKGRIRKRDRIWQIAFGSGFKCNSAVWKALRTVNPAKEKNPWMDEIENFPVPVPKFSAI

SEQ ID NO: 5669 - protein, 517 aa, Setaria italica
MDNPAPATNAATAAASPSRRLPDFQQSVRLKYVKLGYHYLISHGMYLLLMPLMSLVAVHLSTLSPRDVADLWAHLRLNLISVLACSTLLVFLATAYFLTRPRPVYLVDFACYKPGPELRCSRDTFMRCSRLTGSFTDASLEFQRKILELSGLGEDTYLPPAVTRVPPNPSMDAARAEAREVMFGAVDELLAKTGVRPKDIGVLIVNCSLFNPTPSLSAMVVNHYKLRGNVVSYNLGGMGCSAGLLSVDLAKDLLQTHPGSYALVISTENITLNWYSGNDRSKLVSNCLFRMGGAAVLLSNRRSDRRRAKYELVHTVRTHKGADDRCFGCVTQEEDGEGNLGVSLSRDLMAVAGDALKTNITTLGPLVLPVSEQLLFMATLAARKLLKMKKVKPYIPDFKLAFEHFCIHAGGRAVLDELESNLALTDWHMEPSRMTLHRFGNTSSSSLWYELAYSEAKGRIRRRDRVWQIAFGSGFKCNSAVWRALRSVNPAEETNPWMDEIDRFPVDVPKVSKVSSG

SEQ ID NO: 5670 - protein, 524 aa, Sorghum bicolor
MENPAPPTDPAAATGATPTPSSSPSRQLPDFQQSVRLKYVKLGYHYLISHGMYLLLTPLMVLVAVHLSTLSPRDVADLWAHLRLNLISVVACSTLLVFLGTVYFLTRPRPVYLVDFACYKPGPERRCTRDTFMRCSRLTGCFTDGSLEFQRKILERSGLGEETYLPPAVTRVPPNPSMDEARAEAREVMFGAVDELLAKTGVKPKDIGILVVNCSLFNPTPSLSAMVVNHYKLRGNVVSYNLGGMGCSAGLLSVDLARDLLQTHPGSYALVISTENITLNWYSGNDRSKLVSNCLFRMGGAAVLLSNRRSDRRRAKYELVHTVRTHKGADDRCFGCVTQEEDGEGVLGVSLSRDLMAVAGDALKTNITTLGPLVLPLSEQLLFMATLVAKKVLKMKKVKPYIPDFKLAFEHFCIHAGGRAVLDELESNLSLTDWHMEPSRMTLHRFGNTSSSSLWYELAYSEAKGRIRRRHRVWQIAFGSGFKCNSAVWRALRSVNPAEETNPWMDEIDRFPVDVPKVSKVTSD

SEQ ID NO: 5671 - protein, 524 aa, Saccharum officinarum
MENPTPPTNPASATGATPTPSPSLSRQLPDFQQSVRLKYVKLGYHYLITHGMYLLLTPLMVLVAVHLSTLSPRDVADLWAHLRLNLISVVACSTLLVFLGTAYFLTRPRPVYLWDFACYKPGPERRCTRETFMRCSRLTGCFTDASLEFQRKILERSGLGEDTYLPPAVTRVPPNPSMDEARAEAREVMFGAVDELLAKTGVKPKDIGILVVNCSLFNPTPSLSAMVVNHYKLRGNVVSYNLGGMGCSAGLLSVDLAKDLLQTHPGSYALVISTENITLNWYSGNDRSKLVSNCLFRMGGAAVLLSNRRSDRRRAKYELVHTVRTHKGADDRCFGCVTQEEDGEGVLGVSLSRDLMAVAGDALKTNITTLGPLVLPLSEQLLFMATLVAKKVLKMKKVKPYIPDFKLAFEHFCIHAGGRAVLDELESNLSLTDWHMEPSRMTLHRFGNTSSSSLWYELAYSEAKGRIRRRHRVWQIAFGSGFKCNSAVWRALRSVNPAEETNPWMDEIDRFPVDVPKVSKVSSE

SEQ ID NO: 5672 - protein, 520 aa, Hordeum vulgare
MEDSTPPAGANAGERASSPSPSRRLPDFLQSVRLKYVKLGYHYLITHGMYLLLTPLIVLIAVHLSTLSPGDVADLWTHLRFNLLSVIACSTLLVFLSTVYFLTRPRSVYLVDFGCYKPGPERRCSRDTFMRCSKLTGNFTEANLDFQRKILERSGLGEDTYIPPALVTVPPNPSMDLARQEAQVCMFGAIDNMLAKTGVKPKDIGILVVNCSLFNPTPSLSAMVVNHYKLRGNIISYNLGGMGCSAGLLSIDLAKDLLQVHPNSYAMVVSTENITLNWYFGNNRSMLVSNCLFRMGCAAILLSNKRSDRRRSKYELVHTVRTHKGADDKCFSCVTQEEDDSGKVGVALSKDLMAVAGDALKTNITTLGPLVLPFSEQLLFMVTLVGKKLFKMKIKPYIPDFKLAFEHFCIHAGGRAVLDEIEKNMDLTDWHMEPSRMTLFRFGNTSSSSLWYELAYSEAKGRIRRRDRIWQIAFGSGFKCNSAVWKALRSVNPAKEQNNPWMDEIDTFPVEVPKVSKVAE

SEQ ID NO: 5673 - protein, 522 aa, Triticum aestivum
MEDSTPPAGAGASAGEGASSPSPSRRLPDFLQSVRLKYVKLGYHYLITHGMYLLLTPLIVLIAVHLSTLSPGDVADLWTHLRFNLLSVIACSTLLVFLSTVYFLTRPRSVYLVDFGCYKPGPERRCSRETFMRCSKLTGNFTEANLDFQRKILERSGLGEDTYIPPALVTVPPNPSMELARQEAQVCMFGAIDNMLAKTGVKPKDIGILVVNCSLFNPTPSLSAMVVNHYKLRGNIVSYNLGGMGCSAGLLSIDLAKDLLQVHPNSYAMVVSTENITLNWYFGNNRSMLVSNCLFRMGCAAILLSNKRSDRRRSKYELVHTVRTHKGADDKCFSCVTQEEDDSGKVGVALSKDLMAVAGDALKTNITTLGPLVLPFSEQLLFMVTLVGKKLFKMKIKPYIPDFKLAFEHFCIHAGGRAVLDEIEKNMDLTDWHMEPSRMTLFRFGNTSSSSLWYELAYSEAKGRIRRRDRIWQIAFGSGFKCNSAVWKALRSVNPAKEQNNPWMDEIDTFPVDVPKVSKVAE

SEQ ID NO: 5674 - protein, 511 aa, Chelidonium majus
MADPKPDTPLIRPQTSRKLPDFKQSVKLKYVKLGYHYLITHGMYLCLSPLVVLIAAQISTFSIKDLHDLWDHLRFNLISVIVCSTLLVFLSTLYFLTRPRPVYLVDFACYKPEDARKCTRQIFMERSELTGSFTKENLEFQRKILERSGLGESTYLPPAVLRVPPNPSMAEARKEAEIVMFGALDQLFAKTSIKPKDIGILIVNCSLFNPTPSLSAMVINHYKLRGNIVSYNLGGMGCSAGLISIDLAKDLLQVHPNSYALVISMENITLNWYFGNERSMLVSNCLFRMGGAAILLSNKNSERRRSKYRLVHTVRTHKGADDKCFSCVTQEEDPNGKIGVALSKDLMAVAGDALKTNITTLGPLVLPMSEQLLFFATLVGKKLFKMKIKPYIPDFKLAFEHFCIHAGGRAVLDELEKNLQLTEWHMEPSRMTLYRFGNTSSSSLWYELAYTEAKGRIKKGDRTWQIAFGSGFKCNSAVWKALRTVNPAKEKNPWMDEIQQFPVDVPRIASI

SEQ ID NO: 5675 - protein, 524 aa, Avena sativa
MSTENVAPPPAGGNAGGRAESPSPPRRLPDFLQSVRLKYVKLGYHYLITHGMYLLLTPLIVLIAVHLSTLSPADVADLWTHLRFNLLSVVACSTLLVFLSTVYFLTRPRSVYLVDFACYKPGPERRCSRETFMRCSTLTGNFTQGNLDFQRKILERSGLGEDTYIPPALVSIPPNPSMELARQEAMVCMFGAIDNMLAKTGVKPKDIGILVVNCSLFNPTPSLSAMVVNHYKLRGNIISYNLGGMGCSAGLLSIDLAKDLLQVHPNSYAMVVSTENITLNWYFGNNKSMLVSNCLFRMGCAAILLSNKRSDRRRSKYELVHTVRTHKGADDKCFSCVTQEEDDSGKVGVALSKDLMAVAGDALKTNITTLGPLVLPVSEQLIFMATLIAKKVFKMKIKPYIPDFKLAFEHFCIHAGGRAVLDEIEKNMDLTDWHMEPSRMTLFRFGNTSSSSLWYELSYSEAKGRIRRSDRIWQIAFGSGFKCNSAVWKALRSVNPAKEMNNPWMDEIDTFPVDVPKVSTVVVD

SEQ ID NO: 5676 - protein, 522 aa, Secale cereale
MEDSTPPAGAGASAGERPSSPSPSRRLPDFLQSVRLKYVKLGYHYLITHGMYLLLTPLIVLIAVHLSTLSPGDVADLWTHLRFNLLSVIACSTLLVFLSTVYFLTRPRSVYLVDFGCYKPGPERRCSRETFMRCSKLTGNFTEANLDFQRKILERSGLGEDTYIPPALVTVPPNPSMELARQEAQVCMFGAIDNMLAKTGVKPKDIGILVVNCSLFNPTPSLSAMVVNHYKLRGNIVSYNLGGMGCSAGLLSVDLAKDLLQVHPNSYAMVVSTENITLNWYFGNNRSMLVSNCLFRMGCAAILLSNKRSDRRRSKYELVHTVRTHKGADDKCFSCVTQEEDDSGKVGVALSKDLMAVAGDALKTNITTLGPLVLPFSEQLLFMVTLVGKKLFKMKIKPYIPDFKLAFEHFCIHAGGRAVLDEIEKNMDLTDWHMEPSRMTLFRFGNTSSSSLWYELAYSEAKGRIRRHDRIWQIAFGSGFKCNSAVWKALRSVNPAKEENNPWMDEIDTFPVEVPKVSKVAE

SEQ ID NO: 5677 - protein, 519 aa, Panicum virgatum
MDNPAPPPNAAAGAPSPSRRLPDFQQSVRLKYVKLGYHYLISHGMYLLLTPLMVLVAVHLSTLSPRDVADLWAHLRLNLVSVLACSALLVFLATAYFLTRPRPVYLVDFACYKPGPERRCSRDTFMRCSRLTGSFSDASLEFQRKILERSGLGEDTYLPPAVTSVPPSPSMDAARAEAREVMFGAVDELLAKTGVRPKDIGVLVVNCSLFNPTPSLSAIVVNHYKLRGNIVSYNLGGMGCSAGLLSVDLAKDLLQTHPGSYALVISTENITLNWYSGNDRSKLVSNCLFRMGGAAVLLSNRGADRRRAKYELVHTVRTHKGADDRCFGCVTQEEDGEGRVGVSLSRDLMAVAGDALKTNITTLGPLVLPLSEQLLFMASLAARKLLGAKRVRRPYIPDFKLAFEHFCIHAGGRAVLDELESNLALTDWHMEPSRMTLHRFGNTSSSSLWYELAYSEAKGRIRRRDRVWQIAFGSGFKCNSAVWRALRSVNPAEETANPWMDEIDRFPVDVPKVSKVSSD

SEQ ID NO: 5678 - protein, 510 aa, Musa acuminata
MAEQRSDAPLLGSPSGRLPDFKQSVKLKYVKLGYHYLITHGMYLFLTPLVFLVAAQLSTFSLDDLHDLWDHLRFNLVSVILCSTLLVFLSTVYFLTRPRPVYLLDFACYKPEDARKCTRQLFMERSRTTGSFTEENLVFQRRILERSGLGEDTYLPEAVLCVPPNPCMAEARKEARDVMFGAIDELLAKTDVKPKDIGILIVNCSLFNPTPSLSAMVVNHYKLRGNVVSYNLGGMGCSAGLISMDLAKNLLQVYPSSYALVISMENITLNWYFGNNRSMLVSNCLFRMGGAAILLSNKRSDRGRSKYQLVHTFRTHKGADDKCFGCVTQEEDGNGKIGVSLSKDLMGVAGDALKTNITTLGPLVLPMSEHLIFLATLVAKKVFKMKIKPYIPDFKLAFEHFCIHAGGRAVLDELEKNLQLSEWHMEPSRMTLYRFGNTSSSSLWYELAYAEGKGRIKKRDRIWQIAFGSGFKCNSAVWRALRTVNPGKEKNPWMDEIDAFPVSVPKVASL

SEQ ID NO: 5679 - protein, 524 aa, Avena sativa
MSTENVAPPPAGGNAGGRAESPSPPRRLPDFLQSVRLKYVKLGYHYLITHGMYLLLTPLIVLIAVHLSTLSPADVADLWTHLRFNLLSVVACSTLLVFLSTVYFLTRPRSVYLVDFACYKPGPERRCSRETFMRCSTLTGNFTQGNLDFQRKILERSGLGEDTYIPPALVSIPPNPSMELARQEAMVCMFGAIDNMLAKTGVKPKDIGILVVNCSLFNPTPSLSAMVVNHYKLRRNIISYNLGGMGCSAGLLSIDLAKDLLQVHPNSYAMVVSTENITLNWYFGNNKSMLVSNCLFRMGCAAILLSNKRSDRRRSKYELVHTVRTHKGADDKCFSCVTQEEDDSGKVGVALSKDLMAVAGDALKTNITTLGPLVLPVSEQLIFMATLIAKKVFKMKIKPYIPDFKLAFEHFCIHAGGRAVLDEIEKNMDLTDWHMEPSRMTLFRFGNTSSSSLWYELSYSEAKGRIRRSDRIWQIAFGSGFKCNSAVWKALRSVNPAKEMNNPWMDEIDTFPVDVPKVSTVVVD

SEQ ID NO: 5680 - protein, 511 aa, Aquilegia formosa
MADRKLNMPLIPPLSSRKLPDFKQSVKLKYVKLGYHYLITHGMFLFLSPLIILIAAQMSTFSLKDLHDLWDHLRFNLISVIVCSTLLVFLSTLYFLTRPRPVYLVDFACYKPEEARKCTRQIFMERSALTGSFTEGNLEFQRKILERSGLGESTYLPDAVLRVPPNPSMAEARKEAEAVMYGALDQLFEKTKVKPKDIGILIVNCSLFNPTPSLSAMIINHYKLRGNIISYNLGGMGCSAGLISIDLAKDLLQVHPNSYAIVISMENITLNWYFGNERSMLVSNCLFRMGGAAILLSNRSSDRRRSKYRLVHTVRTHKGADDKCFSCVTQEEDPNGKVGVSLSKDLMAVAGDALKTNITTLGPLVLPMSEQLLFFATLVGKKLFKMKIKPYIPDFKLAFEHFCIHAGGRAVLDELEKNLHLSDWHMEPSRMTLHRFGNTSSSSLWYELAYTEAKGRMKKGDRTWQIAFGSGFKCNSAVWKALRTVNPAKEKNPWMDEIHNFPVDVPKVSAL

SEQ ID NO: 5681 - protein, 512 aa, Musa acuminata
MAESEQRANAALLQSSSSRLPDFKQSVKLKYVKLGYHYVITHGMYLFFSPLIAVLVAQLSTFSIKDLHDLWDHLRFNLISAVLCSTLLVFLSTVYFLTRRRPVYLVNFACYKPEDPRKCTRQIFMDRSTLTGSFTEENLAFQRKILERSGLGESTYLPEAVLNVPPNPCMAEARKEARTVMFGAIDELLTKTNVKPKDIGILIVNCSLFNPTPSLSAMVVNHYKLRGNIVSYNLGGMGCSAGLLSIDLAKDLLQVYPNSYALVVSMENITLNWYFGNNRSMLVSNCLFRMGGAAILLSNKRSDRRRSKYQLVHTVRTHKGADDKCFSCVTQEEDENGKIGVSLSKDLMAVAGDALKTNITTLGPLVLPMSEQLIFLATLVAKKVFKMKIRPYIPDFKLAFEHFCIHAGGRAVLDEIEKNLQLSDWHMEPSRMTLYRFGNTSSSSLWYELAYSEGKGRIKKKDRIWQIAFGSGFKCNSAVWKSLKSINPANEKNPWMDEINNFPVAVPKVSAL

SEQ ID NO: 5682 - protein, 510 aa, Musa acuminata
MAEQRSDAPLLGSPSGRLPDFKQSVKLKYVKLGYHYLITHGMYLFLTPLVFLVAAQLSTFSLDDLHDLWDHLRFNLVSVILCSTLLVFLSTVYFLTRPRPVYLLDFACYKPEDARKCTRQLFMERSRTTGSFTEENLVFQRRILERSGLGEDTYLPEAVLCDPPNPCMAEARKEARDVMFGAIDELLAKTDVKPKDIGILIVNCSLFNPTPSLSAMVVNHYKLRGNVVSYNLGGMGCSAGLISMDLAKNLLQVYPSSYALVISMENITLNWYFGNNRSMLVSNCLFRMGGAAILLSNKRSDRGRSKYQLVHTFRTHKGADDKCFGCVTQEEDGNGKIGVSLSKDLMGVAGDALKTNITTLGPLVLPMSEHLIFLATLVAKKVFKMKIKPYIPDFKLAFEHFCIHAGGRAVLDELEKNLQLSEWHMEPSRMTLYRFGNTSSSSLWYELAYAEGKGRIKKRDRIWQIAFGSGFKCNSAVWRALRTVNPGKEKNPWMDEIDAFPVSVPKVAAL

SEQ ID NO: 5683 - protein, 524 aa, Avena sativa
MSTENVATPPAGGNAGGRAESPSPPRRLPDFLQSVRLKYVKLGYHYLITHGMYLLLTPLIVLIAVHLSTLSPADVADLWTHLRFNLLSVVACSTLLVFLSTVYFLTRPRSVYLVDFACYKPGPERRCSRETFMRCSTLTGNFTQGNLDFQRKILERSGLGEDTYIPPALVSIPPNPSMELARQEAMVCMFGAIDNMLAKTGVKPKDIGILVVNCSLFNPTPSLSAMVVNHYKLRGNIISYNLGGMGCSAGLLSIDLAKDLLQVHPNSYAMVVSTENITLNWYFGNNKSMLVSNCLFRMGCAAILLSNKRSDRRRSKYELVHTVRTHKGADDKCFSCVTQEEDDSGKVGVALSKDLMAVAGDALKTNITTLGPLVLPVSEQLIFMATLIAKKVFKMKIKPYIPDFKLAFEHFCIHAGGRAVLDEIEKNMDLTDWHMEPSRMTLFRFGNTSSSSLWYELSYSEAKGRIRRSDRIWQIAFGSGFKCNSAVWKALRSVNPAKEMNNPWMDEIDTFPVDVPKVSTVVVD

SEQ ID NO: 5684 - protein, 213 aa, Elaeis guineensis
MAEPLLNKSSSSRLPSFTQSVKLKYVKLGYHYLITHGMYLFLTPLVVLVAAQLSTFSVQDLHDLWDHLRFNLISVILCSTLLVFLSTLYFLTRPRPVYLVNLACYKPEDARKCTRQIFMEHSKLTGSFTEENLEFQRKILERSGLGENTYLPEAVLNVPPNPSMAEARKEARAVMFGAIDELFAKTNVKPKDIGILIVNCSLFNPTHLFLPWL

SEQ ID NO: 5685 - protein, 524 aa, Avena sativa
MSTENVATPPAGGNAGGRAESPSPPRRLPDFLQSVRLKYVKLGYHYLITHGMYLLLTPLIVLIAVHLSTLSPADVADLWTHLRFNLLSVVACSTLLVFLSTVYFLTRPRSVYLVDFACYKPGPERRCSRETFMRCSTLTGNFTQGNLDFQRKILERSGLGEDTYIPPALVSIPPNPSMELARQEAMVCMFGAIDNMLAKTGAKPKDIGILVVNCSLFNPTPSLSAMVVNHYKLRGNIISYNLGGMGCSAGLLSIDLAKDLLQVHPNSYAMVVSTENITLNWYFGNNKSMLVSNCLFRMGCAAILLSNKRSDRRRSKYELVHTVRTHKGADDKCFSCVTQEEDDSGKVGVALSKDLMAVAGDALKTNITTLGPLVLPVSEQLIFMATLIAKKVFKMKIKPYIPDFKLAFEHFCIHAGGRAVLDEIEKNMDLTDWHMEPSRMTLFRFGNTSSSSLWYELSYSEAKGRIRRSDRIWQIAFGSGFKCNSAVWKALRSVNPAKEMNNPWMDEIDTFPVDVPKVSTVVVD

SEQ ID NO: 5686 - protein, 511 aa, Daucus carota
MSEAKVNQPLIPPSYLRKLPDFKQSIKLKYVKLGYHYLITHGMYLFLSPLVVVLAAQLSTFSLRDIYILWDHLRFNLISVVVCSTLLVFLSTLYFLTRPRPVYLVNFSCYKPEEDRKCTRQTFMEKSKLTGNFTDANLDFQRKILERSGLGEDTYLPEAVLRVPPNPCMAEARKEAELVMFGAIDELLAKTSLKPKDIGVLIVNCSLFNPTPSLASMVINHYKLRGNILSYNLGGMGCSAGLISIDLAKDLLQVHPNSYALVISMENITLNWYFGNERSMLVSNCLFRMGGAAILLSNKRSDRRRSKYQLVHTVRTHKGSDDKCFSCVTQLEDPAGKVGVALSKDLMAVAGDALKTNITTLGPLVLPMSEQLLFFATLVGKKLFRMKIKPYIPDFKLAFEHFCIHAGGRAVLDELEKNLQLSDWHMEPSRMTLNRFGNTSSSSLWYELAYSEAKGRIKKGDRAWQIAFGSGFKCNSAVWKALRTLNPAKEKSPWMDEIHKFPVDVPKVSAV

SEQ ID NO: 5687 - protein, 506 aa, Cocos nucifera
MAEPLLNKSSSSRLPSFTQSVKLKYVKLGYHYLITHGMYLFLTPLVGLVAAQLSTFSVQDLHDLWDHLRFNLISVILCSTLLVFLSTLYFLTRPRPVYLVNFACYKPEDARKCTRQIFMEQSKLTGSFTEENLEFQRKILERSGLGENTYLPEAVLNVPPNPSMAEARKEARAVMFGAIDELFAKTNVKPKDIGILIVNCSLFNPTPSLSAMVVNHYKLRGNIVSYNLGGMGCSAGLISIDLAKDLLQVHPSTYALVISMENITLNWYFGNNRSMLVSNCLFRMGGAAILLSNKSSDRRCSKYQLVHMVRTHKGADDKCFSCVTQEEDAKGKIGVSLSKDLMGVAGDALKTNITTLGPLVLPMSEQLLFFATLVGRKILKMKIRPYIPDFKLAFEHFCIHAGGRAVLDELEKNLQLSEWHMEPSRMTLYRFGNTSSSSLWYELAYTEGKERIRKRDRIWQIAFGSGFKCNSAVWKALKTISPAKEKNPWMDEIHNFPVDVPRVSAL

SEQ ID NO: 5688 - protein, 512 aa, Musa acuminata
MAEAEQRPNAPLLQSSSSRLPDFKQSVKLKYVKLGYHYLISHGMFLFFSPLIAVVVAQLSTLSVKDLHDLWDHLRFNLISVILCSALLVFLFTVYFLRRPRPVYLVNFACYKPEEARKCTRQVFMNRSTLTGSFTEENLAFQRKILERSGLGESTYLPEAVINIPPNPCMAEARKEARTVMFGAIDELLAKTNVKPKDIGILIVNCSLFNPTPSLSAMVVNHYKLRGNIVSYNLGGMGCSAGLLSINLAKDLLQVYPNSYALVISMENITLNWYFGNNRSMLVSNCLFRMGGAAILLSNKRSDRRRSKYQLVHSVRTHKGADDKCFSCVTQEEDEIGKIGVSLSKDLMAVAGDALKTNITTLGPLVLPMSEQLIFFATLVAKKLFKMKVRPYIPDFKLAFEHFCIHAGGRAVLDEIEKNLQLSEWHMEPSRMTLYRFGNTSSSSLWYELAYSEGKGRIKKKDRIWQIAFGSGFKCNSAVWKALKTINPAKEKNPWMDEINDFPVVVPKVSAL

SEQ ID NO: 5689 - protein, 513 aa, Papaver somniferum
MADNPKPETTPLIRTKSARILPDFKQSIKLKYVKLGYHYLITHGMYLCLSPLVVLIAAQISTFSLKDLHDLWDHLRFNLISVIVCSTLLVFLSTLYFLTRPRPVYLVDFSCYKPEDERKCTRQIFMERSGLTGSFTEQNLEFQRKILERSGLGESTYLPPAVLRVPPNPSMAEARKEAEIVMFGALDQLFAKTSVKPKDIGILIVNCSLFNPTPSLSAMVINHYKLRGNIVSYNLGGMGCSAGLISIDLAKDLLQVHPNSYALVISMENITLNWYFGNERSMLVSNCLFRMGGAAILLSNKNSERRRSKYQLVHTVRTHKGADDKCFSCVTQEEDPAGKVGVSLSKDLMAVAGDALKTNITTLGPLVLPMSEQLLFFATLVGKKLFKMKIKPYIPDFKLAFEHFCIHAGGRAVLDELEKNLQLSEWHMEPSRMTLYRFGNTSSSSLWYELAYTEAKGRIKKGDRTWQIAFGSGFKCNSAVWKALRTVNPAKEKNPWMDEIQQFPVDVPRVAAI

SEQ ID NO: 5690 - protein, 512 aa, Musa acuminata
MAEAEQRPNAPLLQSSSSRLPDFKQSVKLKYVKLGYHYLISHGMFLFFSPLIAVVVAQLSTLSVKDLHDLWDHLRFNLISVILCSALLVFLFTVYFLRRPRPVYLVNFACYKPEEARKCTRQVFMNRSTLTGSFTEENLAFQRKILERSGLGESTYLPEAVINIPPNPCMAEARKEAKTVMFGAIDELLAKTNVKPKDIGILIVNCSLFNPTPSLSAMVVNHYKLRGNIVSYNLGGMGCSAGLLSINLAKDLLQVYPNSYALVISMENITLNWYFGNNRSMLVSNCLFRMGGAAILLSNKRSDRRRSKYQLVHSVRTHKGADDKCFSCVTQEEDEIGKIGVSLSKDLMAVAGDALKTNITTLGPLVLPMSEQLIFFATLVAKKLFKMKVRPYIPDFKLAFEHFCIHAGGRAVLDEIEKNLQLSEWHMEPSRMTLYRFGNTSSSSLWYELAYSEGKGRIKKKDRIWQIAFGSGFKCNSAVWKALKTINPAKEKNPWMDEINDFPVVVPKVSAL

SEQ ID NO: 5691 - protein, 511 aa, Tabernaemontana elegans
MSDSKTSTPLIPPSSSRKLPDFKQSVKLKYVKLGYHYLITHGMYLFLSPLVVVIAAQLSTFSLQDLYVLWDHLRFNLISVVVCSTLLVFLSTVYFITRPRPLYLVNFSCYKPEDARKCTRQIFMERSRSTGSFTPENLQFQRKILERSGLGESTYLPEAVLRVPPNPCMAEARKEAEAVMFGAIDELLAKTSLKPKDIGILIVNCSLFNPTPSLSAMVINHYKLRGNIVSYNLGGMGCSAGLISIDLAKDLLQVHPNTYALVISMENITLNWYFGNERSMLVSNCLFRMGGAAILLSNKRSDRRRSKYQLVHTVRTHKGADDKCFSCVTQMEDSNGKIGVSLSKDLMAVAGDALKTNITTLGPLVLPMSEQLLFFATLVGRKLLKMKIKPYIPDFKLAFEHFCIHAGGRAVLDELEKNLQLSDWHMEPSRMTLYRFGNTSSSSLWYELAYSEAKGRIKRGDRTWQIAFGSGFKCNSAVWKALRTVNPAKEKNPWMDEIHQFPVEVPRVSAL

SEQ ID NO: 5692 - protein, 516 aa, Amorphophallus konjac
MAEARPEGAPLPQAPSSGLPDFKQSVKLKYVKLGYHYVITHGMYLFLTPLVAAIAAQLSTLSLRDIHDLWEHLRFNLISVILCSALLVFLSTLYFLTRPRPVYLVDFSCYKPEDARKCSRQIFMERSRLTGSFTDENLEFQRKILERSGLGESTYLPQAVLNVPPNPCMAEARKEAETVMFGALDELFAKTHMKPKDIGILIVNCSLFNPTPSLSAMIVNHYKLRGNILSYNLGGMGCSAGLISLDLAKDLLQAHPNSYALVVSMENITLNWYFGNNRSMLVSNCLFRMGGAAILLSNRRSDRRRSKYQLVHTVRTHKGADDKCFSCVTQEEDANGKIGVSLSKDLMGVAGDALKTNITTLGPLVLPMSEQLLFFATLVGKKLLKMKIKPYIPDFKLAFEHFCIHAGGRAVLDEIEKNLQLSEWHLEPSRMTLYRFGNTSSSSLWYELAYTEAKGRIRRGDRTWQIAFGSGFKCNSAVWKALRTVNPAKERNPWMDEIDQFPVQVPRFSAISSSSS

SEQ ID NO: 5693 - protein, 510 aa, Cajanus cajan
MTDAKPDAPSMASSSRKLPDFKKSVKLKYVKLGYHYLITHGMYLCLSPLVVLIAAQLSTFSPQDLYDLWEHLQYNLISVILCSTLLVFLSTLYFLTRPRPVYLVNFSCYKPEESRKCTKRIFMDHSRLTGSFTEENLEFQRKILERSGLGDSTYLPEAVLNIPPNPSMKEARKEAEAVMFGAIDELLAKTSVKPKDIGILIVNCSLFNPTPSLSAMIVNHYKLRGNIKSYNLGGMGCSAGLISIDLAKDLLQANPNSYALVISMENITLNWYFGNDRSKLVSNCLFRMGGAAVLLSNKNSDRRRSKYRLVTTVRTNKAADDKCFSCVTQEEDADGKVGVTLSKDLMAVAGDALKTNITTLGPLVLPTSEQLLFFATLVGKKILKMKIKPYIPDFKLAFEHFCIHAGGRAVLDELEKNLQLSPWHMEPSRMTLYRFGNTSSSSLWYELAYTEAKGRIRKGDRTWQIAFGSGFKCNSAVWKALRTINPAKEKSPWMDEIDQFPVDVPRVSSI

SEQ ID NO: 5694 - protein, 513 aa, Papaver somniferum
MADNPKPETTPLIRTKSARILPDFKQSIKLKYVKLGYHYLITHGMYLCLSPLVVLIAAQISTFSLKDLHDLWDHLRFNLISVIVCSTLLVFLSTLYFLTRPRPVYLVDFSCYKPEDERKCTRQIFMERSGLTGSFTEQNLEFQRKILERSGLGESTYLPPAVLRVPPNPSMAEARKEAEIVMFGALDQLFAKTSLKPKDIGILIVNCSLFNPTPSLSAMVINHYKLRGNIVSYNLGGMGCSAGLISIDLAKDLLQVHPNSYALVISMENITLNWYFGNERSMLVSNCLFRMGGAAILLSNKNSERRRSKYQLVHTVRTHKGADDKCFSCVTQEEDPAGKVGVSLSKDLMAVAGDALKTNITTLGPLVLPMSEQLLFFATLVGKKLFKMKIKPYIPDFKLAFEHFCIHAGGRAVLDELEKNLQLSEWHMEPSRMTLYRFGNTSSSSLWYELAYTEAKGRIKKGDRTWQIAFGSGFKCNSAVWKALRTINPAKEKNPWMDEIQQFPVDVPRVAAI

SEQ ID NO: 5695 - protein, 504 aa, Daucus carota
QPLIPPSYLRKLPDFKQSIKLKYVKLGYHYLITHGMYLFLSPLVVVLAAQLSTFSLRDIYILWDHLRFNLISVVVCSTLLVFLSTLYFLTRPRPVYLVNFSCYKPEEDRKCTRQTFMEKSKLTGNFTDANLDFQRKILERSGLGEDTYLPEAVLRVPPNPCMAEARKEAELVMFGAIDELLAKTSLKPKDIGVLIVNCSLFNPTPSLASMVINHYKLRGNILSYNLGGMGCSAGLISIDLAKDLLQVHPNSYALVISMENITLNWYFGNERSMLVSNCLFRMGGAAILLSNKRSDRHRSKYQLVHTVRTHKGSDDKCFSCVTQMEDPVGKVGVALSKDLMAVAGDALKTNITTLGPLVLPMSEQLLFFATLVGKKLFRMKIKPYIPDFKLAFEHFCIHAGGRAVLDELEKNLQLSDWHMEPSRMTLNRFGNTSSSSLWYELAYSEAKGRIKKGDRAWQIAFGSGFKCNSAVWKALRTLNPAKEKSPWMDEIHKFPVDVPKVSAV

SEQ ID NO: 5696 - protein, 506 aa, Cocos nucifera
MAEPLIDKSSASRLPSFTQSVKLKYVKLGYHYLITHAMYLFLTPLLLLVAAQISTFSVQDLHDLWDHLRFNLVSVILCSTLLVFLSTLYFLTRPRPVYLVDFACYKPEEARRCTRQIFMERSALTGSFTEENLQFQRKILERSGLGENTYLPEAVLNVPPNPSMAEARKEARAVMFGAIDELFAKTNVKPKDIGILVVNCSLFNPTPSLSAMVVNHYKLRGNILSYSLGGMGCSAGLLSIDLAKDLLQVHPSTYALVISMENITLNWYFGNNRSMLVSNCLFRMGGAAILLSNRTSDRRRSKYQLVHTVRTHKGADDKCFSCVTQEEDANGKIGVSLSKDLMGVAGDALKTNITTLGPLVLPMSEQLLFFATLVGRKILKMKIRPYIPDFKLAFEHFCIHAGGRAVLDELEKNLQLSEWHMEPSRMTLYRFGNTSSSSLWYELAYTEGKGRIRRRDRIWQIAFGSGFKCNSAVWKALKTIDPAKERNPWMDEIHNFPVEVPRVSAI

SEQ ID NO: 5697 - protein, 514 aa, Theobroma cacao
MAESKPEQPLIPSSSSSSSRNLPDFKKSVKLKYVKLGYHYLITHGMYLFLSPLVVVIAAQLSTFSIQDLYDLWEHLQYNLISVIICSTLLVFLSTLYFLTRPRPVYLVNFACYKPEESRKCTKRIFMDQSRMTGTFTEENLEFQRKILERSGLGDSTYLPEAVLNIPPNPSMQEARKEAEAVMFGAIDELLAKTAVKPKDIGILVVNCSLFNPTPSLSAMVINHYKLRGNIQSYNLGGMGCSAGLISIDLAKNLLQVHPNSYALVISMENITLNWYFGNDRSKLVSNCLFRMGGAAILLSNKRSDRRRSKYELVHTVRTHKGADDKCFSCVTQEEDSAGKVGVTLSKDLMAVAGDALKTNITTLGPLVLPMSEQLLFFGTLVGKKLFKMKVKPYIPDFKLAFEHFCIHAGGRAVLDELEKNLQLSEWHMEPSRMTLYRFGNTSSSSLWYELAYSEAKGRIRKGDRTWQIAFGSGFKCNSAVWKALRAVNPAKEKNPWMDEIDRFPVDVPRVSSI

SEQ ID NO: 5698 - protein, 510 aa, Gossypium raimondii
MTDSKPEQPLIPSSSRKLPDFKKSVKLKYVKLGYHYLITHGMYLFLSPLVVVITAQLSTFSILDLYDLWEHLQYNLISVIICSTLLVFLSTLYFLTRPRPVYLVNFACYKPDESRKCPKRIFMDRSQLAGTFTEENLQFQRKILERSGLGEETYLPEAVLNVPPNPSMKEARKEAEIVMFGAIDELLAKTSVKPKDIGILVVNCSLFNPTPSLSAMVINHYKLRGNIQSYNLGGMGCSAGLLSIDLAKNLLQVHPNSYALVISMENITLNWYFGNDRSKLVSNCLFRMGGAAILLSNKRSDRRRSKYQLVHTVRTHKGADDKCFACVTQEEDSAGKIGVTLSKDLMAVAGDALKTNITTLGPLVLPMSEQLLFFATLVGKKLFKMKIKPYIPDFKLAFEHFCIHAGGRAVLDELEKNLQLSEWHMEPSRMTLFRFGNTSSSSLWYELAYSEAKGRIRKGDRTWQIAFGSGFKCNSAVWKALRTVNPAKEKNPWMDEIQNFPVDVPKVSSI

SEQ ID NO: 5699 - protein, 511 aa, Citrus clementina
MPDSVHYKSLIQPSCSRKLPDFKQSVKLKYVKLGYHYVITHGMYLFLSPLVALIAAQLSTFSIQDIYDLWEHLRFNFISVILCSTLLVFLSTLYFLTRPQPVYLVNFACYKPEDARKCTRQIFMERSGLTGTFSQENLDFQRKILERSGLGESTYLPEAVLRVPPNPCMAEARKEAEYVMFGALDELFAKTSLKPKDIGILIVNCSLFNPTPSLSAMVINHYKLRGNIVSYNLGGMGCSAGLISIDLAKDLLQVHPNSYALVISMENITLNWYFGNERSMLVSNCLFRMGGAAILLSNKRSDRWRSKYRLVHTVRTHKGADDKCFSCVTQQEDPTGRIGVSLSKDLMAVAGDALKTNITTLGPLVLPMSEQLLFFATLVARKVFKLKIKPYIPDFKLAFEHFCIHAGGRAVLDELEKNLQLSDRHMEPSRMTLYRFGNTSSSSLWYELAYSEAKGRIKRGDRTWQIAFGSGFKCNSAVWKALRTINPAKEKNPWMDEIHQFPVDVPKVSTI

SEQ ID NO: 5700 - protein, 510 aa, Gossypium hirsutum
MTDSKPLQPLIPSSSRKLPDFKKSVKLKYVKLGYHYLITHGMYLFLSPLVVVITAQLSTFSILDLYDLWEHLQYNLISVIICSTLLVFLSTLYFLTRPRPVYLVNFACYKPDESRKCPKRIFMDRSQLAGTFTEENLQFQRKILERSGLGEETYLPEAVLNVPPNPSMTEARKEAEIVMFGAIDELLAKTSVKPKDIGILVVNCSLFNPTPSLSAMVINHYKLRGNIQSYNLGGMGCSAGLLSIDLAKNLLQAHPNSYALVISMENITLNWYFGNDRSKLVSNCLFRMGGAAILLSNKRSDRRRSKYQLVHTVRTHKGADDKCFACVTQEEDSAGKIGVTLSKDLMAVAGDALKTNITTLGPLVLPMSEQLLFFATLVGKKLFKMKIKPYIPDFKLAFEHFCIHAGGRAVLDELEKNLQLSEWHMEPSRMTLFRFGNTSSSSLWYELAYSEAKGRIRKGDRTWQIAFGSGFKCNSAVWKALRTVNPAKEKNPWMDEIQNFPVDVPKVSSI

SEQ ID NO: 5701 - protein, 511 aa, Citrus sinensis
MPDSVHYKSLIQPSCSRKLPDFKQSVKLKYVKLGYHYVITHGMYLFLSPLVALIAAQLSTFSIQDIYDLWEHLRFNFISVILCSTLLVFLSTLYFLTRPQPVYLVNFACYKPEDARKCTRQIFMERSGLTGTFSQENLDFQRKILERSGLGESTYLPEAVLRVPPNPCMAEARKEAECVMFGALDELFAKTSLKPKDIGILIVNCSLFNPTPSLSAMVINHYKLRGNIVSYNLGGMGCSAGLISIDLAKDLLQVHPNSYALVISMENITLNWYFGNERSMLVSNCLFRMGGAAILLSNKRSDRWRSKYRLVHTVRTHKGADDKCFSCVTQQEDPTGRIGVSLSKDLMAVAGDALKTNITTLGPLVLPMSEQLLFFATLVARKVFKLKIKPYIPDFKLAFEHFCIHAGGRAVLDELEKNLQLSDRHMEPSRMTLYRFGNTSSSSLWYELAYSEAKGRIKRGDRTWQIAFGSGFKCNSAVWKALRTINPAKEKNPWMDEIHQFPVDVPKVSTI

SEQ ID NO: 5702 - protein, 511 aa, Petroselinum crispum
MSEAQVSHPLIPPSYLRKLPDFKQSIKLKYVKLGYHYLITHGMYLFLSPLVVVLAAQLSTFSLQDIYILWDHLRFNLISVVVCSTLLVFLSTLYFLTRPRPVYLVNFSCYKPEEDRKCTRQTFMEKSTLTGNFTDANLDFQRKILERSGLGEDTYLPEAVLRVPPNPCMAEARKEAELVMFGAIDELLAKTSLKPKEIGILIVNCSLFNPTPSLASMVINHYKLRGNILSYNLGGMGCSAGLISIDLAKDLLQVHPNSYALVISMENITLNWYFGNERSMLVSNCLFRMGGAAILLSNKRSDRRRSKYQLVHTVRTHKGSDDKCFSCVTQMEDPVGKVGVALSKDLMAVAGDALKTNITTLGPLVLPMSEQLLFFATLVGKKLFRMKIKPYIPDFKLAFEHFCIHAGGRAVLDELEKNLQLSDWHMEPSRMTLNRFGNTSSSSLWYELAYSEAKGRIKRGDRAWQIAFGSGFKCNSAVWKALRTLNPAKEKSPWMDEIHKFPVDVPKVSAV

SEQ ID NO: 5703 - protein, 510 aa, Gossypium hirsutum
MTDSKPEQPLIPSSSRKLPDFKKSVKLKYVKLGYHYLITHGMYLFLSPLVVVITAQLSTFSIQDLYDLWEHLQYNLISVIICSTLLVFLSTLYFLTRPRPVYLVNFACYKPDEFRKCPKRIFMDRSQLAGTFTEENLQFQRKILERSGLGEETYLPEAVLNVPPNPSMKEARKEAEIVMFGAIDELLAKTSIKPKDIGILVVNCSLFNPTPSLSAMVINHYKLRGNIQSYNLGGMGCSAGLLSIDLAKNLLQVHPNSYALVISMENITLNWYFGNDRSKLVSNCLFRMGGAAILLSNKRSDRRRSKYQLVHTVRTHKGADDKCFACVTQEEDSAGKIGVTLSKDLMAVAGDALKTNITTLGPLVLPMSEQLLFFATLVGRKLIKMKIKPYIPDFKLAFEHFCIHAGGRAVLDELEKNLQLSEWHMEPSRMTLFRFGNTSSSSLWYELAYSEAKGRIRKGDRTWQIAFGSGFKCNSAVWKALRTVNPAKEKNPWMDEIQNFPVDVPKVSSI

SEQ ID NO: 5704 - protein, 512 aa, Capsicum annuum
MSESKPEVPVNNPPSYARNFPDFKQSVKLKYVKLGYHYLITHGMYLFLSPLVIVLAAQLSTFSPSDLYVLWEQLRFNLISVVICSTLLVFLSTLYFLTRPRPVYLVNFSCYKPEDARICTRKIFMERSKLTGSFPDETLEFQRKILERSGLGESTYLPEAVLRVPPNPCMAEARKEAETVMFGAIDELLAKTGVKPKDIGILVVNCSLFNPTPSLSAMIVNHYKLRGNIVSYNLGGMGCSAGLISIDLAKDLLQVHPNTYALVLSMENITLNWYFGTEKSMLLPNCLFRMGGAAVLLSNKGSERRRSKYQLVHTVRTHKGSDDKCFSCVYQMEDPNGKVGVSLSKDLMAVAGDALKTNITTLGPLVLPMSEQLLFFATLVGRKLLKMKIKPYIPDFRLAFEHFCIHAGGRAVLDEIEKNLHLTDWHMEPSRMTLYRFGNTSSSSLWYELAYSEAKGRIKRGDRTWQIAFGSGFKCNSAVWKALRSINPAKEKNPWMDEIDQFPVDVPRIAKI

SEQ ID NO: 5705 - protein, 498 aa, Petroselinum crispum
MSEAQVSHPLIPPSYLRKLPDFKQSIKLKYVKLGYHYLITHGMYLFLSPLVVVLAAQLSTFSLQDIYILWDHLRFNLISVVVCSTLLVFLSTLYFLTRPRPVYLVNFSCYKPEEDRKCTRQTFMEKSTLTGNFTDANLDFQRKILERSGLGEDTYLPEAVLRVPPNPCMAEARKEAELVMFGAIDELLAKTSLKPKEIGILIVNCSLFNPTPSLASMVINHYKLRGNILSYNLGGMGCSAGLISIDLAKDLLQVHPNSYALVISMENITLNWYFGNERSMLVSNCLFRMGGAAILLSNKRSDRRRSKYQLVHTVRTHKGSDDKCFSCVTQMEDPVGKVGVALSKDLMAVAGDALKTNITTLGPLVLPMSEQLLFFATLVGKKLFRMKIKPYIPDFKLAFEHFCIHAGGRAVLDELEKNLQLSDWHMEPSRMTLNRFGNTSSSSLWYELAYSEAKGRIKKGDRAWQIAFGSGFKCNSAVWKALRTLNPAKEKSPWMDEN

SEQ ID NO: 5706 - protein, 513 aa, Petroselinum crispum
MSEAKVEQQQPLIPPSYLRKLPDFKQSIKLKYVKLGYHCLITHGMYLFLSPLVVVLAAQLSTFSLQDIYILWDHLRFNLISVIVCSTLLVFLSTLYFLTRPRPVYLVNFSCYKPEVERKCTRQTFMEKSTLTGNFTDANLDFQRKILERSGLGEDTYLPEAVLRVPPNPCMAEARKEAELVMFGAIDELLAKTSMKPKDIGILIVNCSLFNPTPSLASMVINHYKLRGNILSYNLGGMGCSAGLISIDLAKDLLQVHPNSYALVISMENITLNWYFGNERSMLVSNCLFRMGGAAILLSNKRSDRRRSKYQLVHTVRTHKGSDDRCFSCVTQMEDPAGKVGVALSKDLMAVAGDALKTNITTLGPLVLPMSEQLLFFATLVGKKLFRMKIKPYIPDFKLAFEHFCIHAGGRAVLDELEKNLQLSDWHMEPSRMTLNRFGNTSSSSLWYELAYSEAKGRIKKGDRAWQIAFGSGFKCNSAVWKALRTLNPAKEKSPWMDEIHKFPVDVPKVSAV

SEQ ID NO: 5707 - protein, 511 aa, Quercus alba
MTETKSNVSLKPSSSSRNLPDFKKSIKLKYVKLGYHYLITHGMYLFITPLVVLIAVQLSTFSFQDLYDLWEHLQYNLISVIICSTLLVFLSTVYFVTRPRPVYLVNFSCYKPEESRKCTKRIFMDQSRLTGTFSDENLEFQKKILERSGLGDSTYLPEAVLNIPPNPSMKEARKEAEAVMYGAIDELFAKTSVKPKDIGILVVNCSLFNPTPSLSAMVINHYKLRGNIVSYNLGGMGCSAGLISIALAKDLLQVHPNSYALVISMENITLNWYFGNDRSKLVSNCLFRMGGAAILLSNKSSDRRRSKYQLVHAVRTHKGADDKCFGCVTQEEDSNGKVGVTLSKDLMAVAGDALKTNITTLGPLVLPMSEQLLFFATLIGKKLFKMKIKPYIPDFKLAFEHFCIHAGGRAVLDELEKNLQLSDWHMEPSRMTLHRFGNTSSSSLWYELAYTEAKGRMKKGDRTWQIAFGSGFKCNSAVWKALRTINPAKEKSPWMDEIHSFPVDVPKISAI

SEQ ID NO: 5708 - protein, 495 aa, Vinca minor
RRLPDFQQSVKLKYVKLGYHYLITHGMYLCLSPLVVVIAAQLSTFSLQDLYVLWDHLRFNLISVVVCSTLLVFLSTVYFITRPRPVYLVNFSCYKPEDARKCTRQIFMERSKLTGSFTSENLEFQKKILERSGLGESTYLPEAVLRVPPNPCMAEARKEAETVMFGAIDELLAKTSLKPKDIGILIVNCSLFNPTPSLSAMVINHYKLRGNIVSYNLGGMGCSAGLISIDLAKDLLRVHPNTYALVISMENITLNWYFGNERSMLVSNCLFRMGGAAILLSNKSSDRRRSKYQLVHTVRTHKGSDDKCFSCVTQMEDPDGKIGVALSKDLMAVAGDALKTNITTLGPLVLPMSEQLLFFATLVGRKLLKMKIRPYIPDFKLAFEHFCIHAGGRAVLDELEKNLQLSDWHMEPSRMTLYRFGNTSSSSLWYELAYSEAKGRIKRGDRTWQIAFGSGFKCNSAVWKALKTVNPAKEKNPWMDEIHQFPVEVPRVAAL

SEQ ID NO: 5709 - protein, 515 aa, Prunus persica
MSASNLRTPLNPPSSVSPSSLKLPDFKQSVKLKYVKLGYHYLITHGMYLFLSPLFVLTVAQLSTFSLQDLHDLWDHLRFNLISVVLCSTLLVFLLTLYFLTRPRPVYLVDFSCYKPEDARKCPRQIFMDRSHFIGTFTGENLEFQRKILERSGLGESTYLPEAVIQVPPNPCMAEARKEAEMVMFGALDQLFEKTSIKPKDIGILIVNCSLFNPTPSLSAMVINHYKLRGNIISYNLGGMGCSAGLISIDLAKDLLRVHPNTYALVISMENITLNWYFGNDRSMLVSNCLFRMGGAAILLSNNGSDRRRSKYQLVHTVRTHKGADDKCFSCVTQKEDFAGKIGVSLSKDLMAVAGDALKTNITTLGPLVLPMSEQLLFFATLVGRKLFKMKVKPYIPDFKLAFEHFCIHAGGRAVLDELEKNLQLSDRHMEPSRMTLYRFGNTSSSSLWYELAYTEAKGRMKKGDRTWQIAFGSGFKCNSAVWKALRTVNPAKEKNPWMDEIHQFPVDVPKVSAL

SEQ ID NO: 5710 - protein, 511 aa, Vitis vinifera
MSEAKVDTPLISPSSSRNLPDFKKSVKLKYVKLGYHYLITHGMYLFLSPLVVVIAAQLSTFSLQDLHDLWDHLRFNLISVILCSTLLVFLSTLYFLTRPRPVYLVDFACYKPEESRKCTRKIFMDQSQMTGSFTESSLEFQRKILEKSGLGESTYLPEAVLNIPPNPSMQEARKEAATVMFGALDQLFAKTSLKPKDIGILVVNCSLFNPTPSLSAMVINHYKLRGNIISYNLGGMGCSAGLISIDLAKDLLQVHPNSYALVISMENITLNWYFGNQRSMLVSNCLFRMGGAAVLLSNKSSDRRRSKYRLVHTVRTHKGADDKCFACVTQEEDAEGKVGVSLSKDLMGVAGDALKTNITTLGPLVLPMSEQLLFFATLIGRKLFKMKLKPYIPDFKLAFEHFCIHAGGRAVLDELEKNLHLSDWHMEPSRMTLYRFGNTSSSSLWYELAYTEAKGRIKKGDRTWQIAFGSGFKCNSAVWKALRTINPAQEKNPWMDEIDMFPVNVPKVSAL

SEQ ID NO: 5711 - protein, 511 aa, Vitis vinifera
MSETNPNTPLIPPSPSRKLPDFKKSVKLKYVKLGYHYLITHGMYLFLSPLIVLIAAQLSTFSLQDLHDLWENLKFNLISVILCSALLVFLSTLFVLTRPRPVYLVDFSCYKPDDARKCSRQIFMDRSKQIGSFTEENIEFQKKIIERSGLGESTYLPEAVINVPPNPSMAEARKEAEMVMFGALDQLFEKTMVKPKDIGILIVNCSLFNPTPSLSAMVINHYKLRGNIISYNLGGMGCSAGLISIDLAKNLLQVHPNSYALVISMENITLNWYFGNERSMLVSNCLFRMGGAAILLSNKWSDRRRSKYQLVHTVRTHKGSDDKCFACVTQKEDSNGKIGVSLSKDLMAVAGDALKTNITTLGPLVLPMSEQLLFFATLVGKKVFKMKVKPYIPDFKLAFEHFCIHAGGRAVLDELEKNLQLSDWHMEPSRMTLYRFGNTSSSSLWYELAYTEAKGRVKKGDRTWQIAFGSGFKCNSAIWKALRTVNPAKEKNPWMDEIHWFPVDVPMVSTL

SEQ ID NO: 5712 - protein, 511 aa, Sesamum indicum
MSETTASTPLIPPSSSRKLPDFKQSVKLKYVKLGYHYLITHGMYLFLSPLVVVIAAQVSTFSLQDLYVLWDHLRFNLISVIVCSALLVFLSTVYFLTRPRPVYLVNFSCYKPNDDRKCTRQIFMERSRLTGTFTEENLEFQRKILERSGLGESTYLPEAVLRVPPNPCMAEARKEAETVMFGAIDELLAKTSLKPKDIGILIVNCSLFNPTPSLSAMVINHYKLRGNIISYNLGGMGCSAGLISIDLAKDLLQVHPNTYALVISMENITLNWYFGNERSMLVSNCLFRMGGAAILLSNKRSDYWRSKYRLVHTVRTHKGSDDKCFSCVTQMEDSKGKIGVALSKDLMAVAGDALKTNITTLGPLVLPMSEQLLFFATLVGKKLFKMKLKPYIPDFKLAFEHFCIHAGGRAVLDELEKNLQLSDWHMEPSRMTLYRFGNTSSSSLWYELAYSEAKGRIKRGDRTWQIAFGSGFKCNSAVWKALRTINPAKEKNPWMDEIHQFPVEVPKVSAI

SEQ ID NO: 5713 - protein, 515 aa, Prunus mume
MSASNLRTPLNPPSSVSSSSLKLPDFKQSVKLKYVKLGYHYLITHGMYLFLSPLFVLTVAQLSTFSLQDLHDLWDHLRFNLISVVLCSTLLVFLLTLYFLTRPRPVYLVDFSCYKPEDTRKCSRQIFMDRSHFIGTFTGENLEFQRKILERSGLGESTYLPEAVIQVPPNPCMAEARKEAEMVMFGALDQLFEKTSIKPKDIGILIVNCSLFNPTPSLSAMVINHYKLRGNIISYNLGGMGCSAGLISIDLAKDLLRVHPNTYALVISMENITLNWYFGNDRSMLVSNCLFRMGGAAILLSNNGSDRRRSKYQLVHTVRTHKGADDKCFSCVTQKEDFAGKIGVSLSKDLMAVAGDALKTNITTLGPLVLPMSEQLLFFATLVGRKLFKMKVKPYIPDFKLAFEHFCIHAGGRAVLDELEKNLQLSDRHMEPSRMTLYRFGNTSSSSLWYELAYTEATGRMKKGDRTWQIAFGSGFKCNSAVWKALRTVNPAKEKNPWMDEIHQFPVDVPKVSAL

SEQ ID NO: 5714 - protein, 510 aa, Castanea mollissima
MTEPKSNVSLNPSSSSRNLPDFKKSVKLKYVKLGYHYLITHGMYLFITPLVVLIAVQLSTFSFQDLYDLWEHLQYNLISVIICSTLLVFLSTVYFVTRPRPVYLVNFSCYKPEESRKCTKRIFMDQSRLTGTFSAENLEFQKKILERSGLGDSTYLPEAVLNIPPNPSMKEARKEAEAVMYGAIDELFAKTSVKPKDIGILVVNCSLFNPTPSLSAMVINHYKLRGNIVSYNLGGMGCSAGLISIALAKDLLQVHPNSYALVISMENITLNWYFGNDRSKLVSNCLFRMGGAAILLSNKSSDRRRSKYQLVHAVRTHKGADDKCFACVTQEEDSNGKVGVTLSKDLMAVAGDALKTNITTLGPLVLPMSEQLLFFATLIGKKLFKMKIKPYIPDFKLAFEHFCIHAGGRAVLDELEKNLQLSDWHMEPSRMTLHRFGNTSSSSLWYELAYTEAKGRMKKGDRTWQIAFGSGFKCNSAVWKALRTIDPAKEKNPWMDEIHRFPVDVPKISA

SEQ ID NO: 5715 - protein, 510 aa, Phaseolus vulgaris
MTDAREGAPSMASSSRSLPDFKKSIKLKYVKLGYHYLITHGMYLCLTPLVVLIAAQLSTFSFQDFYDIWEHLQYNLISVILCSTLLVFLSTLYFLTRPRPVYLVDFSCYKPEESRQCTKRTFIDHSRLTGSFTEENLEFQRKILERSGLGETTYLPEAVLNIPPNPSMKEARKEAEAVMFGAIDELLAKTSVKPKDIGILIVNCSLFNPTPSLSAMIVNHYKLRGNIRSYNLGGMGCSAGLISIDLAKDLLQANPNSYALVISMENITLNWYFGNDRSKLVSNCLFRMGGAAVLLSNKSSDRRRSKYRLVTTVRTHKGADDKCFSCVTQEEDANGKIGVTLSKDLMAVAGDALKTNITTLGPLVLPTSEQLLFFATLVGKKIFKMKIKPYIPDFKLAFEHFCIHAGGRAVLDELEKNLQLSTWHMEPSRMTLYRFGNTSSSSLWYELAYTEAKGRIRKGDRTWQIAFGSGFKCNSAVWKALRTIDSAKEKSPWIDEIDQFPVDVPRVSSF

SEQ ID NO: 5716 - protein, 469 aa, Olea europaea
MYLFLSPVVVLIAAQLSTFSLQDLNDLWDHLRFNLISVIVCSTLLVFLSTVYFLTSPRPVYLVNFSCYKPDDDRKCTRQIFMERSRLTGSFTEENLEFQRKILERSGLGESTYLPEAVLKIPPNPCMAEARKEAEAVMFGAIDELLAKTSLKPKDIGILIVNCSLFNPTPSLSAMVINHYKLRGNIISYNLGGMGCSAGLISIDLAKDLLQVHPNTYALAISMENITLNWYFGNERSMLVSNCLFRMGGAAILLSNKRSDRWRSKYRLVHTVRTHKGSDDKCFSCVTQLEDSQGKVGVSLSKELMAVAGDALKTNITTLGPLVLPMSEQLIFLATLVGKKLFKMKLKPYIPDFKLAFEHFCIHAGGRAVLDELEKNLQLSDWQMEPSRMTLYRFGNTSSSSLWYELAYSEAKGRIRRGDRMWQIAFGSGFKCNSAVWKALRTINPAKEKSPWIDEIHQFPVEVPKVSTI

SEQ ID NO: 5717 - protein, 512 aa, Fragaria vesca
MSGSNLNKSLISPSLSSPKLPDFKQSVKLKYVKLGYHYLITHGMYLFLTPLFVLTAAQVSTFSLQDLHDLWDHLRFNLISVVLCSTLLVFLSTLYFLTRPRPVYLVDFSCYKPEDAQKTTRQVFMKCSHSIGTFTGENLEFQRKILERSGLGESTYLPEAVIRVPPNPCMAEARKEAEMVMYGALDQLFEKTSIKPKDIGILVVNCSLFNPTPSLSAMLINHYKLRGNIISYNLGGMGCSAGLISIDLAKDLLQVHPNTYALVISMENITLNWYFGNDRSMLVSNCLFRMGGAAMLLSNNRHDRCRSKYQLVHTVRTHKGADDKCFSCVTQKEDPAGKIGVSLSKDLMAVAGDALKTNITTLGPLVLPMSEQLLFFATLVGRKLFKMKVKPYIPDFKLAFEHFCIHAGGRAVLDELEKNLQLLDRHMEPSRMTLYRFGNTSSSSLWYELAYTEAKGRMKKGDRTWQIAFGSGFKCNSAVWKALRTVNPVKEKNPWMDEIDMFPVDVPKVSSI

SEQ ID NO: 5718 - protein, 870 aa, Sorghum bicolor
MDITQVLLAAQSPDANLRTVAESNLTQFQEQNLPNFLLSLSIELSNDEKPPESRRLAGIILKNSLDAKDSAKKELLTQQWVSVDPSVKLKIKELLLVTLGSSVHDARHTSSQVIAKVASIEIPRREWQDLVANLLGNMTSPGASAPLKQATLEALGYVCEEISPQDLEQDQVNAVLTAVVQGMNQTELSPEVRLAAVKALYNALDFAESNFANEMERNYIMKVVCETAVSKEVEIRQAAFECLVAIASTYYSHLDPYMQTIFNLTANAVKGDEEPVALQAVEFWSAICDEEIALQDEYEGSEDGNSTVHFRFIEKALPSLVPMLLETLLKQEEDQDQDDNVWNISMSGGTCLGLISRTVGDAVVPLVMPFVEANITKPDWHCREAATFAFGSILEGPSVEKLAPLVQGGLDFLLNTMNDANSQVKDTTAWTLGRVFELLHSPAGANPIINNSNLPRIMSVLLESSKDSPNVAEKVCGAIYFLAQGYEDAESMSSVLTPYLPNIIAALLSAADRADTTHFRLRASAYEALNEIVRVSNIPETSGIIGQLLQEIMRRLNLTFDLHILSSGDKEKQSDLQALLCGVLQVIIQKLNSTDAKSIISQTADQLMMLFLRVFACHNSTVHEEAMLAIGALAYATGPDFVKYMPNFFTYLEAGLQNYEEYQVCSISVGVVGDICRALEDKILPFCDRIMTVLLKDLSSSMLNRSVKPPIFSCFGDIALAIGENFEKYLPYAMPMLQGAAGLLGTLDRSDDDMVDYGNQLRRGIFEAYSGILQGIKGPKAQLMIPYATHLLQFTEAVFKDRSRDDSVTKAAVAVIGDLADTLGQSSKDLFKTHLFHVEFLRECQAQEFDDEVRETAQWAQGMINQAVVS

SEQ ID NO: 5719 - protein, 870 aa, Zea mays
MDITQVLLAAQSPDANLRTVAEGNLTQFQEQNLPNFLLSLSIELSNDEKPPESRRLAGIILKNSLDAKDSAKKELLTQQWVSVDPSIKLKIKESLLVTLGSSVHDARHTSSQVIAKVASIEIPRREWQDLIAKLLENMTSPGASAPLKQATLEALGYVCEEISPQDLEQDQVNAVLTAVVQGMNQAELSPEVRLAAVKALYNALDFAESNFANEMERNYIMKVVCETAMSKEVEIRQAAFECLVAIASTYYSHLDPYMQTIFDLTANAVKGDEEPVALQAVEFWSAICDEEIALQDEYEGSEDGNSTVHFRFIEKALPLLVPMLLETLLKQEEDQDQDDNVWNISMSGGTCLGLISRTVGDAVVPLVMPFVEANITKPDWHCREAATFAFGSILEGPSVEKLAPLVQAGLDFLLNTMNDANSQVKDTTAWTLGRVFELLHSPAGANPIINNSNLPRIMSVLLESSKDAPNVAEKVCGAIYFLAQGYEDAESMSSVLTPYLPNIIAALLSAADRADSTHSRLRASAYEALNEIVRVSNIPETSGIIGQLLQEIMRRLNLTFDLHILSSGDKEKQSDLQALLCGVLQVIIQKLSSTDAKSIVSQTADQLMMLFLRVFACHNSTVHEEAMLAIGALAYATGPDFVKYMPNFFTYLEAGLQNYEEYQVCSISVGVVGDICRALEDKILPFCDRIMTVLLKDLSSSMLNRSVKPPIFSCFGDIALAIGENFEKYLPYAMPMLQGAAELLGTLDQSDDDMVDYGNQLRRGIFEAYSGILQGIKGPKAQLMIPYATHLLQFTEAVFKDRSRDDSVTKAAVAVLGDLADTLGQSSKDLFKTHLFHVEFLRECQAQQLDDEVRETAQWAQGMINQAVVS

SEQ ID NO: 5720 - protein, 868 aa, Setaria italica
MDITQVLLAAQSPDANLRTVAESNLTQFQEQNLPNFLLSLSIELSNDEKPPESRRLAGIILKNSLDAKDSAKKELLTQQWVSVDPSIKSKIKESLLVTLGSSVHDARHTSSQVIAKVASIEIPRREWQDLIAQLLGNMTSPGASAPLKQATLEALGYVCEEISPQHLEQDQVNAVLTAVVQGMNQTELSPEVRLAAVKALYNALDFAESNFANEMERNYIMKVICDTAVSKEVEIRQAAFECLVAIASTYYSHLDPYMQTIFNLTANAVKGDEEQVALQAVEFWSAICDEEIALQDEYEGSDDGNSTIHFRFIEKALPSLVPMLLETLLKQEEDQDQDDNVWNISMSGGTCLGLIARTVGDAIVPLVMPFVEANITKPDWHCREAATFAFGSILEGPSVEKLAPLVQAGLDFLLNTMNDSNSQVKDTTAWTLGRVFEILHSPAGANPIINNSNLPRIMAVLLESSKDVPNVAEKVCGAIYFLAQGYEDAESMSSVLTPYLPNVIAALLNAADRADTTHFRLRASAYEALNEIVRVSNIPETSGIIGQLLQEIMRRLNLTFDLHIISSGDKEKQSDLQALLCGVLQVIIQKLSSTDAKSIIVQTADQLMVLFLRVFACHSSTVHEEAMLAIGALAYATGSGFEKYMPNFFTYLEAGLQNYEEYQVCSISVGVVGDICRALEDKILPFCDRIMAVLLKDLSNSMLNRSVKPPIFSCFGDIALAIGENFEKYLPYAMPMLQGAAELLGTLDQSDDDMVDYGNQLRRGIFEAYSGILQGIKGPKAQLMIRYATHLLQFTEAVSKDRSRDDSVTKAAVAVLGDLADTLGASSKDLFQTHLFHVEFLRECLDLDDEVQETASWAQGMINQAVVS

SEQ ID NO: 5721 - protein, 868 aa, Panicum virgatum
MDITQILLAAQSPDANLRTVAESNLTQFQEQNLPNFLLSLSVELSNDEKPPESRRLAGIILKNSLDAKDSAKKELLTQHWVSVDPSIKSKIKDSLLVTLGSSVHDARHTSSQVIAKVASIEIPRREWLDLIAKLLGNMTLPGASAPLKQATLEALGYVCEEISPQHLEQDQVNAVLTAVVQGMNQTELSPEVRLAAVKALYNALDFAESNFANEMERNYIMKVVCDTAVSKEVEIRQAAFECLVAIASTYYSHLDYYMQTIFNLTANAVKGDEEPVALQAVEFWSAICDEEIALQDEYEGSDDGNSTIHFRFIEKALPSLVPMLLETLLKQEEDQDQDDNVWNISMSGGTCLGLIARTVGDAIVPLVMPFVQANITKPDWHCREAATFAFGSILEGPSVEKLAPLVQGGLDFLLNTMNDSNSQVKDTTAWTLGRVFELLHSPAGANPIINNSNLPRIMAVLLESSKDVPNVAEKVCGAIYFLAQGYEDAESMSSVLTPYLPNVIAALLSAADRADTTHFRLRASAYEALNEIVRVSNVPETSGIIGQLLQEIMRRLNLTFDLHILSSGDKEKQSDLQALLCGVLQVIIQKLSSTDAKSIIAQTADQLMTLFLRVFACHSSTVHEEAMLAIGALAYATGPDFVKYMPNFFTYLEAGLQNYEEYQVCSISVGVVGDICRALEDKILPFCDRIMTVLLKDLSNSMLNRSVKPPIFSCFGDIALAIGENFEKYLPYAMPMLQGAAELLGTLDQSDDDMVDYGNQLRRGIFEAYSGILQGIKGPKAQLMIPYATHLLQFTEAIFRDRSRDDSVTKAAVAVLGDLADTLGASSKDLFQTHLFHAEFLRECLDLDDEVRETASWAQGMINQAVVS

SEQ ID NO: 5722 - protein, 868 aa, Panicum virgatum
MDITQILLAAQSPDANLRTVAETNLTQFQEQNLPNFLLSLSVELSNDEKPPESRRLAGIILKNSLDAKDSSKKELLTQQWVSVDPSIKSKIKESLLGTLGSSVHDARRTSSQVIAKVASIEIPRREWQDLIAKLLGNMTLPGASAPLKQATLEALGYVCEEISPQHLEQDQVNAVLTAVVQGMNQTELSSEVRLAAVKALYNALDFAESNFANEMERNYIMKVICDTAVSKEVEIRQAAFECLVAIASTYYSHLDYYMQTIFNLTANAVKGDEEPVALQAVEFWSAICDEEIALQDEYEGSDDGNSTIHFRFIEKALPSLVPMLLETLLKQEEDQDQDDNVWNISMSGGTCLGLIARTVGDAIVPLVMPFVEANITKPDWHCREAATFAFGSILEGPSVEKLAPLVQSGLGFLLNTMNDSNTQVKDTTAWTLGRVFELLHSPAGANPIINSSNLPRIMAVLLESSKDVPNVAEKVCGAIYFLAQGYEDAESMSSVLTPYLPNVIAALLSAADRADTTHFRLRASAYEALNEIVRVSNVPETSGIIGQLLQEIMRRLNLTFDLHILSSGDKEKQSDLQALLCGVLQVIIQKLSSTDAKSIIALTADQLMTLFLRVFACHSSTVHEEAMLAIGALAYATGPDFVKYMPNFFTYLEAGLQNYEEYQVCSISVGVVGDICRALEDKILPFCDRIMTVLLKDLSNSMLNRSVKPPIFSCFGDIALAIGENFEKYLPYGMPMLQGAAELLGTLDQSDDDMVDYGNQLRRGIFEAYSGILQGIKGPKAQLMIPYATHLLQFTEAVFRDRSRDDSVTKAAVAVLGDLADTLGASSKDLFQAHLFHVEFLRECLDLDDEVRETASWAQGMINQAVVS

SEQ ID NO: 5723 - protein, 868 aa, Echinochloa colona
MDITQVLLAAQSPDANLRTAAESNLTQFQEQNLPNFLLSLSVELSDDGKPPESRRLAGIILKNSLDAKDSAKKDLLTQQWVSVDPSIKSKIKESLLVTLASSVHDARHTSSQVIAKVAAIEIPRREWQDLIAKLLGNMTTPGASAPLKQATLEALGYVCEEISPQHLEQDQVNAVLTAVVQGMNQTELSPEVRLAAVKALYNALDFAESNFANEMERNYIMKVVCDTTVSKEVVIRQAAFECLVAIASTYYSHLDPYMQTIFNLTANAVKGDEEPVALQAVEFWSAICDEEIALQDEYEGSDDGNSTIHFRFIEKALPSLVPMLLETLLKQEEDQDQDDNVWNISMSGGTCLGLIARTVGDAIVPLVMPFVEANITKPDWHCREAATFAFGSILEGPSVEKLAPLVQAGLDFLLNTMNDSNSQVKDTTAWTLGRVFEILHSPAGANPIINNSNLPRIMAVLLESSKDVPNVAEKVCGAIYFLAQGYEDAESLSSVLTPYLPNVIAALLNAADRADTTHFRLRASAYEALNEIVRVSNIPETSGIVGQLLQEIMRRLSLTFDLHILSSGDKEKQSDLQALLCGVLQVIIQKLSSTDAKSIITQTADQLMTLFLRVFACHSSTVHEEAMLAIGALAYATGPDFVKYMPGFFTYLEAGLQNYEEYQVCSISVGVVGDICRALEDKILPFCDRIMTVLLKDLSNSMLNRSVKPLIFSCFGDIALAIGESFEKYLPYAMPMLQGAAELLGTLDQSDDDMVDYGNQLRRGIFEAYSGILQGIKGPKAQLMIPYATHLLQFTEAVFRDRSRDDSVTKAAVAVLGDLADTLGASSKELFHTHLFHVEFLRECLDLDDEVRETASWAQGMINQALVS

SEQ ID NO: 5724 - protein, 158 aa, Pennisetum glaucum
MDITQVLLAAQSPDANLRTAAESNLTQFQGQNLPNFLLSLSIELSNDEKPPESRRLAGIILKNSLDAKDSAKKELLTQQWVSVDPSLKSKIKESLLVTLGSSVHDARHTSSQVIAKVASIEIPRREWQDLIAQLLGNMTSPGASAPLKQHPRGIGVCM

SEQ ID NO: 5725 - protein, 868 aa, Setaria italica
MDITQILLAAQSPDANLRTVAESNLKQFQEQNLPNFLLSLSVELSNDEKPPESRRLAGIILKNSLDAKDSAKKELLTQQWVSMDPSIKLKIKESLLVTLGSSVHDARHTTSQVIAKVASVEIPRREWQDLIAKLLGNMTSPSAYAPLKQATLEALGYVCEEISPQHLEQDQVNAVLTAVVQGMNQTELSFEVRHAAVKALYNALDFAESNFANEMERNYIMKVVCDTGVSKEVEIRQAAFECLVAIASIYYSHLDPYMQTIFNLTANAVKGDEESVALQAVEFWSAICDEEIALQDEYEGSDDGNSTVHFHFIEKALPSLVPMLLETLLKQEEDQDQDDNVWNISMSGGTCLGLIARTVGDAIVPLVMPFVEANITKPDWHCREAATFAFGSILEGPSVEKLVPLVQAGLDFLLNTMNDSNSQVKDTTAWTLGRVFELLHSPAGANPIINNSNLPRIMAVLLESSKDVPNVAEKVCGAIYFLAQGYEDVESMSSVLTPYLPNVIAALLSAADRADTTHFRLRASAYEALNEIVRVSNIPETSGIIGQLLQEIMRRLDLTFDLQILSSGDKEKQSDLQALLCGVLQVIIQKLSSTDSKSIITQTADQLMLLFLRVFACHSSTVHEEAMLAIGALAYATGSDFLKYMPQFFTYLEAGLHNYEEYQVCSISVGALGDICRALEDKILPFCDRIMTVLLKDLSNSMLNRSVKPLIFSCFGDIALAIGENFEKYLPYSMPMLQGAAELLGTLDQSDDDMVDYGNQLRRGIFEAYSGILQGIKGPKAQLMIPYAAHLLQFTEAVFKDRSRDESVTKAAVAVLGDLADTLGASSKDMFQTNLFHVEFLRECIDSDDEVRETASWAQGMINQVVVS

SEQ ID NO: 5726 - protein, 868 aa, Oryza sativa
MNITQILLSAQSADGNLRVVAEGNLKQFQEQNLPNFLLSLSVELSDNEKPPESRRLAGIILKNSLDAKDSAKKELLIQQWVSLDPSIKQKIKESLLITLGSSVHDARHTSSQVIAKVASIEIPRREWQELIAKLLGNMTQQGAPAPLKQATLEALGYVCEEISPEHLEQDQVNAVLTAVVQGMNQTELSPEVRLAAVKALYNALDFAESNFANEMERNYIMKVICDTAVSKEVEIRQAAFECLVAIASTYYVHLDPYMQTIFNLTANAVKGDEEAVALQAIEFWSTICDEEIELQEEYEGSDDANSTVNYRFIEKALPSLVPMLLETLLKQEEDQDQDDNVWNISMSGGTCLGLIARTVGDAIVPLVMPFVEGNITKPDWHCREAATFAFGSILEGPSVEKLAPLVQAGLDFLLNTTKDPNSQVRDTTAWTLGRVFELLHSPASANPIITSANLTRIMTVLLESSKDVPNVAEKVCGAIYFLAQGYEDAESISSVLTPFLPNLIAALLSAADRADTTHFRLRASAYEALNEIVRVSNISETSGIIGQLLQEIMRRLNLTFDLHILSSGDKEKQSDLQALLCGVLQVIIQKLSSSDAKSIIAQTADQLMFLFLHVFACHSSTVHEEAMLAIGALAYATGTDFVKYMPEFFKYLEAGLQNYEEYQVCSISVGVVGDICRALEDKILPFCDGIMTVLLKDLSNSMLNRSVKPPIFSCFGDIALAIGDNFEKYLPYAMPMLQGAAELLAVLDHTDEDMVDYGNQLRRGIFEAYSGILQGIKGAKAQLMIPYASHLLQFTEAVYKDRSRDESVTKAAVAVLGDLADTLGSSSKDLFKSNLFHVEFLRECHDLDDEVRDTASWAQGMINQALVS

SEQ ID NO: 5727 - protein, 923 aa, Sorghum bicolor
KSSLSRDRAAAPLPGCLSAAAPLLSSTCAQPLLCLPPTEHRRCSTCAPLSVALPLHLLLFEAAQSPDANLRTVAEGNLTQFQEQNLPNFLLSLSIELSNDEKPPESRRLAGIILKNSLDEKDSAKKELLTQQWVSVDPSVKLKIKESLLVTLGSSVHDARHTSSQVIAKVASIEIPRREWQDLVAKLLGNMTSPGASAPLKQATLEALGYVCEEISPLDMEQDQVNAVLTAVVQGMNQTELSPEVRLAAVKALYNALDIAVSNFANEMERNYIMKVVCETAVSKEVEIRQAAFECLVAIASTYYPHLDPYMQTIFNLTANAVKGDEEPVALQAVEFWSAICDEEIMLQDEYEGSEDGNSTAHFCFIEKALPSLVPMLLEALLKQEEDQDQDDNVWNISMSGGTCLGLISKTVGDAVVPLVMPFVEANITKPDWHCREAATFAFGSILEGPSVEKLAPLVQAGLDFLLNTMNDTNSQVKDTTAWTLGRVFELLHSPDGANPIINNSNLPRIMSVLLQSSKDAPNVAEKVCGAIYFLAQGYEDAESMSSMLTPYLPNIIAALLSAADRADTTHFRLRASAYEALNEIVRVSNIPETSGIIGQLLQEIMRRLNLTFDLHILSSGDKEKQSDLQALLCGVLQVIIQKLSSTDAKSIISQTADQLMMLFLRVFACHNSTVHEEAMLAIGALAYATGPDFVKYMPNFFTYLEAGLQNYEEYQVCSISVGVVGDICRALEDKILPFCDSIMTVLLKNLSSSMLNRSVKPPIFSCFGDIALAIGENFEKYLPYAIPMLQGAAGLLGTLNQSDDDMVDYGNQLRRGIFEAYSGILQGIKGPKAQQMIPYATHLLQFTEAVFKDRSRDDSVTKAAVAVLGDLADTLGESSKDLFKTQLFHIEFLRECQAQELDDEVRDTAQWAQGMINLAVVS

SEQ ID NO: 5728 - protein, 868 aa, Secale cereale
MDITQILLAAQSPDGNLRSAAEGNIKQFQEQNLPNFLLSLSVELSNDERPPESRRLAGIILKNSLDAKDSAKKELLTQQWVSLDHSIKLQIKESLLITLGSSVGDARQTSSQVIAKIASIEIPRREWQDLIAKLLSNMTQPGASAPLKQATLEALGYVCEEIPPEHLEQDQVNAVLTAVVQGMNQTELSSEVRLAAVKALYNALDFAESNFANEMERTFIMKVICDTAVSKEVEIRQAAFECLVAIASTYYVHLDPYMQTIFNLTANAVKGDEEPVALQAVEFWSTICEEEIELQEEYEGSDDANSTVNYRFIEKALPSLVPMLLETLLKQEEDQEQDDNAWNISMSGGTCLGLIARTVGDAIVPLVMPFVEANITKPDWRCREAATFAFGSILDGPSLEKLAPLVQAGLDFLLNTMNDPNSQVKDTTAWTLGRVFELLHSPCSANPIISNANLPRIMSVLLESSKDVPNVAEKVCGAIYFLAQGYEDAEAVSSLLTPYLPNVIAALLTAADRGDMTHVRLRASAYEALNEVVRVSNIPETSSIIGQLLQEIMRRLNLTFDHQIFSSGDKEKQSDLQALLCGVLQVIIQKLSSSDAKSIIAQTADQLMLLFLRVFACHSATVHEEAMLAIGALAYATGPDFVKYMPEFFKYLEAGLQNYEEYQVCSISVGVVGDICRALEDKNLPFCDGIMTVLLKDLSNSQLNRSVKPPIFSCFGDIALAIGDNFEKYLPYAMPMLQGAAELLVVLDQNDEDMVDYGNQLRRGIFEAYSGILQGIKGAKAQLMIPYAGHLLQFTEAVYKDRSRDESVTKAAVAVLGDLADTLGPISKDLFKSHLFHVEFLRECQDLDDEVRETASWTQGMINQAIVS

SEQ ID NO: 5729 - protein, 868 aa, Triticum aestivum
MDITQILLAAQSPDGNLRSAAEGNIKQFQEQNLPNFLLSLSVELSNDERPPESRRLAGIILKNSLDAKDSAKKELLIQQWVSLDPSIKLQIKESLLITLGSSVGDARQTSSQVIAKIASIEIPRREWQDLIAKLLSNMTQPGASAPLKQATLEALGYVCEEIPPEHLEQDQVNAVLTAVVQGMNQTELSSEVRLAAVKALYNALDFAESNFANEMERTFIMKVICDTAVSKEVEIRQAAFECLVAIASTYYVHLDPYMQTIFNLTANAVKGDEEPVALQAVEFWSTICEEEIELQEEYEGSDDANSTVNYRFIEKALPSLVPMLLETLLKQEEDQEQDDNAWNISMSGGTCLGLIARTVGDAIVPLVMPFVEANITKPDWRCREAATFAFGSILDGPSLEKLAPLVQAGLDFLLNTMNDPNSQVKDTTAWTLGRVFELLHSPCSTNPIISNANLPRIMAVLLESSKDVPNVAEKVCGAIYFLAQGYEDAEPASSLLTPYLPNVIAALLTAADRGDMTHVRLRASAYEALNEIVRVSNIPETSSIIGQLLQEIMRRLNLTFDHQIFSSGDKEKQSDLQALLCGVLQVIIQKLSSSDAKSIIAQTADQLMLLFLRVFACHSATVHEEAMLAIGALAYATGPDFVKYMPEFFKYLEAGLQNYEEYQVCSISVGVVGDICRALEDKILPFCDGIMTVLLKDLSNSQLNRSVKPPIFSCFGDIALAIGENFEKYLPYAMPMLQGAAELLVVLDQNDEDMVDYGNQLRRGIFEAYSGILQGIKGAKAQLMIPYAGHLLQFTEAVYKDRSRDESVTKAAVAVLGDLADTLGPISKDLFKSHLFHVEFLRECLDLDDEVRETASWTQGMINQAIVS

SEQ ID NO: 5730 - protein, 868 aa, Triticum aestivum
MDITQILLAAQSPDGNLRSAAEGNIKQFQEQNLPNFLLSLSVELSNDERPPESRRLAGIILKNSLDAKDSAKKELLTQQWVSLDHSIKLQIKESLLITLGSSVGDARQTSSQVIAKIASIEIPRREWQDLIAKLLSNMTQPGASVPLKQATLEALGYVCEEIPPEHLEQDQVNAVLTAVVQGMNQTELSSEVRLAAVKALYNALDFAESNFANEMERTFIMKVICDTAVSKEVEIRQAAFECLVAIASTYYVHLDPYMQTIFNLTANAVKGDEEPVALQAVEFWSTICEEEIELQEEYEGSDDANSTVNYRFIEKALPSLVPMLLETLLKQEEDQEQDDNAWNISMSGGTCLGLIARTVGDAIVPLVMPFVEANITKPDWRCREAATFAFGSILDGPSLEKLAPLVQAGLDFLLNTMNDPNSQVKDTTAWTLGRVFELLHSPCSTNPIISNANLPRIMAVLLESSKDVPNVAEKVCGAIYFLAQGYEDAEPASSLLTPYLPNVIAALLTAADRGDMTHVRLRASAYEALNEIVRVSNIPETSSIIGQLLQEIMRRLNLTFDHQIFSSGDKEKQSDLQALLCGVLQVIIQKLSSSDAKSIIAQTADQLMLLFLRVFACHSATVHEEAMLAIGALAYATGPDFVKYMPEFFKYLEAGLQNYEEYQVCSISVGVVGDICRALEDKILPFCDGIMTVLLKDLSNSQLNRSVKPPIFSCFGDIALAIGENFEKYLPYAMPMLQGAAELLVVLDQNDEDMVDYGNQLRRGIFEAYSGILQGIKGAKAQLMIPYAGHLLQFTEAVYKDRSRDESVTKAAVAVLGDLADTLGPISKDLFKSHLFHVEFLRECLDLDDEVRETASWTQGMINQAIVS

SEQ ID NO: 5731 - protein, 868 aa, Secale cereale
MDITQILLAAQSPDGNLRSAAEVNIKQFQEQNLPNFLLSLSVELSNDERPPESRRLAGIILKNSLDAKDSAKKEQLTQQWVSLDHSIKLQIKESLLITLGSSVGDARQTSSQVIAKIASIEIPRREWQDLIAKLLSNMTQPGASAPLKQATLEALGYVCEEIPPEHLEQDQVNAVLTAVVQGMNQTELSSEVRLAAVKALYNALDFAESNFANEMERTFIMKVICDTAVSKEVEIRQAAFECLVAIASTYYVHLDPYMQTIFNLTANAVKGDEEPVALQAVEFWSTICEEEIELQEEYEGSDDANSTVNYRFIEKALPSLVPMLLETLLKQEEDQEQDDNAWNISMSGGTCLGLIARTVGDAIVPLVMPFVEANITKPDWRCREAATFAFGSILDGPSLEKLAPLVQAGLDFLLNTMNDPNSQVKDTTAWTLGRVFELLHSPCSANPIISNANLPRIMSVLLESSKDVPNVAEKVCGAIYFLAQGYEDAEAVSSLLTPYLPNVIAALLTAADRGDMTHVRLRASAYEALNEVVRVSNIPETSSIIGQLLQEIMRRLNLTFDHQIFSSGDKEKQSDLQALLCGVLQVIIQKLSSSDAKSIIAQTADQLMLLFLRVFACHSATVHEEAMLAIGALAYATGPDFVKYMPEFFKYLEAGLQNYEEYQVCSISVGVVGDICRALEDKILPFCDGIMTVLLKDLSNSQLNRSVKPPIFSCFGDIALAIGDNFEKYLPYAMPMLQGAAELLVVLDQNDEDMVDYGNQLRRGIFEAYSGILQGIKGAKAQLMIPYAGHLLQFTEAVYKDRSRDESVTKAAVAVLGDLADTLGPISKDLFKSHLFHVEFLRECQDLDDEVRETASWTQGMINQAIVS

SEQ ID NO: 5732 - protein, 868 aa, Brachypodium distachyon
MDITQILLAAQSPDGNLRAVAEGNIKQFQEQNLPNFLLSLSVELSSDERPPESRRLAGIILKNSLDAKDSAKKELLTQQWVSLDPLIKSRIKDSLLITLGSSVADARQTSSQVIAKVASIEIPRKEWQDLIAKLLNNMTQPGASAAVKQATLEALGYVCEEIPPEHLEQEQVNAVLTAVVQGMNQTELSSEVRLAAVKALYNALDFAESNFANEMERNFIMKVICDTAVSNEVEIRQAAYECLVAIASTYYVHLDPYMQTIFNLTANAVKGDEEPVALQAVEFWSTICEEEIELQEEYVGSDDANSTVNYRFIEKALPSLVPMLLETLLKQEEDQEQDDNAWNISMSGGTCLGLIARTVGDAIVPLVMPFVEANITKPDWHCREAATFAFGSILDGPSLEKLAPLVQAGLDFLLNTMKDPNSQVKDTTAWTLGRVFELLHSPCSSNPIISNANLPRIMTVLLDSSKDVPNVAEKVCGAIYFLAQGYEDAELVSSSLTPYLPNVIAALLSAADRADTTHFRLRASAYEALNEIVRVSNIPETSSIIGQLLQEIMRRLNLTFDHQIFSSGDKEKQSDLQALLCGVLQVIIQKLSNSDAKSIIAQTADQLMFLFLRVFACHSSTVHEEAMLAIGALAYATGPDFVKYMPEFFKYLEAGLQNHEEYQVCSISVGVVGDICRALEDKVLPFCDGIMTVLLKDLSNPVLNRSVKPPIFSCFGDIALAIGENFEKYLPYAMPMLQGAAELLGVLDQNDEDMVDYGNQLRRGIFEAYSGILQGIKGEKAQLMIPYAGHLLQFTEAVYKDQSRDESVTKAAVAVLGDLADTLGPMSKDLFKGHLFHVEFLRECLDVDDEVRETASWAQGMISQAIVS

SEQ ID NO: 5733 - protein, 868 aa, Secale cereale
MDITQILLAAQSPDGNLRSAAEVNIKQFQEQNLPNFLLSLSVELSNDERPPESRRLAGIILKNSLDAKDSAKKEQLTQQWVSLDHSIKLQIKESLLITLGSSVGDARQTSSQVIAKIASIEIPRREWQDLIAKLLSNMTQPGASAPLKQATLEALGYVCEEIPPEHLEQDQVNAVLTAVVQGMNQTELSSEVRLAAVKALYNALDFAESNFANEMERTFIMKVICDTAVSKEVEIRQAAFECLVAIASTYYVHLDPYMQTIFNLTANAVKGDEEPVALQAVEFWSTICEEEIELQEEYEGSDDANSTVNYRFIEKALPSLVPMLLETLLKQEEDQEQDDNAWNISMSGGTCLGLIARTVGDAIVPLVMPFVEANITKPDWRCREAATFAFGSILDGPSLEKLAPLVQAGLDFLLNTMNDPNSQVKDTTAWTLGRVFELLHSPCSANPIISNANLPRIMSVLLESSKDVPNVAEKVCGAIYFLAQGYEDAEAVSSLLTPYLPNVIAALLTAADRGDMTHVRLRASAYEALNEVVRVSNIPETSSIIGQLLQEIMRRLNLTFDHQIFSSGDKEKQSDLQALLCGVLQVIIQKLSSSDAKSIIAQTADQLMLLFLRVFACHSATVHEEAMLAIGALAYATGPDFVKYMPEFSKYLEAGLQNYEEYQVCSISVGCGRIPCRALEDKILPFCDGIMTVLLKDLSNSQLNRSVKPPIFSCFGDIALAIGDNFEKYLPYAMPMLQGAAELLVVLDQNDEDMVDYGNQLRRGIFEAYSGILQGIKGAKAQLMIPYAGHLLQFTEAVYKDRSRDESVTKAAVAVLGDLADTLGPISKDLFKSHLFHVEFLRECQDLDDEVRETASWTQGMINQAIVS

SEQ ID NO: 5734 - protein, 868 aa, Hordeum vulgare
MDITQILLAAQSPDGNLRSAAEANIKQFQEQNLPNFLLSLSVELSNDERPPESRRLAGIILKNSLDAKDSARKELLIQQWVSLDHSIKSQIKESLLITLGSSVGDARQTSSQVIAKIASIEIPRREWQDLIAKLLSNMTQPGASAPLKQATLEALGYVCEEIPPEHLEQDQVNAVLTAVVQGMNQTELSSEVRLAAVKALYNALDFAESNFANEMERTFIMKVICDTAVSKEVEIRQAAFECLVAIASTYYVHLDPYMQTIFNLTANAVKGDEEPVALQAVEFWSTICEEEIELQEEYEGSDDANSTVNYRFIEKALPSLVPMLLETLLKQEEDQEQDDNAWNISMSGGTCLGLIARTVGDAIVPLVMPFVEANITKPDWRCREAATFAFGSILDGPSLEKLAPLVQAGLDFLLNTMNDPNSQVKDTTAWTLGRVFELLHSPCSTNPIISNANLPRIMAVLLESSKDVPNVAEKVCGAIYFLAQGYEDAEPVSSLLTPYLPNVIAALLTAADRSDMTHVRLRASAYEALNEIVRVSNIPETSSIIGQLLQEIMRRLNLTFDHQIFSSGDKEKQSDLQALLCGVLQVIIQKLNSSDAKSIIAQTADQLMLLFLRVFACHSATVHEEAMLAIGALAYATGPDFEKYMPEFLKYLEAGLQNYEEYQVCSISVGVVGDICRALEDKILPFCDGIMTVLLKDLSNSQLNRSVKPPIFSCFGDIALAIGENFEKYLPYAMPMLQGAAELLVVLDQNDEDMVDYGNQLRRGIFEAYSGILQGLKGAKAQLMIPYAGHLLQFTEAVYKDGSRDESVTKAAVAVLGDLADTLGPISKDLFKSHLFHVEFLRECLDLDDEVRETASWTQGMINQAIVS

SEQ ID NO: 5735 - protein, 220 aa, Secale cereale
MDITQILLAAQSPDGNLRSVAEGSLKLFQEQNLPRFLLSLSVELSSDQRPPECRRLAGIILKNSLDAKDCSRKELLGQQWVSLDLLIKSRIKESLLLTLGSSVPDARQASSQVIAKVASIEMPRREWPDLIAKLLGNMTQQGASAPLKQATLEALGYVCEEISPEHLEQDQVNAVLTAVVQGMNQAELSVEVRLAAVKALYNASLFCLIATLQMIWRGTI

SEQ ID NO: 5736 - protein, 869 aa, Hordeum vulgare
MDITQILLAAQSPDGNLRSVAEGSLKLFQEQNLPRFLLSLSVELSNDERPPESRRLAGIILKNLLDAKDCSRKELLAQQWVSLDLSIKSRIKESLLLTLGSSVPDARQASSQVIAKVASIEMPRREWQDLIAKLLGNMTQQGASAPLKQATLEALGYVCEEISPEHLEQDQVNAVLTAVVQGMNQTELSVEVRLSAVKALYNALYFADSNFANEMERNYILKVICETAVSNEVEIRQAAFECLVAIASIYYMHLEPYMQTVFNLTSNTVKGDEESVALQAIEFWSTICDEEIQLQEEYEGYDDANSSANFRFIEKALSSLVPMLLETLLKQEEDEEQDDNVWNISMSGGTCLGLIAKAVGDAIVPLVMPFVEANITNPDWHCREAATFAFGSILDGPSLPKLAPLVHAGLNFLLNAMKDPNSQVKGTTAWTLGRVFEFLHSPTSGNPIVTSGNLTRIMTVLLESSKDVPNVAEKVCGAIYFLAQGYENTVDSVSSVLTPYLPSVITALLSASDCADTAHFRLRSSAYEALNEIVRVTNIDETSSIIGQLLQEVMRRLNLTFDLEIFSSGDKENQSDLQALLCGVLQVIVPKLSNSDAESIITQNADQLMFLFLRVFACHSSTVHEEAMLAIGVLADAIGPDFVKYMPEFFKYLEAGLHNHEEYQVCSISVGVVGDICRTLEDKVLPFCDGIMTVLLKDLSNPTLNRSVKPPIFSCFGDIALAIGGNFEKYLPYAIPMLQGAAELVAVLDQSDDDMVHYGNQLRRGIFEAYSGILQGIKGPKAQLMVPCATHLLQFTEAVYKDGSRDESVTKAAVAVLGDLADTLGPVSKDLFRSHLFHVEFFRECLDSDEEVRETASWAQGMINQAVVA

SEQ ID NO: 5737 - protein, 603 aa, Brachypodium distachyon
MRRRSVLPSHHDDLDKGGGKPPQSRLCLLATLCVMFWVLIFYFHFSVLPSDADASTTHPVSVATEARIARADPAPDGRVSEPDDPLLAPPAVVSEPPPATLPKEEEMEQEAPTAVVVAQEEAPRREYPFQRALKTAENESDPCGGRYIYVHELPPRFNEDMLRECQRLSLWTNMCKFMSNDGLGPPLGNEEGVFSNTGWYATNQFAVDVIFGNRMKQYECLTKDSSIAAAVFVPFYAGFDVARYLWGYNTSMRDAASHDLVDWLRQRPEWNVMGGRDHFLVGGRIAWDFRRLTDQESDWGNKLLFMPAAKNMSMLVVESSPWNANDFAVPYPTYFHPAKDADVFLWQDRMRSLERPWLFSFAGAPRPGDPMSIRGQLIDQCRTSSFCKLLECDLGESKCHSPSAIMKMFQSSLFCLQPQGDSYTRRSAFDSMLAGCIPVFFHPGSAYVQYTWHLPKNYTRYSVFIPEDSIRKGNVSIEEILKSIHPDVAKQMREEVINLIPRVIYADPRSKLEALKDAFDVSVEAIINKVTQLRRDIISNSEGKDFVEENSWKYDLLEEGQRTIGPHEWDPFFSKPKDKGGDSTNSSEEAAKGAWKIEQRGQN

SEQ ID NO: 5738 - protein, 602 aa, Panicum virgatum
MRRRPVLPSHHDDMDKGGGKPASSRLCFLATLCAMFWVLIFYFHFAVVSNEPDASAAQAGGVRIARARLQLPEPDGAVRHDMPLVPPARASEPPPSVARPKEVVVEEKPAAGARQEEAQPKVAAPYPFERALKTAENKSDPCGGRYIYVHELPPRFNEDMLRDCEKLSVWTNMCRFMSNDGLGPPLSDEEGVFSSTGWYGTNQFSVDVIFGNRMKQYECLTNDSSIAAAVFVPFYAGFDIARYLWGYNISTRDAASLDLVDWLMKKPEWNVMGGRDHFLVAGRITWDFRRLTEEESDWGSKLLFLPAAKNMSMLVVESSPWNSNDFGIPYPTYFHPAKDADVFLWQDRMRSLERPWLFSFAGAPRPGDPMSIRGQLIDQCRSSSVCKLLECDLGESKCHSPSTIMKMFQSSLFCLQPQGDSYTRRSAFDSMLAGCIPVFFHPGSAYVQYTWHLPKNYTRYSVFIPEDDIRAKNASIEERLKSIHPDVVKNMREEVINLIPRVIYADPRSKLETLKDAFDVSIEAIINKVTKLRRDIIAGREDKDFIEENSWKYSLLEDGQRTIGPHEWDPFFSKPKEKGGDPSSSAAEAAKNSWKSEQRGQN

SEQ ID NO: 5739 - protein, 604 aa, Panicum virgatum
MRRRSVLPSHHDDMEKGGGKPASSRLCFLATLCAMFWVLIFYFHFAVVSNEPDAQAGGVRIARARLQLPEPDGAARHDMPLEPPARASERPPPVTRPKEEEEEEEEKEENPAAAARQEEAPPKVAASYPFERALKTAENKSDPCGGRYIYVHELPPRFNEDMLRDCEKLSVWTNMCRFMNNDGLGPPLSDEEGVFSSTGWYGTNQFSVDVIFGNRMKQYECLTKDSSIAAAVFVPFYAGFDIARYLWGHNISTRDAASLDLVDWLMKKPEWNVMGGRDHFLVAGRITWDFRRLTEEESDWGSKLLFLPAAKNMSMLVVESSPWNSNDFGIPYPTYFHPAKDADVFLWQDRMRSLERPWLFSFAGAPRPGDPMSIREQLIDQCRSSSVCKLLECDLGESKCHSPSTIMKMFQSSLFCLQPQGDSYTRRSAFDSMLAGCIPVFFHPGSAYVQYTWHLPKNYTRYSVFIPEDDIRTRNASIEERLKSIHPDVVKNMREEVINLIPRVIYADPRSKLETLKDAFDVSIEAIINKVTKLRRDIMAGREDKDFIEENSWKYSLLEDGQRTIGPHQWDPFFSKPKEKGGDPNSSSAEAAKNSWKSEQRGQN

SEQ ID NO: 5740 - protein, 491 aa, Panicum virgatum
MGENGVPKHCYPAAAMEVTSVELGHTAASKCYDDDGRLKRTGTMWTASAHIITAVIGSGVLSLAWAIAQLGWVAGPAVMLLFSFVTYYTSALLADCYRSGDPCTGKRNYTYMDAVNANLSGVKVQICGFLQYANIVGVAIGYTIAASISMLAIKKANCFHVEGHGVPCSISSTPYMIIFGVAEIFFSQIPDFDQISWLSILAAVMSFTYSTIGLGLGIVQVVANKGVQGSLTGISVGVVAPVDKVWRSLQAFGDIAFAYSYSLILIEIQDTIRAPPPSESKVMRRATIVSVAVTTLFYMLCGCMGYAAFGDAAPGNLLTGFGFYEPFWLLDVANAAIVVHLVGAYQVYCQPLFAFVEKWAQQRWPKSRYITGEVDVPLSLAGSAGRCYKMNLFRLTWRTAFVVATTVVSMLLPFFNDVVGLLGALGFWPLTVYFPVEMYIVQKKVPRWSTRWVCLQLLSLACLIITVASAAGSVAGIISDLKVYRPFVTTY

SEQ ID NO: 5741 - protein, 489 aa, Panicum virgatum
MGENGKHCYPAAAMEVTSAELGHTAASKCYDDDGRLKRTGTMWTASAHIITAVIGSGVLSLAWAIAQLGWVAGPAVMLLFSFVTYYTSGLLADCYRSGDACTGKRNYTYMDAVNANLSGVKVQICGFLQYANIVGVAIGYTIAASISMLAIKKANCFHVEGHGDPCSISSTPYMIIFGVAEIFFSQIPDFDQISWLSILAAVMSFTYSAIGLGLGIVQVVANKGVQGSLTGISVGAVTPVDKVWRSLQAFGDIAFAYSYSLILIEIQDTIRAPPPSESKVMRRATIVSVAVTTLFYMLCGCTGYAAFGDAAPGNLLTGFGFYEPFWLLDVANAAIVVHLVGAYQVYCQPLFAFVEKWAQQRWPESRYITGEVGVPLSLSGSAGRCYKMNLFRLTWRTAFVVATTVVSMLLPFFNDVVGLLGALGFWPLTVYFPVEMYIVQKKVPRWSTRWVCLQLLSLGCLIITVASAAGSVAGIISDLKVYKPFVTTY

SEQ ID NO: 5742 - protein, 494 aa, Setaria italica
MGENVVPKHCYPAAAAAAMEVTSVELGHTAASKCYDDDGRLKRTGTMWTASAHIITAVIGSGVLSLAWAIAQLGWVAGPTVMLLFSFVTYYTSALLADCYRSGDPCTGKRNYTYMDAVNANLSGIKVQICGFLQYANIVGVAIGYTIAASISMLAIKKANCFHVEGHGDPCSISSTPYMIIFGVAEIFFSQIPDFDQISWLSILAAVMSFTYSTIGLGLGIVQVVANKGVQGSLTGISIGAVTPIDKVWRSLQAFGDIAFAYSYSLILIEIQDTIRAPPPSESKVMRRATVVSVAVTTLFYMLCGCMGYAAFGDNAPGNLLTGFGFYEPFWLLDVANAAIVVHLVGAYQVYCQPLFAFVEKWAKQKWPKSKYITGEVDVPLSLSGSAGRCYKLNLFRLTWRTAFVVATTVISMLLPFFNDVVGLLGALGFWPLTVYFPVEMYIVQKKVPRWSTRWVCLQMLSLACLIITVASAAGSVAGIISDLKVYKPFVTTY

SEQ ID NO: 5743 - protein, 485 aa, Sorghum bicolor
MGEHCYPATMEESSIELGHTAASKCYDDDGRLKRTGTMWTASAHIITAVIGSGVLSLAWAIAQLGWVAGPAVMLLFSFVTYYTSALLADCYRSGDPCTGKRNYTYMDAVNANLSGIKVQLCGFLQYANIVGVAIGYTIAASISMLAIKRANCFHVEGHGDPCNISSTPYMIIFGVAEIFFSQIPDFDQISWLSILAAVMSFTYSTIGLGLGIVQVVANKGVQGSLTGISVGAVTPLDKVWRSLQAFGDIAFAYSYSLILIEIQDTIRAPPPSESKVMRRATIVSVAVTTLFYMLCGCMGYAAFGDNAPGNLLTGFGFYEPFWLLDVANAAIVVHLVGAYQVYCQPLFAFVEKWAQQRWPKSSYITGEVDVPLSLAGAAGRCYKLNLFRLTWRTAFVVATTVVSMLLPFFNDVVGLLGALGFWPLTVYFPVEMYIVQKKVPRWSTLWVCLQLLSLGCLIITVASAAGSVAGIISDLKVYKPFVTTY

SEQ ID NO: 5744 - protein, 476 aa, Saccharum officinarum
MEVTSVELGHTAASKCYDDDGRLKRTGTMWTASAHIITAVIGSGVLSLAWAIAQLGWVAGPAVMLLFSFVTYYTSALLADCYRSGDACTGKRNYTYMDAVNANLSGIKVQLCGFLQYANIVGVAIGYTIAASISMLAIKRANCFHVEGHGDPCNISSTPYMIIFGVAEIFFSQIPDFDQISWLSILAAVMSFTYSTIGLGLGIVQVVANKGVQGSLTGISVGTVTPLDKVWRSLQAFGDIAFAYSYSLILIEIQDTIRAPPPSESKVMRRATIVSVAVTTLFYMLCGCMGYAAFGDNAPGNLLTGFGFYEPFWLLDVANAAIVVHLVGAYQVYCQPLFAFVEKWAQQRWPKSRYVTGEVDVPLSLAGAAGRCYKLNLFRLTWRTAFVVATTVVSMLLPFFNDVVGLLGALGFWPLTVYFPVEMYIVQKKVPRWSTRWVCLQLLSLSCLTITVACDAGSVAGIISDLKVYKPFVTTY

SEQ ID NO: 5745 - protein, 482 aa, Brachypodium distachyon
MGENGVGRQPYYPAMEVSGVENGHTAGSKCYDDDGRLKRTGTMWTASAHIITAVIGSGVLSLGWAIAQLGWVAGPAVMLLFSLVTYYTSALLSDCYRSGDETTGKRNYTYMDAVNANLSGIKVQICGFLQYANIVGVAIGYTIAASISMLAIKRANCFHAKGHVNPCHISSTPYMIIFGAAQIFFSQIPDFDQISWLSIVAAIMSFTYSTIGLGLGIVQVVANRGVKGSLTGISIGVVTPMDKVWRSLQAFGDIAFAYSYSLILIEIQDTIRAPPPSESKVMRRATVVSVATTTLFYMLCGCMGYAAFGDEAPGNLLTGFGFYEPFWLLDVANAAIVVHLVGAYQVYCQPLFAFVEKWAQQRWPKSSFIVGEIEVSFGFKVNLFRLTWRSAFVVATTVVSMLLPFFNDVVGFLGALGFWPLTVYFPVEMYIVQKKIPRWGSQWVCLQLLSLACLVITVASAAGSVAGIMSDLKVYKPFSTSD

SEQ ID NO: 5746 - protein, 489 aa, Hordeum vulgare
MGQNGVGKNYYQGTAAAAMEVSSVEHGQAAASKCYDDDGRLKRTGTMWTASAHIITAVIGSGVLSLAWAIGQLGWVAGPAVMLLFSLVTYYTSSLLSDCYRSGDETTGKRNYTYMDAVNANLSGIKVQLCGFLQYANIVGVAIGYTIAASISMLAIKKANCFHVKGHVNPCHISSTPYMIIFGVAEIFFSQIPDFDQISWLSILAAIMSFTYSIIGLSLGIVQVVANKGVKGSLTGISIGVVTPMDKVWRSLQAFGDIAFAYSYSLILIEIQDTIRAPPPSESKVMRRATVVSVATTTLFYMLCGCMGYAAFGDNAPGNLLTGFGFYEPFWLLDIANAAIVVHLVGAYQVYCQPLFAFVEKWAQQRWPKSRFITGEIQVPLISSGFKINLFRLTWRSAFVVATTVVSMLLPFFNDVVGFLGAIGFWPLTVYFPVEMYIVQKKIPKWSSQWVCLQLLSLACLIITIAAAAGSIAGIMSDLKVYKPFSTTD

SEQ ID NO: 5747 - protein, 478 aa, Zea mays
MEVSSVEFGHHAAAASKCFDDDGRLKRTGTMWTASAHIITAVIGSGVLSLAWAIAQLGWVAGPTVMLLFSFVTYYTSALLADCYRSGDACTGKRNYTYMDAVNANLSGVKVWFCGFLQYANIVGVAIGYTIAASISMLAIQRANCFHVEGHGDPCNISSTPYMIIFGVVQIFFSQIPDFDQISWLSILAAVMSFTYSTIGLGLGIAQVVSNKGVQGSLTGISVGLVTPVDKMWRSLQAFGDIAFAYSYSLILIEIQDTIRAPPPSESKVMRRATVVSVAVTTFFYMLCGCMGYAAFGDNAPGNLLTGFGFYEPFWLLDVANAAIAVHLVGAYQVYCQPLFAFVEKWARQRWPKSRYITGEVDVPLPLGTAGGRCYKLSLFRLTWRTAFVVATTVVSMLLPFFNDVVGLLGALGFWPLTVYFPVEMYIVQKKVPRWSTRWVCLQLLSVACLVITVASAAGSVAGIVSDLKVYKPFVTTS

SEQ ID NO: 5748 - protein, 494 aa, Zea mays
MAENNVVATYYYPTAAPAAMEVCGAELGQGKPDKCFDDDGRPKRNGTMWTASAHIITAVIGSGVLSLGWAIAQLGWVAGPVVMLLFSLVTYYTSSLLADCYRSGDPSTGKRNYTYMDAVNANLSGIKVQICGFLQYANIVGVAIGYTIAASISMLAIRRANCFHQKGHGNPCKISSTPYMIIFGVAEIFFSQIPDFDQISWLSILAAVMSFTYSSIGLGLGVVQVIANRGVQGSLTGITIGVVTPMDKVWRSLQAFGDVAFAYSYSLILIEIQDTIRAPPPSESTVMKRATVVSVAVTTLFYMLCGCMGYAAFGDGAPGNLLTGFGFYEPFWLLDVANAAIVVHLVGAYQVYCQPLFAFVEKWAAQRWPDSAYITGEVEVPLPLPASRRRCCKVNLFRATWRTAFVVATTVVSMLLPFFNDVVGFLGALGFWPLTVYFPVEMYVVQKKVPRWSSRWVCLQMLSLGCLVISIAAAAGSIAGIASDLKVYRPFKSY

SEQ ID NO: 5749 - protein, 491 aa, Sorghum bicolor
MAENVVATYYYPTAAPAAMEVCGAELGKGASDKCFDDDGRPKRNGTMWTASSHIITAVIGSGVLSLGWAIAQLGWVAGPAAMLLFSLVTYYTSSLLADCYRSGDPSTGKRNYTYMDAVNANLSGIKVQICGFLQYANIVGVAIGYTIAASISMLAIRRANCFHQKGHGNPCKVSSTPYMIIFGVAEIFFSQIPDFDQISWLSILAAVMSFTYSSIGLGLGIVQVIANRGVQGSLTGISIGVVTPMDKVWRSLQAFGDIAFAYSYSLILIEIQDTIRAPPPSESTVMKRATVVSVAVTTLFYMLCGCMGYAAFGDGAPGNLLTGFGFYEPFWLLDVANAAIVVHLVGAYQVYCQPLFAFVEKWAAQRWPDSAFVTGEVEVPLPATRRRSCKVNLFRATWRTAFVVATTVVSMLLPFFNDVVGFLGALGFWPLTVYFPVEMYVVQKKVPRWSPRWVCLQMLSLGCLVISVAAAAGSIAGIASDLKVYRPFKSY

SEQ ID NO: 5750 - protein, 487 aa, Panicum virgatum
MAAENVVATYYYPTAAPGAMEVCGAEFGRGAGDKCFDDDGRPKRSGTVWTASAHIITAVIGSGVLSLGWATAQLGWVAGPAVMLLFSLVTYYTSALLADCYRSGDPTTGKRNYTYMDAVNANLSGVKVQICGFLQYANIVGVAIGYTIAASISMLAIRRANCFHQKGHGNPCAISSTPYMIIFGVAEIFFSQIPDFDQISWLSILAAVMSFTYSTIGLGLGIVQVIANKGVQGSLTGISIGAVTPMDKVWRSLQAFGDIAFAYSYSLILIEIQDTIRAPPPSESTVMKRATVVSVAVTTLFYMLCGCMGYAAFGDGAPGNLLTGFGFYEPFWLLDVANAAIVVHLVGAYQVYCQPLFAFVEKWAARRWPGSAFVAGEVEVPLLPRYKVNPFRATWRTAFVAATTAVSMLLPFFNDVVGFLGALGFWPLTVYFPVEMYVVQKKVPRWSTRWVCLQMLNLGCLVISVAAAAGSIAGIASDLKVYRPFKS

SEQ ID NO: 5751 - protein, 488 aa, Oryza sativa
MGENVVGTYYYPPSAAAMDGVELGHAAAGSKLFDDDGRPRRNGTMWTASAHIITAVIGSGVLSLGWAIAQLGWVAGPAVMVLFSLVTYYTSSLLSDCYRSGDPVTGKRNYTYMDAVNANLSGFKVKICGFLQYANIVGVAIGYTIAASISMLAIGRANCFHRKGHGDPCNVSSVPYMIVFGVAEVFFSQIPDFDQISWLSMLAAVMSFTYSVIGLSLGIVQVVANGGLKGSLTGISIGVVTPMDKVWRSLQAFGDIAFAYSYSLILIEIQDTIRAPPPSESAVMKRATVVSVAVTTVFYMLCGSMGYAAFGDDAPGNLLTGFGFYEPFWLLDIANAAIVVHLVGAYQVFCQPLFAFVEKWAAQRWPESPYITGEVELRLSPSSRRCRVNLFRSTWRTAFVVATTVVSMLLPFFNDVVGFLGALGFWPLTVYFPVEMYVVQKKVPRWSTRWVCLQMLSVGCLVISIAAAAGSIAGVMSDLKVYRPFKGY

SEQ ID NO: 5752 - protein, 308 aa, Triticum aestivum
MIIFGVAQVFFSQIPDFDQISWLSMLAAAMSFTYSSIGLGLGIVQGIANGGVKGSLTGISIGTVTPMQKVWRSTQAFGDIAFAYSYSLILIEIQDTIRAPPPSESTVMKRATMVSVAVTTVFYMLCGCMGYAAFGDAAPGNLLTGFGFYEPFWLLDVANAAIVVHLVGAYQVYCQPLFAFVEKWAAKRWPESTFVTGEVEVPLFRTYKVNMFRATWRTAFVVATTVVSMMLPFFNDVVGFLGALGFWPLTVYFPVEMYVVQKKVPKWSTQWVCLQMLSLGCLAISLAAAAGSIAGIKSDLKVYHPFKS

SEQ ID NO: 5753 - protein, 218 aa, Triticum aestivum
MADKVVATYYYPPMEVAAAELGHTAGSKLDDDGRNKRTGTMWTASSHIITAVIGSGVLSLGWAIAQLGWVAGPAVMLLFSLVTYFTSSLLADCYRSGDQSTGKRNYTYMDAVNANLSGIKVQICGVLQYANIVGVSIGYTIAASISMLAIKRANCFHGNGHADPCKVSSAPYMIIFGVAQVFFSQIPDFDQISWLSMLAQPCPSPTPPSASASASSKS

SEQ ID NO: 5754 - protein, 441 aa, Avena sativa
MWTASSHIITAVIGSGVLSLGWAIAQLGWVAGPAVMILFSLVTYFTSSLLADCYRSGDQSTGKRNYTYMDAVNANLSGVKVKICGVLQYANIVGVAIGYTIAASISMLAIKRANCFHGKGHADPCKISSTPYMVIFGVAQVFFSQIPDFDQISWLSMLAAAMSFTYSSIGLGLGIVQVIANGGVKGSMTGISIGAVTPMQKVWRSTQAFGDIAFAYSYSLILIEIQDTIRAPPPSESTVMKRATGVSVAVTTVFYMLCGCMGYAAFGDAAPGNLLTGFGFYEPFWLLDVANAAIVVHLVGAYQVYCQPLFAFVEKWAAQRWPDSSFVTGEVEVPLLRTSYKVNMFRATWRTAFVVATTVVSMMLPFFNDVVGFLGALGFWPLTVYFPVEMYVVQKKVPKWSTKWVCLQILSLGCLAISLAAAAGSIAGIKSDLKVYHPFKT

SEQ ID NO: 5755 - protein, 480 aa, Triticum aestivum
MADKVVATYYYPPMEVAAAELGQTAGSKLDDDGRNKRTGTMWTASSHIITAVIGSGVLSLGWAIAQLGWVAGPAVMLLFSLVTYFTSSLLADCYRSGDQSTGKRNYTHMDAVNANLSGIKVQICGVLQYANIVGVSIGYTIAASISMLAIKRANCFHGNGHADPCKVSSVPYMIIFGVAQVFFSQIPDFDQISWLSMLAAAMSFTYSSIGLGLGIVQVIANGGIKGSLTGISIGTVTPMQKVWRSTQAFGDIAFAYSYSLILIEIQDTIRAPPPSESTVMKRATMVSVAVTTVFYMLCGCMGYAAFGDAAPGNLLTGFGFYEPFWLLDIANAAIVIHLVGAYQVYCQPLFAFVEKWAAKRWPESTYVTGEVEVPLFRTYKVNMFRAAWRTAFVVATTVVSMMLPFFNDVVGFLGALGFWPLTVYFPVEMYVVQKKVPKWSTQWVCLQMLSLGCLAISLAAAAGSIAGIKSDLKVYHPFKS

SEQ ID NO: 5756 - protein, 488 aa, Secale cereale
MEVAAAELGHTAGSKLDDDGRNKRTGTMWTASSHIITAVIGSGVLSLGWAIAQLGWVAGPAVMLLFSLVTYFTSSLLADCYRSGDQSTGKRNYTYMDAVNANLSGIKVKICGVLQYANIIGVAIGYTIAASISMLAIKRANCFHGNGHADPCKVSSVPYMIIFGVAQVFFSQIPDFDQISWLSMLAAAMSFTYSSIGLGLGIVQVIANGGMKGSMTGISIGTVTPMQKVWRSLQAFGDIAFAYSYSLILIEIQDTIRAPPPSESTVMKRATMVSVAVTTVFYMLCGCMGYAAFGDAAPGNLLTGFGFYEPFWLLDVANAAIVIHLVGAYQVYCQPLFAFVEKWAAKRWPESTFITGEVEVPLFRTYKVNLFRATWRTAFVVATTVVSMMLPSSTTWWGSWERWGSGRSPSSFPSRCTWCRRRCPSGARGGCACRCSASDASPSPLPPPPGPSPASSPTSRCTTRSSHNRRLTIMNKSRLRPVMFTLAG

SEQ ID NO: 5757 - protein, 469 aa, Avena sativa
MEVSAAELGDTALSKCFDDDGRNKRTGTMWTASSHIITAVIGSGVLSLGWAIAQLGWVAGPAVMILFSLVTYFTSSLLADCYRSGDQSTGKRNYTYMDAVNANLSGVKVKICGVLQYANIVGVAIGYTIAASISMLAIKRANCFHGKGHADPCKISSTPYMVIFGVAQVFFSQIPDFDQISWLSMLAAAMSFTYSSIGLGLGIVQVIANGGVKGSMTGISIGAVTPMQKVWRSTQAFGDIAFAYSYSLILIEIQDTIRAPPPSESTVMKRATGVSVAVTTVFYMLCGCMGYAAFGDAAPGNLLTGFGFYEPFWLLDVANAAIVVHLVGAYQVYCQPLFAFVEKWAAQRWPDSKFVTGEVEVPLLRTSYKVNMFRATWRTAFVVATTVVSMMLPFFNDVVGFLGALGFWPLTVYFPVEMYVVQKKVPKWSTKWVCLQILSLGCLAISLAAAAGSIAGIKSDLKVYHPFKT

SEQ ID NO: 5758 - protein, 463 aa, Triticum aestivum
AAELGHTAGSKVDDDGRNKRTGTMWTASSHIITAVIGSGVLSLGWAIAQLGWVAGPAVMLLFSLVTYFTSSLLADCYRSGDQSTGKRNYTYMDAVNANLSGVKVQICGVLQYANIVGVSIGYTIAASISMLAIKRANCFHGNGHADPCKVSSVPYMIIFGVAQVFFSQIPDFDQISWLSMLAAAMSFTYSSIGLGLGIVQVIANGGVKGSLTGISIGTVTPMQKVWRSTQAFGDIAFAYSYSLILIEIQDTIRAPPPSESTVMKRATMVSVAVTTVFYMLCGCMGYAAFGDAAPGNLLTGFGFYEPFWLLDVANAAIVVHLVGAYQVYCQPLFAFVEKWAAKRWPESTFVTGEVEVPLFRTYKVNMFRATWRTAFVVATTVVSMMLPFFNDVVGFLGALGFWPLTVYFPVEMYVVQKKVPKWSTQWVCLQMLSLGCLAISLAAAAGSIAGIKSDLKVYHPFKT

SEQ ID NO: 5759 - protein, 487 aa, Brachypodium distachyon
MGESVVATYYYPSAAMEVSAAELGQSKQPGSKGGCDDDDRPSRTGTMWTASSHIITAVIGSGVLSLGWAIAQLGWVAGPAVMLLFSLVTYFTSSLLADCYRSGDQSTGKRNYTYMDAVNANLSGFKVKVCGLLQYANIVGVAIGYTIAASISMLAISRANCFHRKGHADPCKISSVPYMLVFGVAQVFFSQIPDFDQISWLSMLAAAMSFTYSSIGLGLGVAQVIANGGVQGSMTGISIGAGVTPMQKVWRSTQAFGDIAFAYSYSLILIEIQDTIRAPPKSTESKVMKRATLVSVAVTTVFYMLCGCMGYAAFGDRAPGNLLTGFGFYEPFWLLDVANAAIVVHLVGAYQVYCQPLFAFVEKYAGQRWPESRYVTREIELSVGGFRVNMFRLTWRTAFVVATTVVSMMLPFFNDVVGFLGALGFWPLTVYFPVEMYIVQRKVPRWSTRWVCLQMLSGGCLVISLAAAAGSIAGIKSDLKVYHPFKS

SEQ ID NO: 5760 - protein, 469 aa, Avena sativa
MEVSAAELGDTALSKCFDDDGRNKRTGTMWTASSHIITAVIGSGVLSLGWAIAQLGWVAGPAVMILFSLVTYFTSSLLADCYRSGDQSTGKRNYTYMDAVNANLSGVKVKICGVLQYANIVGVAIGYTIAASISMLAIKRANCFHGKGHANPCKISSTPYMVIFGVAQVFFSQIPDFDQISWLSMLAAAMSFTYSSIGLGLGIVQVIANGGVKGSMTGISIGAVTPMQKVWRSTQAFGDIAFAYSYSLILIEIQDTIRAPPPSESTVMKRATGVSVAVTTVFYMLCGCMGYAAFGDAAPGNLLTGFGFYEPFWLLDVANAAIVVHLVGAYQVYCQPLFAFVEKWAAQRWPDSSFVTGEVEVPLLRTSYKVNMFRATWRTAFVVATTVVSMMLPFFNDVVGFLGALGFWPLTVYFPVEMYVVQKKVPKWSTKWVCLQILSLGCLAISLAAAAGSIAGIKSDLKVYHPFKT

SEQ ID NO: 5761 - protein, 469 aa, Avena sativa
MEVSAAELGDTALSKCFDDDGRNKRTGTMWTASSHIITAVIGSGVLSLGWAIAQLGWVAGPAVMILFSLVTYFTSSLLADCYRSGDQSTGKRNYTYMDAVNANLSGVKVKICGVLQYANIVGVAIGYTIAASISMLAIKRANCFHGKGHANPCKISSTPYMVIFGVAQVFFSQIPDFDQISWLSMLAAAMSFTYSSIGLGLGIVQVIANGGVKGSMTGISIGAVTPMQKVWRSTQAFGDIAFAYSYSLILIEIQDTIRAPPPSESTVMKRATGVSVAVTTVFYMLCGCMGYAAFGDAAPGNLLTGFGFYEPFWLLDVANAAIVVHLVGAYQVYCQPLFAFVEKWAAQRWPDSKFVTGEVEVPLFRTSCKVNMFRATWRTAFVVATTVVSMMLPFFNDVVGFLGALGFWPLTVYFPVEMYVVQKKVPKWSTKWVCLQILSLGCLAISLAAAAGSIAGIKSDLKVYHPFKT

SEQ ID NO: 5762 - protein, 206 aa, Secale cereale
MEVAAAELGHTAGSKLDDDGRNKRTGTMWTASSHIITAVIGSGVLSLGWAIAQLGWVAGPAVMLLFSLVTYFTSSLLADCYRSGDQSTGKRNYTYMDAVNANLSGIKVQICGVLQYANIVGVAIGYTIAASISMLAIKRPMFPRQRPRRPLQGLQRPLHDHLRRRSGLLLPDPRLRSDLLALHARRRHVLHLLLHRPRPRHRPSHS

SEQ ID NO: 5763 - protein, 220 aa, Brachypodium distachyon
MDAMAALARTSPTLAATGRRSSARLRPSASLSFAAASSRPRGRVGLSMPERSGRATRVARASPRRIVASSDVEQSYIMIKPDGVQRGLVGEIISRFEKKGFLLKGLKLFQCPKDLAQEHYKDLKERPFFPKLIDYITSGPVVCMAWEGDGVVASARKLIGSTNPLQAEPGTIRGDLAVQTGRNVVHGSDSPDNGKREIALWFKEGELAQWESVQTPWLVE

SEQ ID NO: 5764 - protein, 445 aa, Brachypodium distachyon
MTPSAMNMTKEQKEQQDIDDWLPITSSRKAKWWYSAFHNVTALVGAGVLSLPYAMSELGWGPGVAAMILSWVITLYTLWQMVEMHECVPGKRFDRYHELGQHAFGQKLGLWIVVPQQLIVEVGVCIVYMVTGGKSLKKFHDVVAPADAAPIRTSYFIVIFGSAHLLLSQLPNFNSITVVSLAAAVMSLSYSTIAWVASLEHRRHGGSSHVVDYSMTASTSAGRTFNFLSALGDVAFAYAGHNVVLEIQATIPSTPGKPSKKPMWLGVMVAYLVVAVCYLPVAFVGYYVFGNAVDDNILITLEKPRWLIAAANMFVVVHVIGSYQIYAMPVFDMLETFLVKKLRFHPGWPLRLIARSLYVVFTMIVGIAIPFFGGLLGFFGGFAFAPTTYFLPCIMWLIIMKPKKFGFSWCTNWICIIIGVLLSLLAPIGGLRSIIINAKTYKFFS

SEQ ID NO: 5765 - protein, 443 aa, Hordeum vulgare
MNTSKAAPTEKELQDIDDWLPITSSRSAKWWYSAFHNVTAMVGAGVLSLPYAMSELGWGPGVAAMILSWVITLYTLWQMVEMHECVPGKRFDRYHELGQHAFGEKLGLWIVVPQQLVVEVGVCIVYMVTGGKSLKKVHDLLRPEHSHPIRTSYFICIFGSAHFLLSQLPNFNSITGVSLAAAVMSLSYSTIAWAASLHHAGKAGPDHAVDYSMTASTSTGRTFNFLSALGDVAFAYAGHNVVLEIQATIPSTPEKPSKKPMWRGVVLAYIVVAICYLPVAFLGYYVFGNAVDDNILITLEKPRWLIAAANLFVVVHVIGSYQIYAMPVFDMLETFLVKKLRFKPGWPLRLIARSLYVAFTMLVGIAIPFFGGLLGFFGGFAFAPTTYFLPCIMWLAIKKPARFSMSWCINWVCIIIGVLLSILAPIGGLRSIIVNYKTYQFFS

SEQ ID NO: 5766 - protein, 438 aa, Zea mays
MATPSSMTSTEKEKAIDDWLPITSSRNAKWWYSAFHNVTAMVGAGVLSLPYAMSELGWGPGVVAMVLSWVITLYTLWQMVEMHECVPGKRFDRYHELGQHAFGDKLGLWIVVPQQLIVEIGVCIVYMVTGGKSFEKCYTVACPDCKPLRTSSWIMIFAAIHLLLSQLPNFNSITLVSLAAAVMSLTYSTIAWAASAHKGRHSAVDYSMKASTTTGQTFNFLSALGDVAFAYAGHNVVLEIQATIPSTPDKPSKKPMWQGVVLAYLVVAICYLPVAFVGYYVFGNAVDDNILITLEKPRWLIAAANIFVVVHVIGSYQIYAMPVFDMLETFLVKKLRFKPGMPLRLIARSLYVVLTALVGIAVPFFGGLLGFFGGFAFAPTTYYLPCILWLKIKKPKKFSLSWFINWFCIIVGVLLTVLAPIGGLRSIVVNASTYKFFS

SEQ ID NO: 5767 - protein, 446 aa, Brachypodium distachyon
MAPSAMNMTKEQKDQQDIDDWLPITSSRKAKWCYSAFHNVTAMVGAGVLSLPYAMSELGWGGGDDPVMGDNPVHAMADGGDARVRPREAVRLVPRAGAAHLRAEAGPVDRRPAAAHCGSRRLHHVHGDGRQVAEEVPRRGGAGRRRPDPDQLLHRHLRVRPPAALPASQLQLHHRRLPRRRRHVALLLHHRLAWVASLEHRHHGGGSSHVVDYSMTASTSAGRMFNFLSALGDVAFAYAGHNVVLEIQAMIPSTPDKPSKKPMWLGVMVTYLVVAVCYLPVAFVGYYVFGNAVDDNILITLEKPRWLIAAANMFVVVHVIGSYQIYAMPVFDMLETFLVKKLRFPLAGLSVSSPAPSTLVMFTMIVGIAIPFFGGLLGFFGGFAFSPTTYFLPCIMWLIIMKPKKFGFSWCTNWICITIGVLLSVMAPIGGLRSIIINAKTYKFFS

SEQ ID NO: 5768 - protein, 437 aa, Brachypodium distachyon
MAPSAMNMTKEQKDQQDIDDWLPITSSRKAKWCYSAFHNVTAMVGAGVLSLPYAMSELGWYGPGVAAMILSWVITLYTLWQMVEMHECVPGKRFDWYHELGQHTFGQKLGLWIVVPQQLIVEVGVCIMCMVTGGKSLKKFHDVVAPADAAPIRTSYFIVIFGSAHLLLSQLPNFNSITVVSLAAAVMSLSYSTIAWPGSHVVDYSMTASTSAGRMFNFLSALGDVAFAYAGHNVVLEIQAMIPSTPDKPSKKPMWLGVMVTYLVVAVCYLPVAFVGYYVFGNAVDDNILITLEKPRWLIAAANMFVVVHVIGSYQIYAMPVFDMLETFLVKKLRFPLAGLSVSSPAPSTLVMFTMIVGIAIPFFGGLLGFFGGFAFSPTTYFLPCIMWLIIMKPKKFGFSWCTNWICITIGVLLSVMAPIGGLRSIIINAKTYKFFS

SEQ ID NO: 5769 - protein, 444 aa, Panicum virgatum
MAAPSAMSSTAAGSKEQQKQDIDDWLPITSSRNAKWWYSAFHNVTAMVGAGVLSLPYAMSELGWGPGVVAMLLSWVITLYTLWQMVEMHECVPGKRFDRYHELGQHAFGDKLGLWIVVPQQLIVEVGVCIVYMVTGGKSLEKCYTVACPDCDPLRTSSWIMIFAAVHLLLSQLPNFNSITLVSLAAAVMSLSYSTIAWAASAHKGRQPDVDYSKTASTATGQTFNFLSALGDVAFAYAGHNVVLEIQATIPSTPEKPSKKPMWQGVVLAYIVVAICYLPVAFVGYYVFGNAVDDNILITLEKPRWLIAMANIFVVVHVIGSYQIYAMPVFDMLETFLVKKLRFRPGLPLRLIARSLYVVFTALVGIAVPFFGGLLGFFGGFAFAPTTYYLPCILWLKIKKPKTFSFSWFANWFCIIIGVLLTVFAPIGGLRSIIVNASTYKFFS

SEQ ID NO: 5770 - protein, 441 aa, Panicum virgatum
MAQSAMSSATGKEQQEQAIDDWLPITSSRNAKWWYSAFHNVTAMVGAGVLSLPYAMSELGWGPGVAAMLLSWVITLYTLWQMVEMHECVPGKRFDRYHELGQHAFGDKLGLWIVVPQQLIVEVGVCIVYMVTGGKSFEKCYTVACPDCQPLRTSSWIMIFAAIHLLLSQLPNFNSITLVSLAAAVMSLSYSTIAWAASAHKGRQPDVDYSKTASTATGQTFNFLSALGDVAFAYAGHNVVLEIQATIPSTPDKPSSKPMWQGVILAYLVVAICYLPVAFVGYYVFGNAVDDNILITLEKPRWLIAMANIFVVVHVIGSYQIYAMPVFDMLETFLVKKLRFRPGLPLRLIARSLYVVFTALVGIAVPFFGGLLGFFGGFAFAPTTYYLPCILWLKIKKPKTFSISWFANWFCIIIGVLLTVFAPIGGLRSIIVNASTYKFFS

SEQ ID NO: 5771 - protein, 404 aa, Zea mays
MSALGTLSGGAAGVSGLLRLRRRVAPALAAPSHHAAGTLNCAALPDAAPLVWGRQLRPSLLLPATLLPSSSQGARRHTPRRPAAAAGEAKSVGFLEKYPALVTGFFFFMWYFLNVIFNILNKKIYNYFPYPYFVSLIHLVVGVVYCLISWSVGLPKRAPINGTLLKLLFPVALCHGIGHITSNVSFAAVAVSFAHTIKALEPFFSAAATQFILGQQVPFSLWLSLAPVVIGVSMASLTELSFNWTGFINAMISNISFTYRSIYSKKAMTDMDSTNVYAYISIIALIVCIPPAVIFEGPRLMQHGFSDAIAKVGLTKFVSDLFLVGLFYHLYNQIATNTLERVAPLTHAVGNVLKRVFVIGFSIVVFGNKISTQTGIGTSIAIAGVAMYSYIKAKIEEEKRKKSA

SEQ ID NO: 5772 - protein, 402 aa, Panicum virgatum
MSALGALSGGAAGVAGLLSLRRRAAPPPSGLATPAHLPPLKCAVLPDAGQLVWGRQLRPALLPAALLPPQPARRHALCPPAAAAGEAKPAGFLDKYPALVTGFFFFMWYFLNVIFNILNKKIYNYFPYPYFVSLIHLVVGVVYCLISWSVGLPKRAPINSNLLKLLFPVALCHALGHVTSNVSFAAVAVSFAHTIKALEPFFNAAATQFVLGQQVPLSLWLSLAPVVIGVSMASLTELSFNWTGFINAMISNISFTYRSIYSKKAMTDMDSTNVYAYISIISLLVCIPPALIFEGPQLMQHGFSDAIAKVGLQKFVTDLFLVGLFYHLYNQLATNTLERVAPLTHAVGNVLKRVFVIGFSIIVFGNRITTQTGIGTCIAIAGVAMYSYIKARIEEEKRKKSA

SEQ ID NO: 5773 - protein, 410 aa, Echinochloa colona
MSALGTLSGGAAGLAGLLRLRHHASKPAPSALASSSPHLPPLKCAAVPDAGQLVWGRQLRPALLPAALHHPAQLARKRADTLRPPAAAAGSAEEAKPVGFLQKYPALVTGFFFFMWYFLNVIFNILNKKIYNYFPYPYFVSVIHLLVGSVYCLIGWSVGFPKRAPINGTLLKLLFPVALCHGIGHITSNVSFAAVAVSFAHTIKALEPFFNAAATQFILGQQVPFALWMSLAPVVIGVSMASLTELSFNWTGFINAMIANLSFTYRSIYSKKAMTDMDSTNVYAYISIISLIVCIPPALIMEGPQLMQHGFSDAIAKVGLQKFVSDLLLVGLFYHLYNQIATNTLERVAPLTHAVGNVLKRVFVIGFSIIVFGNRISTQTGIGTSIAIGGVAIYSYIKAKIEEEKRKKSA

SEQ ID NO: 5774 - protein, 407 aa, Echinochloa colona
MSALGSLSGGAAGLAGLLRLRHHSSSPAPSALASSSPHLPPLKCAAVPDAGQLVWGRQLRPALLPAALHHPTQLARKRDTLRPPAAASAGEAKPAGFLQKYPALVTGFFFFTWYFLNVIFNILNKKIYNYFPYPYFVSVVHLLVGSVYCLIGWSVGFPKRAPINGTLLKLLFPVALCHGIGHITSNVSFAAVAVSFAHTIKALEPFFNAAATQFILGQQVPFALWMSLAPVVIGVSMASLTELSFNWTGFINAMIANLSFTYRSIYSKKAMTDMDSTNVYAYISIISLIVCIPPALIMEGPQLMQHGFSDAIAKVGLQKFVSDLLLVGLFYHLYNQIATNTLERVAPLTHAVGNVLKRVFVIGFSIIVFGNRISTQTGIGTSIAIGGVAIYSYIKAKIEEEKRKKSA

SEQ ID NO: 5775 - protein, 405 aa, Setaria italica
MSALGALSGGAAGVAGLLSLRRRAAAPPPPSALASSSHLPPLKCAAVPDAGHLVWGRQLRPALALLPFPSQAARKQTPRPPAAASAGEAKPAGFLSKYPALVTGFFFFMWYFLNVIFNILNKKIYNYFPYPYFVSAIHLLVGVVYCLISWSLGLPKRAPVNANLLKLLFPVALCHALGHVTSNVSFAAVAVSFAHTIKALEPFFNAAATQFILGQQVPLSLWLSLAPVVIGVSMASLTELSFNWTGFINAMISNISFTYRSIYSKKAMTDMDSTNVYAYISIISLIVCIPPALMFEGPKLMQHGFNDAIAKVGLQKFVTDLFLVGLFYHLYNQVATNTLERVAPLTHAVGNVLKRVFVIGFSIIVFGNRITTQTGIGTSIAIAGVAMYSYIKAKIEEEKRKKKSA

SEQ ID NO: 5776 - protein, 417 aa, Oryza sativa
MPALGTLSGGAAGVAGLLRLRRATPSPAVATPFPAAAAARCAAAAAAVVPDGGQLVWGRQLRPALLLPAAGGLLQPPTSPSSSQAGRRQALRPPAAATSGEAKPAGFLEKYPALITGFFFFMWYFLNVIFNILNKKIYNYFPYPYFVSVIHLLVGVVYCLVSWTVGLPKRAPINSTLLKLLFPVALCHALGHVTSNVSFATVAVSFAHTIKALEPFFNAAATQFVLGQQVPLPLWLSLAPVVLGVSMASLTELSFNWTGFINAMISNISFTYRSIYSKKAMTDMDSTNVYAYISIIALIVCIPPAVIIEGPQLLQHGFNDAIAKVGLTKFVSDLFFVGLFYHLYNQVATNTLERVAPLTHAVGNVLKRVFVIGFSIIVFGNRITTQTGIGTCIAIAGVAIYSYIKAKIEEEKRAKSA

SEQ ID NO: 5777 - protein, 402 aa, Triticum aestivum
MPALGTLSAGGAAAGVAGLLRLRRGPALASPLPAAARAGAVHDGAQLVWGRQLRPALVLPAGLLPLQASKRLTLRPPAASAEPAGEAKSPGLLEKYPAITTGFFFFMWYFLNVIFNILNKKIYNYFPYPYFVSVIHLLVGVVYCLLSWAVGLPKRAPINATLLKLLFPVALCHALGHVTSNVSFATVAVSFAHTIKALEPFFNAAATQFVLGQTVPLSLWLSLAPVVLGVSMASLTELSFSWKGFINAMISNISFTYRSIYSKKAMTDMDSTNVYAYISIIALVVCIPPALIIEGPQLMQYGLNDAIAKVGMTKFVSDLFLVGLFYHLYNQIATNTLERVAPLTHAVGNVLKRVFVIGFSIIIFGNKITTQTGIGTCVAIAGVALYSYIKAKIEEEKRAKAA

SEQ ID NO: 5778 - protein, 404 aa, Avena sativa
MPALGTLSTGGAAAGVAGLLRLRRGPAVASPLPAAARAGAVHDGGQLVWGRQLRPVLLLPAGLLPSQASKRLPLRPPAASASSEPAGDAKAPGILEKYPAITTGFFFFMWYFLNVIFNILNKKIYNYFPYPYFVSVIHLLVGVVYCLISWAVGLPKRAPINSTLLKLLFPVALCHALGHVTSNVSFATVAVSFAHTIKALEPFFNAAATQFVLGQTVPLSLWLSLAPVVLGVSMASLTELSFNWKGFINAMISNISFTYRSIYSKKAMTDMDSTNVYAYISIIALIVCIPPAIIIEGPQLMQSGLNDAIAKVGLTKFISDLFLVGLFYHLYNQLATNTLERVAPLTHAVGNVLKRVFVIGFSIIIFGNRITTQTGIGTCVAIAGVAIYSYIKAKIEEEKRAKSA

SEQ ID NO: 5779 - protein, 409 aa, Festuca arundinacea
ARGLLQQCRRSGRSPPAARPPASRACSASAAAPPSPRRCRPPRAPARCTTAASSSGAGSSAPTSSSPPACSRARPPRGCRSARPPPPSEPAGEAKSVGLLEKYPAITTGFFFFMWYFLNVIFNILNKKIYNYFPYPYFVSVIHLLVGVVYCLISWAVGLPKRAPINSTLLKLLFPVALCHALGHVTSNVSFATVAVSFAHTIKALEPFFNAAATQFVLGQTVPLSLWLSLAPVVLGVSMASLTELSFNWKGFINAMISNISFTYRSIYSKKAMTDMDSTNVYAYISIIALIVCIPPAVIIEGPQLMQYGLNDAIAKVGLTKFVSDLFLVGLFYHLYNQLATNTLERVAPLTHAVGNVLKRVFVIGFSIIIFGNKITTQTGIGTVVAIAGVATYSYIKAKIEEEKRAKSA

SEQ ID NO: 5780 - protein, 403 aa, Lolium multiflorum
MPALGTLSAGGATAGVAGLLRLRRGPAVASPLPAAARAGAVHDGGQLVWGRQLRPNLLLPAGLRPSHVSKRLPLRPPAASASDPAGDTKSVGLLEKYPAITTGFFFFMWYFLNVIFNILNKKIYNYFPYPYFVSVIHLLVGVVYCLISWAVGLPKRAPINSTLLKLLFPVALCHALGHVTSNVSFATVAVSFAHTIKALEPFFNAAATQFVLGQTVPLSLWLSLAPVVLGVSMASLTELSFNWKGFINAMISNISFTYRSIYSKKAMTDMDSTNVYAYISIIALIVCIPPAVIIEGPQLMQYGLNDAIAKVGMTKFVSDLFLVGLFYHLYNQLATNTLERVAPLTHAVGNVLKRVFVIGFSIIIFGNKITTQTGIGTVVAIAGVATYSYIKAKIEEEKRAKSA

SEQ ID NO: 5781 - protein, 566 aa, Setaria italica
MGAAGCAVPLAASHCRRLQLLMLALALVPLGGRGFRVRAVGADTGGLSRDAFPKGFVFGTATSAFQVEGAASTNGRGPSIWDPFVHTPGKIAGDANADVTTDEYHRYKEDVDLMKSLNFDAYRFSISWSRIFPDGEGKVNEEGVQYYNNLIDHMLKQGLTPYANLNHYDLPLALQKKYKGWLGPKIVDIFADYADFCFKTFGDRVKNWFTLNEPRIVSFLGYDKGLNPPNRCTQCAAGGNSATEPYIVVHNILLSHATAVARYRNKYQATQKGKVGIVLDFNWYEPLTNSTADQAAAQRARDFHVGWFMDPLINGQYPKTMQDIVKDRLPSFTPEQAKLVKGSSDCFGINQYTTYYISDEQTPQQATPSYSSDWGVQYNFERNGLPIGQLANSVWLYIVPTGMYGVVNYLKEKYQNPTIIISENGMDQSGNLTRDEYLHDTVRVEFYKNYLTELKKGIDEGANVVAYFAWSLLDNFEWLSGYTSKFGIVYVDFTTLKRYPKDSAYWFRDMLSGAGSKAATPQTGSQSSAGSPAGSAPAASSGPALLVSLLVSLCLLVPSVFMVSSA

SEQ ID NO: 5782 - protein, 564 aa, Panicum virgatum
MGAAGSAAPPAAAAHCRRVLLALALVSLCGRGLRVRAAGADTGGLSRDAFPKGFVFGTATSAFQVEGAAASGGRGASIWDPFVHTPGNIAGDANADVATDEYHRYKEDVDLMKSLNFDAYRFSISWSRIFPDGEGKVNEEGVQYYNNLIDYMIKQGLTPYVNLNHYDLPLALQKKYKGWLGPKIVDIFADYADFCFKTFGDRVKNWFTLNEPRIVAFLGYDTGADPPNRCTQCAAGGNSATEPYIVAHNIILSHATAVARYRNKYQATQKGKVGIVLDFNWYEPLTNSTEDQAAAQRARDFHVGWFLDPLINGQYPKTMQDIVKDRLPSFTPEQAKLVKGSSDYFGINQYTTYYISDKQTPQQAATSYSSDWSVQYNFQRNGVPIGQLAHSVWLYIVPTGMSGVVNYLKEKYQNPTIIISENGMDQPGNLTREEYLHDTVRVDFYRNYLTELKKGIDGGANVVAYFAWSLLDNFEWLSGYTSKFGIVYVDFTTLKRYPKDSAYWFRDMLSGAGSKSATPQTGSDTSAGSPAGSAPAASSGPALLVSLLVSLFVLVPSAFIVSSA

SEQ ID NO: 5783 - protein, 563 aa, Panicum virgatum
MGAAGSAAPPPAAAHCHRALLALALVSLCGRGLRVRAAGADTGSLSRDAFPKGFVFGTATSAFQVEGAAASGGRGPSIWDPLVHTPGNIAGDANADVTTDEYHRYKEDVDLMKSLNFDAYRFSISWSRIFPDGEGKVNEEGVQYYNNLIDYMIKQGLTPYANLNHYDLPLALQKKYKGWLGPKIVGIFADYADFCFKTFGDRVKNWFTLNEPRIVAFLGYDTGVNPPNRCTQCAAGGNSATEPYIVVHNIILSHATAVARYRNKYQATQKGKVGIVLDFNWYEPLTNSTEDQAAAQRARDFHVGWFLDPLINGNYPKTMQDIVKDRLPSFTPEQAKLVKGSSDYYGINQYTTYYISDKQTPQQAATSYSSDWSVQYNFQRNGVPIGQLAHSVWLYIVPTGMYGVVNYLKEKYQNPTIIISENGMDQPGNLTREEYLHDTVRVDFYKNYLTELKKGIDEGANVVAYFAWSLLDNFEWLSGYTSKFGIVYVDFTTLKRYPKDSAYWFRDMLSGAGSKSATPQTGSHTSAGSPAGSTPAASCGPALLVSLLVSLCLLVPSVFIVSS

SEQ ID NO: 5784 - protein, 413 aa, Pennisetum glaucum
MVKQGLTPYANLNHYDLPLALEKKYKGWLGPKIVDKFADYADFCFKTFGDRVKNWFTLNEPRIVSFLGYDKGLNPPNRCTQCAAGGNSATEPYTVVHNILLSHATAVARYRNKYQATQKGKVGIVLDFNWYEPLTNSTADQAAAQRARDFHVGWFMDPLINGQYPKTMQDIVKDRLPSFTPEQAKLVKGSSDCFGINQYTTYYISDQQTPQQGTPSYSSDWGVQYNFERNGQPIGQLANSGWLYIVPTGMYGVVNYLKEKYQNPTIIISENGMDQSGNLTRDEYLHDTVRVEFYKNYLTELKKGIDDGANVVAYFAWSLLDNFEWLSGYTSKFGIVYVDFTTLKRYPKDSAYWFRDMLSGAGSKAATPQTGSQSSAASPAGSAPAASSGAALLVSLLVSLCLLVPPVFMVSLA

SEQ ID NO: 5785 - protein, 559 aa, Echinochloa colona
MGAAGCAAHCRRLRQLVLALALVALGVGGGHGVRVRAAGVDTGGLSRDAFPKGFVFGTATSAFQVEGAAASGGRGPSIWDPFVHTPGKIAGDANADVTTDEYHRYKEDVDLMKSLNFDAYRFSISWSRIFPDGEGKVNEEGVQYYNNLIDYMIKQGLTPYANLNHYDIPLALQKKYKGWLGPKIVDIFADYADFCFKTFGDRVKNWFTLNEPRIVSFLGYDKGINPPNGAPNVLLVRLSNRTFIVVHNILLSHATAVARYRNKYQATQKGKVGIVLDFNWYEPLTNSTEDQAAAQRARDFHVGWFMDPLVNGQYPKTMQDIVKDRLPSFTPEQSKLVKGSSDCFGINQYTTYYISDQQTPQQAGTSYSSDWGVQYIFQRNGVPIGQLANSVWLYIVPTGMYGVVNYLKEKYQNPTIIISENGMDQSGNLTRDEYVHDTVRVEFYKNYLTELKKGIDDGANVVAYFAWSLLDNFEWLSGYTSKFGIVYVDFTTLKRYPKDSAYWFRDMLSGAGSKAATPLSPASGSLTSAPTASSAPVLLVSLLVSLWFLVPSVFMVSSP

SEQ ID NO: 5786 - protein, 343 aa, Saccharum officinarum
MDHAADAHRTDLMTITRHVLNEQSRNPESRGDFTILLSHIVLGCKFVASAVNKAGLAQLIGLAGETNVQGEEQKKLDVLSNEVFVKALVSSGRTCVLVSEEDEEATFVDPKLRGKYCVCFDPLDGSSNIDCGVSIGTIFGIYMIKDKDNVTLSDVLQPGKDMLAAGYCMYGSSCTLVLSTGTGVNGFTLDPSLGEFILTHPDIKIPKKGKIYSVNEGNAKNWDVPVAKFVEKCKYPKDGSPPKSLRYIGSMVADVHRTLLYGGVFLYPADQKSPNGKLRVLYEVFPMSFLMEQAGGQSFTGKERALDLVPTKIHERSPIFLGSYDDVEEIKALYAEQAKSSSA

SEQ ID NO: 5787 - protein, 345 aa, Zea mays
MDHAADAHRTDLMTITRHVLNEQSRNPESRGDFTILLSHIVLGCKFVASAVNKAGLAQLIGLAGETNVQGEEQKKLDVLSNEVFVKALVSSGRTCVLVSEEDEEATFVDPKLRGRYCVCFDPLDGSSNIDCGVSIGTIFGIYIIKDKDNVTLEDVLQPGKNMLAAGYCMYGSSCTLVLSTGTGVNGFTLDPSLGEFILTHPDIKIPKKGKIYSVNEGNAKNWDAPVAKFVEKCKYPKDGSPPRSLRYIGSMVADVHRTLLYGGVFLYPADEKNPNGKLRILYEVFPMSFLMEQAGGQSFTGKERALDLIPTKIHDRSPIFLGSYDDVEEIKALYAEQAKSSSASS

SEQ ID NO: 5788 - protein, 343 aa, Pennisetum glaucum
MDHAADAHRTDLMTITRHVLNEQSRYPESRGDFTILLSHIVLGCKFVASAVNKAGLAKLIGLAGETNVQGEEQKKLDVLSNEVFVKALVSSGRTCVLVSEEDEEATFVDPQLRGKYCVCFDPLDGSSNIDCGVSIGTIFGIYMIKDKDNVTLEDVLQPGKDMLAAGYCMYGSSCTLVLSTGSGVNGFTLDPSLGEFILTHPDIKMPKKGKIYSVNEGNARNWDAPTAKFVEKCKYPKDGSSPKSLRYIGSMVADVHRTLLYGGVFLYPADEKNPNGKLRVLYEVFPMSFLIEQAGGQSFTGKERALDLVPTKIHDRSPIFLGSYDDVEEIKALYAQQAKSSSA

SEQ ID NO: 5789 - protein, 343 aa, Panicum virgatum
MDHTADAHRTDLMTITRHVLNEQSRNPESRGDFTILLSHIVLGCKFVASAVNKAGLAKLIGLAGETNVQGEEQKKLDVLSNEVFVKALVSSGRTCILVSEEDEEATFVDPALRGKYCVCFDPLDGSSNIDCGVSIGTIFGIYMIKDKDNVTLEDVLQPGTNMLAAGYCMYGSSCTLVLSTGSGVNGFTLDPSLGEFILTHPDIKIPKKGKIYSVNEGNAKNWDAAVAKFVEKCKYPKDGSPPKSLRYIGSMVADVHRTLLYGGVFLYPADKKSPNGKLRVLYEVFPMSFLMEQAGGQSFTGKERALDLVPTKIHERSPVFLGSYDDVEEIKALYAELAKTSSA

SEQ ID NO: 5790 - protein, 343 aa, Panicum virgatum
MDHTAEAHQTDLMTITRHVLNEQSRNPESRGDFTILLSHIVLGCKFVASAVNKAGLAKLIGLAGETNVQGEEQKKLDVLSNEVFVKALVSSGRTCVLVSEEDEEATFVDPALRGKYCVCFDPLDGSSNIDCGVSIGTIFGIYMIKDKDNVTLEDVLQPGTNMLAAGYCMYGSSCTLVLSTGSGVNGFTLDPSLGEFILTHPDIKIPKKGKIYSVNEGNAKNWDAAVAKFVEKCKYPKDGSPPKSLRYIGSMVADVHRTLLYGGVFLYPADKKSPNGKLRVLYEVFPMSFLMEQAGGQSFTGKERALDLVPTTIHERSPVFLGSYDDVEEIKALYAELAKTSSA

SEQ ID NO: 5791 - protein, 343 aa, Echinochloa colona
MDYAADAHQTDLMTLTRHVLNEQSRYPESRGDFTILLSHIVLGCKFVASAVNKAGLAKLIGLAGETNVQGEEQKKLDVLSNEVFVKALVSSGRTCVLVSEEDEEATFVDPKLRGKYCVCFDPLDGSSNIDCGVSIGTIFGIYMIKDKDNVTLEDVLQPGKDMLAAGYCMYGSSCTLVLSSGSGVNGFTLDPSLGEFILTHPDIKIPKKGKIYSVNEGNAKNWDAPTAKFVEKCKYPEDGSSPKSLRYIGSMVADVHRTLLYGGVFLYPADEKNPNGKLRVLYEVFPMSFLMEQAGGQAFTGKERALDLVPTKIHERSPIFLGSYDDVEEIKTLYAKLAKSGSA

SEQ ID NO: 5792 - protein, 343 aa, Setaria italica
MDHEADAHRTDLMTITRHVLNEQSRYPESRGDFTILLSHIVLGCKFVASAVSKAGLAHLIGLAGETNVQGEEQKKLDVLSNEVFVKALVSSGRTCVLVSEEDEEATFVDPKLRGKYCVCFDPLDGSSNIDCGVSIGTIFGIYMIKDKDNVTLEDVLQPGKDMLAAGYCMYGSSCMLVLSTGSGINGFTLDPSLGEFILTHPDIKMPKKGKIYSVNEGNARNWDAPTAKFVEKCKYPTDGSSPRSLRYIGSMVADVHRTLLYGGVFLYPADEKNPNGKLRVLYEVFPMSFLMEQAGGQSFTGKERALDLVPTKIHERSPVFLGSYDDVEEIKALYAEQAKSSSA

SEQ ID NO: 5793 - protein, 343 aa, Eragrostis curvula
MDHAAEAHQTDLMTLTRHVLNEQSRNPESRGDFTILISHIVLGCKFVASAVNKAGLAKLIGLAGETNIQGEEQKKLDVLSNELFLQALVSSGRTCILVSEEDDEATFVDPALRGNYCVCFDPLDGSSNIDCGVSIGTIFGIYMVKDKDNVTLNDVLQPGKNMLAAGYCMYGSSCTLVLSTGNGVNGFTLDPSLGEFILTHPNIKIPKKGKIYSVNEGNAKNWDEPTAKFVEKCKYPKDGSPPRSLRYIGSMVADIHRTLLYGGVFLYPADQKSPNGKLRVLYEVFPMSFLMEEAGGQSFTGKERALDLVPTKIHERSPIVLGSYDDVEEIKALYAEQAKSSSG

SEQ ID NO: 5794 - protein, 339 aa, Oryza sativa
MDHEADAYRTDLMTITRYVLNEQSRNPEARGDLTILLSHIVLGCKFVASAVNKAGLAKLIGLAGETNVQGEEQKKLDVLSNEVFVKALVSSGRTCVLVSEEDEEATFVDPALRGKYCVCFDPLDGSSNIDCGVSIGTIFGIYMIKDKENVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQAGGQSFTGKERALDLVPTKIHERSPIFLGSFEDVEEIKGLYAAQAK

SEQ ID NO: 5795 - protein, 341 aa, Sorghum bicolor
MDHAAEAQRTDLMTITRHVLNEQSRHPESRGDFTILLSHIVLGCKFVASAVNKAGLAKLIGLAGETNVQGEEQKKLDVLSNEVFVKALVSSGRTCVLVSEENEEAIFVDPALRGKYCVCFDPLDGSSNIDCGVSIGTIFGIYMIKDKDNVTLEDVLQPGTNMLAAGYCMYGSSCTLVLSTGNGVNGFTLDPSLGEFILTHPNIKIPKKGKIYSVNEGNAKNWDGPTAKFVEKCKYPQDGSPPKSLRYIGSMVADVHRTLLYGGIFLYPADQKSPNGKLRVLYEVFPMSFLMEQAGGQSFTGKQRALQLAPAKLHDRSPIFLGSYDDVEEIKALYASESNNA

SEQ ID NO: 5796 - protein, 341 aa, Echinochloa colona
MDHAAEAQRTDLMTITRHVLNEQSRHPESRGDFTILLSHIVLGCKFVASAVNKAGLAKLIGLAGETNVQGEEQKKLDVLSNEVFVKALVSSGRTCVLVSEENEEAIFVDPALRGKYCVCFDPLDGSSNIDCGVSIGTIFGIYMIKDKDNVTLDDVLQPGTDMLAAGYCMYGSSCTLGLSTGNGVNGFTLDPSLGEFILTHPNIKMPKKGKIYSVNEGNAKNWDVPTAKYVEKCKFPQDGSSPKSLRYIGSMVADVHRTLLYGGIFLYPADQKSPNGKLRVLYEVFPMSFLMEQAGGQAFTGKQRALELAPTKIHDRSPIFLGSYDDVEEIKALYASESSTV

SEQ ID NO: 5797 - protein, 343 aa, Brachypodium distachyon
MDHAADAHRTDLMTITRHVLNEQSKYPESRGDLTILLSHIVLGCKFVASAVNKAGLAKLTGLAGETNVQGEEQKKLDVLSNEVFVNALVSSGRTCVLVSEEDEEATFVAPALRGKYCVCFDPLDGSSNIDCGVSIGTIFGIYMIKNQDTVTLEEVLQPGKDMIAAGYCMYGSSCTLVLSTGNGVNGFTLDPSLGEFIMTHPDIKIPPKGKIYSVNEGNAKNWDTPTAKYVEKCKFPTDGSSPKSLRYIGSMVADVHRTLLYGGIFLYPADKKSPNGKLRVMYEVFPMSFLMEQAGGQSFTGKERALDLIPTKIHERSPIFLGSSDDVEEIKALYAEQAKATSA

SEQ ID NO: 5798 - protein, 341 aa, Panicum virgatum
MDHAAEAQRTDLMTITRHVLNEQGRHPESRGDFTILLSHIVLGCKFVASAVNKAGLAKLVGLAGETNVQGEEQKKLDVLSNEVFVKALVSSGRTCVLVSEENEEAIFVDPALRGKYCVCFDPLDGSSNIDCGVSIGTIFGIYMIKDKDNVTLGDVLQPGTNMLAAGYCMYGSSCTLVLSTGNGVNGFTLDPSLGEFILTHPNIKIPKKGKIYSVNEGNAKNWDVPTEKYVEKCKFPQDGSSPKSLRYIGSMVADVHRTLLYGGIFLYPADQKSPNGKLRVLYEVFPMSFLMEQAGGQAFTGKQRALELAPTKLHDRSPIFLGSYDDVEEIKALYASESSTA

SEQ ID NO: 5799 - protein, 341 aa, Panicum virgatum
MDHAAEAQRTDLMTITRHVLNEQGRHPESRGDFTILLSHIVLGCKFVASAVNKAGLAKLVGLAGETNVQGEEQKKLDVLSNEVFVKALVSSGRTCVLVSEENEEAIFVDPQLRGKYCVCFDPLDGSSNIDCGVSIGTIFGIYMIKDKDNVTLGDVLQPGTNMLAAGYCMYGSSCTLVLSTGNGVNGFTLDPSLGEFILTHPNIKIPKKGKIYSVNEGNAKNWDVPTAKYVEKCKFPQDGSSPKSLRYIGSMVADVHRTLLYGGIFLYPADQKSPNGKLRVLYEVFPMSFLMEQAGGQAFTGKQRALELAPTKLHDRSPIFLGSYDEVEEIKALYASESSAV

SEQ ID NO: 5800 - protein, 341 aa, Echinochloa colona
MDHAAEAQRTDLMTITRHVLNEQSRHPESRGDFTILLSHIVLGCKFVASAVNKAGLAKLIGLAGETNVQGEEQKKLDVLSNEVFVKALVSSGRTCVLVSEENEEAIFVDPALRGKYCVCFDPLDGSSNIDCGVSIGTIFGIYMIKDKDNVTLDDVLQPGTNMLAAGYCMYGSSCTLVLSTGNGVNGFTLDPSLGEFILTHPNIKMPKKGKIYSVNEGNAKNWDAPTAKYVEKCKFPQDGSSPKSLRYIGSMVADVHRTLLYGGIFLYPADQKSPNGKLRVLYEVFPMSFLMEQAGGQAFTGKQRALELAPTKLHDRSPIFLGSYDDVEEIKALYASESSTV

SEQ ID NO: 5801 - protein, 341 aa, Zea mays
MDHAAEAQRTDLMTITRHVLNEQSRHPESRGDFTILLSHIVLGCKFVAAAVNKAGLAKLIGLAGETNVQGEEQKKLDVLSNEVFVKALVSSGRTCVLVSEENEEAIFVDPALRGKYCVCFDPLDGSSNIDCGVSIGTIFGIYMVKDKDNVTLEDVLQPGTNMLAAGYCMYGSSCTLVLSTGNGVNGFTLDPSLGEFILTHPNIKIPRKGKIYSVNEGNAKNWDGPTAKFVEKCKYPEDGSPPRSLRYIGSMVADVHRTLLYGGIFLYPADQKSPNGKLRVLYEVFPMSFLMEQAGGQAFTGKQRALELAPAKLHDRSPVFLGSYDDVEEIKALYASMSNSG

SEQ ID NO: 5802 - protein, 341 aa, Setaria italica
MDHAAEAQRTDLMTITRHVLNEQSRHPESRGDFTILLSHIVLGCKFVASAVNKAGLAKLIGLAGETNVQGEEQKKLDVLSNEVFVKALVSSGRTCVLVSEENEEAIFVDPALRGKYCVCFDPLDGSSNIDCGVSIGTIFGIYMIKDKDNVTLDDVIQPGTNMLAAGYCMYGSSCTLVLSTGNGVNGFTLDPSLGEFILTHPNIKIPKKGKIYSVNEGNAKNWDAPTAKYVEKCKFPQDGSSPKSLRYIGSMVADVHRTLLYGGIFLYPADQKSPNGKLRVLYEVFPMSFLMEQAGGQAFTGKQRALELAPTKLHERSPIFLGSYDDVEEIKALYASESSTV

SEQ ID NO: 5803 - protein, 122 aa, Echinochloa colona
MDHAAEAQRTDLMTITRHVLNEQSRHPESRGDFTILLSHIVLGCKFVASAVNKAGLAKLIGLAGETNVQGEEQRNWMCCPMRSLSRRLSAAAAPAFLCLKRTRRPYSSTQPSVESTAFVSIR

SEQ ID NO: 5804 - protein, 343 aa, Avena sativa
MDHAADTYRTDLMTITRYVLNEQSRFPESRGDLTILLSHIVLGCKFVASAVNKAGLAKLTGLAGETNVQGEEQKKLDILSNEVFVNALVSSGRTCVLVSEEDELATFVDPKLRGKYCVCFDPLDGSSNIDCGVSIGTIFGIYMIKNYDTVTLEEVLLPGKDMIAAGYCMYGSSCTLVLSTGSGVNGFTLDPSLGEFIMTHPEIKIPPKGKIYSVNEGNAKNWDTPTAKYVEKCKYPTDGSSPKSLRYIGSMVADVHRTLLYGGIFLYPADKKSPNGKLRVMYEVFPMSFLMEQAGGQSFTGKGRSLDLIPTNIHERSPIFLGSYDDVEEIKALYAEEAKAGSA

SEQ ID NO: 5805 - protein, 341 aa, Oryza sativa
MDHAAEAQRTDLMTITRHVLNEQGRHPESRGDFTILLSHIVLGCKFVASAVNKAGLAKLIGLAGDTNVQGEEQKKLDVLSNEVFVKALVSSGRTCVLVSEENEEAIIVDAPLRGKYCVCFDPLDGSSNIDCGVSIGTIFGIYMIKDKDNVTLDDVLQPGTDMLAAGYCMYGSSCTLVLSTGNGVNGFTLDPSLGEFILTHPNIKIPNRGKIYSVNEGNAKNWDAPTAKFVEKCKFPQDGSPSKSLRYIGSMVADVHRTLLYGGIFLYPADQKSPNGKLRVLYEVFPMSFLMEQAGGQAFTGKQRALELVPRKIHDRSPIFLGSYDDVEDIKALYASESIIG

SEQ ID NO: 5806 - protein, 340 aa, Flaveria ramosissima
MDHAADAFRTDLMTITRFVLNEQSKHPESRGDFSILLSHIVLGCKFVCAAVNKAGLAKLIGLAGETNVQGEEQKKLDVLSNEVFVKALVSSGRTCILVSEEDEEAIIVEPSKRGKYCVVFDPLDGSSNIDCGVSIGTIFGIYMIKDSDAARLEDVLQPGKNMLAAGYCMYGSSCTLVLSTGSGVNGFTLDPSLGEFILTHPDIKIPKKGKIYSVNEGNAKNWDGPTAKFVEKCKFPKDGSPAKSLRYIGSMVADVHRTLLYGGVFLYPADKKSPNGKLRVLYEVFPMSFLMEQAGGQAFTGKERALDLVPKKIHDRSPIFLGSYDDVEEIKALYAAEEKA

SEQ ID NO: 5807 - protein, 344 aa, Leymus cinereus x Leymus triticoides
MDHAADTFRTDLMTITRHVLNEQSKHPESRGDLTILLSHIVLGCKFVASAVNKAGLAKLIGLAGETNVQGEEQKKLDVLSNEVFVNALVSSGRTCVLVSEEDEEATFVDPKLRGKYCVCFDPLDGSSNIDCGVSIGTIFGIYMIKNQDTVTLEEVLQPGKDMIAAGYCMYGSSCTLVLSTGNGVNGFTLDPSLGEFIMTHPDIKIPPKGKIYSVNEGNAKNWDTPTAKYVEKCKYPTDGSSPKSLRYIGSMVADVHRTLLYGGIFLYPADKKSPNGKLRVMYEVFPMSFLMEEAGGQSFTGKGRSLDLIPTNIHERSPIFLGSSDDVEEIKALYAEEAKKAGSA

SEQ ID NO: 5808 - protein, 344 aa, Hordeum vulgare
MDHAADTFRTDLMTITRHVLNEQSRHPESRGDLTILLSHIVLGCKFVASAVNKAGLAKLTGLAGETNVQGEEQKKLDVLSNEVFVNALVSSGRTCVLVSEEDEEATFVDPKLRGKYCVCFDPLDGSSNIDCGVSIGTIFGIYMIKNQDTVTLEEVLQPGKDMIAAGYCMYGSSCTLVLSTGNGVNGFTLDPSLGEFIMTHPDIKIPPKGKIYSVNEGNAKNWDTPTAKYVEKCKYPTDGSSPKSLRYIGSMVADVHRTLLYGGIFLYPADKKSPNGKLRVMYEVFPMSFLMEEAGGQSFTGKGRSLDLIPTDIHERSPIFLGSSDDVEEIKALYAEEAKKAGSA

SEQ ID NO: 5809 - protein, 340 aa, Triphysaria pusilla
MDHAADAHRTDLMTITRHVLNEQSKHPESRGDFTILLSHIVLGCKFVCSAVNKAGLAKLIGLAGETNVQGEEQKKLDVLSNEVFIKALVSSGRTCILVSEEDEEATFVEPSHRGKYCVVFDPLDGSSNIDCGVSIGTIFGIYAIYDGHDPKLEDVLQPGKNMLAAGYCMYGSSCTFVLSTGSGVNGFTLDPSLGEFILTHPDIKIPKKGKIYSVNEGNAKNWDGPTAKYVEKCKYPTDGSPAKSLRYIGSMVADVHRTLLYGGVFLYPADKKSPNGKLRVLYEVFPMSFLMEQAGGQAFTGKERALDLVPKNIHDRSPIFLGSYDDVEEIKTLYAAEEQK

SEQ ID NO: 5810 - protein, 343 aa, Avena sativa
MDHAADTYRTDLMTITRYVLNEQSRFPESRGDLTILLSHIVLGCKFVASAVNKAGLAKLTGLAGETNVQGEEQKKLDILSNEVFVNALVSSGRTCVLVSEEDELATFVDPKLRGKYCVCFDPLDGSSNIDCGVSIGTIFGIYMVKNYDTVTLEEVLLPGKDMIAAGYCMYGSSCTLVLSTGSGVNGFTLDPSLGEFIMTHPEIKIPPKGKIYSVNEGNAKNWDTPTAKYVEKCKYPTDGSSPKSLRYIGSMVADVHRTLLYGGIFLYPADKKSPNGKLRVMYEVFPMSFLMEQAGGQSFTGKGRSLDLIPTNIHERSPIFLGSYDDVEEIKALYAEEAKAGSA

SEQ ID NO: 5811 - protein, 341 aa, Musa acuminata
MDHEAEAHRTDLMTITRYVLNEQSRHQESRGDFTILLSHIVLGCKFVCSAVNKAGLAKLIGLAGETNVQGEEQKKLDVLSNEVFVKALISSGRTCILVSEEDEEATFVDPSLRGKYCVVFDPLDGSSNIDCGVSIGTIFGVYMVKDKDNVTLDEVLQPGKNMLAAGYCMYGSSCTLVLSTGSGVNGFTLDPSLGEFILTHPDIKIPKKGKIYSVNEGNAKNWDGPTTKYVEKCKFPKDGDSPKSLRYIGSMVADVHRTLLYGGIFLYPADKKSPNGKLRVLYEVFPMSFLMEQAGGQAFTGKQRALDLVPTKIHQRSPIFLGSYDEVEEIKALYAAEENTA

SEQ ID NO: 5812 - protein, 343 aa, Festuca arundinacea
MDHAADTYRTDLMTITRYVLNEQSRFPESRGDLTILLSHIVLGCKFVASAVNKAGLAKLTGLAGETNVQGEEQKKLDILSNEVFVNALVSSGRTCVLVSEEDELATFVDPKLRGKYCVCFDPLDGSSNIDCGVSIGTIFGIYMIKNFDTVTLEEVLLPGKDMIAAGYCMYGSSCTLVLSTGSGVNGFTLDPSLGEFIMTHPEIKIPPKGKIYSVNEGNAKNWDTPTAKYVEKCKYPTDGSSPKSLRYIGSMVADVHRTLLYGGIFLYPADKKSPNGKLRVMYEVFPMSFLMEQAGGQSFTGKGRSLDLIPTNIHERSPIFLGSYDDVEEIKALYAEEAKAGAA

SEQ ID NO: 5813 - protein, 340 aa, Flaveria ramosissima
MDHAADAFRTDLMTITRFVLNEQSKHPESRGDFSILLSHIVLGCKFVCAAVNKAGLAKLIGLAGETNVQGEEQKKLDVLSNEVFVKALVSSGRTCILVSEEDEEAIIVEPSKRGKYCVVFDPLDGSSNIDCGVSIGTIFGIYMIKDSGAARLEDVLQPGKNMLAAGYCMYGSSCTLVLSTGSGVNGFTLDPSLGEFILTHPDIKIPKKGKIYSVNEGNAKNWDGPTAKFVEKCKFPTDGSPAKSLRYIGSMVADVHRTLLYGGVFLYPADKKSPNGKLRVLYEVFPMSFLMEQAGGQAFTGKERALDLVPKKIHDRSPIFLGSYDDVEEIKALYAAEGKA

SEQ ID NO: 5814 - protein, 340 aa, Flaveria ramosissima
MDHAADAFRTDLMTITRFVLNEQSKHPESRGDFSILLSHIVLGCKFVCAAVNKAGLAKLIGLAGETNVQGEEQKKLDVLSNEVFVKALVSSGRTCILVSEEDEEAIIVEPSKRGKYCVVFDPLDGSSNIDCGVSIGTIFGIYMIKDSGEARLEDVLQPGKNMLAAGYCMYGSSCTLVLSTGSGVNGFTLDPSLGEFILTHPDIKIPKKGKIYSVNEGNAKNWDGPTAKFVEKCKFPKDGSPVKSLRYIGSMVADVHRTLLYGGVFLYPADKKSPNGKLRVLYEVFPMSFLMEQAGGQSFTGKERALDLVPKKIHERSPIFLGSYDDVEEIKALYAAEEKA

SEQ ID NO: 5815 - protein, 340 aa, Plantago ovata
MDHAADAHRTDLMTITRHVLNEQSKHPESRGDFTILLSHIVLGCKFVCSAVNKAGLAKLIGLAGETNVQGEEQKKLDVLSNEVFVKALVSSGRTCILVSEEDEEATFVEGPKRGKYCVVFDPLDGSSNIDCGVSIGTIFGIYLIGEGIEPKLEDVLQPGKNMVAAGYCMYGSSCTFVLSTGSGVNGFTLDPSLGEFILTHPDIKIPKKGKIYSVNEGNAKNWDGPTAKYVEKCKFPTDGSPAKSLRYIGSMVADVHRTLLYGGIFLYPADKKSPSGKLRVLYEVFPMSFLMEQAGGQSFTGKERALDLVPTKIHERSPIFLGSYDDVEEIKALYAAEEKK

SEQ ID NO: 5816 - protein, 177 aa, Flaveria ramosissima
MDHAADAFRTDLMTITRFVLNEQSKHPESRGDFSILLSHIVLGCKFVCAAVNKAGLAKLIGLAGETNVQGEEQKKLDVLSNEVFVKALVSSGRTCILVSEEDEEAIIVEPSKRGKYCVVFDPLDGSSNIDCGVSIGTIFGIYMIKDSGAARWKMFFSLERICWLLDTACMVALARLC

SEQ ID NO: 5817 - protein, 341 aa, Cocos nucifera
MDHAADAQRTDLMTITRYVLNEQTKHPESRGDFTILLSHIVLGCKFVCSAVNKAGLAKLLGLAGDKNVQGEEQKKLDVLSNEVFIKALISSGRTCILVSEEDEEATFVDPALRGKYCVVFDPLDGSSNIDCGVSIGTIFGIYMVKDKNEVTLNDVLQPGKNMLAAGYCMYGSSCTLVLSTGSGVNGFTLDPSLGEFILTYPNIKIPKKGKIYSVNEGNAKNWDGPTAKFIEKCKFPKDGSSPKSLRYIGSMVADVHRTLLYGGIFLYPADKKSPNGKLRVLYEVFPMSFLMEQAGGQAFTGKQRALDLVPTKIHQRSPIFLGSYDDVEEIKALYAAEESHA

SEQ ID NO: 5818 - protein, 341 aa, Cichorium intybus
MDHAADAFRTDLMTITRFVLNEQSKHPESRGDFSILLSHIVLGCKFVCSAVNKAGLAKLIGLAGETNVQGEEQKKLDVLSNEVFVKALVSSGRTCILVSEEDEEAIMVEPSKRGKYCVVFDPLDGSSNIDCGVSIGTIFGIYMIKDGDEARLEDVLQPGKNMLAAGYCMYGSSCTLVLSTGSGVNGFTLDPSLGEFILTHPDIKIPKKGKIYSVNEGNAKNWDGPTAKFVEKCKFPTDGSSAKSLRYIGSMVADVHRTLLYGGIFLYPADKKSPSGKLRVLYEVFPMSFLMEQAGGQSFTGKERALDLVPKKIHERSPIFLGSYDDVEEIKALYAAEEKAN

SEQ ID NO: 5819 - protein, 341 aa, Lactuca sativa
MDHAADAFRTDLMTITRFVLNEQSKHPESRGDFSILLSHIVLGCKFVCSAVNKAGLAKLIGLAGETNVQGEEQKKLDVLSNEVFVKALVSSGRTCILVSEEDEDAIIVEPSKRGRYCVVFDPLDGSSNIDCGVSIGTIFGIYMIKDGDEATLEDVLQPGKNMVAAGYCMYGSSCTLVLSTGSGVNGFTLDPSLGEFILTHADIKIPKKGKIYSVNEGNAKNWDGPTAKFVEKCKYPTDGSSAKSLRYIGSMVADVHRTLLYGGVFLYPADKKSPNGKLRVLYEVFPMSFLMEQAGGQSFTGKERALDLVPKKIHERSPIFLGSYDDVEEIKALYAAEEKAN

SEQ ID NO: 5820 - protein, 340 aa, Echinacea purpurea
MDHAADAFRTDLMTITRFVLNEQSKHPESRGDFSILLSHIVLGCKFVCAAVNKAGLAKLIGLAGETNVQGEEQKKLDVLSNEVFVKALVSSGRTCILVSEEDEEAIIVEPSKRGKYCVVFDPLDGSSNIDCGVSIGTIFGIYMIKDGGEARLEDVLQPGKNMLAAGYCMYGSSCTFVLSTGSGVNGFTLDPSLGEFILTHPDIKIPKKGKIYSVNEGNAKNWDAPTAKFVEKCKFPKDGSPAKSLRYIGSMVADVHRTLLYGGVFLYPADKKSPNGKLRVLYEVFPMSFLMEQAGGQSFTGKERALDLVPKKIHERSPIFLGSYDDVEEIKALYAAEEKA

SEQ ID NO: 5821 - protein, 340 aa, Flaveria ramosissima
MDHAADAFRTDLMTITRFVLNEQSKHPESRGDFSILLSHIVLGCKFVCAAVNKAGLAKLIGLAGETNVQGEEQKKLDVLSNEVFVKALVSSGRTCILVSEEDEEAIIVEPSKRGKYCVVFDPLDGSSNIDCGVSIGTIFGIYMIKDSGEARLEDVLQPGKNMLAAGYCMYGSSCTLVLSTGSGVNGFTLDPSLGEFILTHPDIKIPKKGKIYSVNEGNAKNWDGPTAKFVEKCKFPKNGSPVKSLRYIGSMVADVHRTLLYGGVFLYPADKKSPNGKLRVLYEVFPMSFLMEQAGGQSFTGKERALDLVPKKIHERSPIFLGSYDDVEEIKALYAAEEKA

SEQ ID NO: 5822 - protein, 340 aa, Guizotia abyssinica
MDHEADAFRTDLMTITRFVLNEQSKYPESRGDFSILLSHIVLGCKFVCAAVNKAGLAKLIGLAGDTNVQGEEQKKLDVLSNEVFVKALVSSGRTCILVSEEDEEAIFVEPSKRGKYCVVFDPLDGSSNIDCGVSIGTIFGIYMIKDSGEARLEDVLQPGKNMLAAGYCMYGSSCTLVLSTGSGVNGFTLDPSLGEFILTHPDIKIPKKGKIYSVNEGNAKNWDGPTAKFVEKCKFPKDGSPAKSLRYIGSMVADVHRTLLYGGVFLYPADKKSPNGKLRVLYEVFPMSFLMEQAGGQSFTGKERALDLVPKKIHERSPIFLGSYDDVEEIKALYAAEEKA

SEQ ID NO: 5823 - protein, 340 aa, Pennisetum glaucum
DHAAEAQRTDLMTITRHVLNEQSRHPESRGDFTILLSHIVLGCKFVASAVNKAGLAKLIGLAGETNVQGEEQKKLDVLSNEVFVKALVSSGRTCILVSEENEEAIFVDPALRGKYCVCFDPLDGSSNIDCGVSIGTIFGIYMIKDKDNVTLDDVMQPGTNMLAAGYCMYGSSCTLVLSTGNGVNGFTLDPSLGEFILTHPNIKIPKKGKIYSVNEGNAKNWDAPTAKYVETCKFPQDGSSPKSLRYIGSMVADVHRTLLYGGIFLYPADKKSPNGKLRVLYEVFPMSFLMEQAGGQAFTGKQRALELAPTKLHERSPIFLGSYDDVEEIKALYASESSTV

SEQ ID NO: 5824 - protein, 340 aa, Helianthus annuus
MDHAADAMHTDLMTITRFVLNEQSKYPESRGDFSILLSHIVLGCKFVCAAVNKAGLAKLIGLAGETNVQGEEQKKLDVLSNEVFVKALVSSGRTCILVSEEDEEAIIVEPSKRGKYCVVFDPLDGSSNIDCGVSIGTIFGIYMIKDAGAARLEDVLQPGKNMLAAGYCMYGSSCTLVLSTGSGVNGFTLDPSLGEFILTHPDIKIPKKGKIYSVNEGNAKNWDGPTAKFVEKCKFPKDGSPAKSLRYIGSMVADVHRTLLYGGVFLYPADKKSPNGKLRVLYEVFPMSFLMEQAGGQSFTGKERALDLVPKKIHERSPIFLGSYDDVEEIKALYAAEEKA

SEQ ID NO: 5825 - protein, 344 aa, Avena sativa
MDHAAEAQRTDLMTITRHALNEQGRHPESRGDFTILLSHIVLGCKFVASAVNKAGLAKLIGLAGETNIQGEEQKKLDVLSNEVFVKALVSSGRTCVLVSEENEEAIFVDGPLRGKYCVCFDPLDGSSNIDCGVSIGTIFGIYMIKDKDNATLEDVLQPGTNMIAAGYCMYGSSCTLVLSTGNGVNGFTLDPSLGEFILTHPNIKIPNKGKIYSVNEGNARNWDVPTAKFVEKCKFPQDGSSPKSLRYIGSMVADVHRTLLYGGIFLYPADKKSPNGKLRVLYEVFPMSFLMEQAGGQSFTGKQRALELAPTEIHQRSPIFLGSYDDVEEIKSLYASESSTGLSA

SEQ ID NO: 5826 - protein, 340 aa, Triphysaria pusilla
MDHAADAYRTDLMTITRHVLNEQSKHPESRGDFTILLSHIVLGCKFVCSAVSKAGLAKLIGLAGETNVQGEEQKKLDVLSNEVFIKALVSSGRTCILVSEEDEEATFVEPSHRGKYCVVFDPLDGSSNIDCGVSIGTIFGIYAIYDGHDPKLEDVLQPGKNMLAAGYCMYGSSCTFVLSTGSGVNGFTLDPSLGEFILTHPDIKIPKKGKIYSVNEGNAKNWDGPTAKYVEKCKYPTDGSPAKSLRYIGSMVADVHRTLLYGGVFLYPADKKSPNGKLRVLYEVFPMSFLMEQAGGQAFTGKERALDLLPQKIHDRSPIFLGSYDDIEEIKALYAAEEQK

SEQ ID NO: 5827 - protein, 344 aa, Triticum aestivum
MDHAADTFRTDLMTITRHVLNEQSRHPESRGDLTILLSHIVLGCKFVASAVNKAGLAKLTGLAGETNVQGEEQKKLDVLSNEVFVNALVSSGRTCVLVSEEDEKATFVDPKLRGKYCVCFDPLDGSSNIDCGVSIGTIFGIYMIKNQDTVTLEEVLQPGKDMIAAGYCMYGSSCTLVLSTGNGVNGFTLDPSLGEFIMTHPDIKIPPKGKIYSVNEGNAKNWDTPTAKYVEKCKYPTDGSSPKSLRYIGSMVADVHRTLLYGGIFLYPADKKSPSGKLRVMYEVFPMSFLMEEAGGQSFTGKGRSLDLIPTDIHERSPIFLGSSDDVEEIKALYAEEAKKAGSA

SEQ ID NO: 5828 - protein, 344 aa, Triticum aestivum
MDHAADTFRTDLMTITRHVLNEQSRHPESRGDLTILLSHIVLGCKFVASAVNKAGLAKLTGLAGETNVQGEEQKKLDVLSNEVFVNALVSSGRTCVLVSEEDEKATFVDPKLRGKYCVCFDPLDGSSNIDCGVSIGTIFGIYMIKNQDTVTLEEVLQPGKDMIAAGYCMYGSSCTLVLSTGNGVNGFTLDPSLGEFIMTHPDIKIPPKGKIYSVNEGNAKNWDTPTAKYVEKCKYPTDGSSPKSLRYIGSMVADVHRTLLYGGIFLYPADKKSPSGKLRVMYEVFPMSFLMEEAGGQSFTGKGRSLDLIPTDIHERSPIFLGSSDDVEEIKALYAEEAKKEGSA

SEQ ID NO: 5829 - protein, 340 aa, Mimulus guttatus
MDHAADAHRTDLMTITRHVLNEQTKHPESRGDFTILLSHIVLGCKFVCSAVNKAGLAKLIGLAGETNVQGEEQKKLDVLSNEVFINALVSSGRTCILVSEEDEEATFVEPSKRGKYCVVFDPLDGSSNIDCGVSIGTIFGIYLIKDGDEPKLEDVLQPGKNMLAAGYCMYGSSCTFVLSTGGGVNGFTLDPSLGEFILTHPDIKIPKKGKIYSVNEGNAKNWDGPTAKYVEKCKFPTDGSASKSLRYIGSMVADVHRTLLYGGVFLYPADKKSPNGKLRVLYEVFPMSFLMEQAGGQAFTGKQRALDLVPEKIHDRSPIFLGSYDDVEEIKALYAAEEQK

SEQ ID NO: 5830 - protein, 344 aa, Secale cereale
MDHAADTFRTDLMTITRYVLNEQSRHPESRGDLTILLSHIVLGCKFVASAVNKAGLAKLTGLAGETNVQGEEQKKLDVLSNEVFVNALVSSGRTCVLVSEEDEKATFVDPKLRGKYCVCFDPLDGSSNIDCGVSIGTIFGIYMIKNQDTVTLEEVLQPGKDMIAAGYCMYGSSCTLVLSTGNGVNGFTLDPSLGEFIMTHPDIKIPPKGKIYSVNEGNAKNWDTPTAKYVEKCKYPTDGSSPKSLRYIGSMVADVHRTLLYGGIFLYPADKKSPNGKLRVMYEVFPMSFLMEEAGGQSFTGKGRSLDLIPTDIHERSPIFLGSSDDVEEIKALYAEEAKKAGSA

SEQ ID NO: 5831 - protein, 969 aa, Malus domestica
MADHEEEDLRMALRMSMQNSPPEPKRSKPRDGPAGAPAEEPSEVKTRRLQRELMAAAAEKRMLDTSKCPPSASASPSKVLSGSAGSGSGLAPNVATKDKELSLEEVNLGKGLSEEDAKQLFSMVFGPEVTKGILVQWSNQGIRFSSDPETSMGLVQHEGGPCGVLAAIQAFVLKYLLFYPAELGKVAPNMHQNTGSRTPSNSQCVASNNFASLTEDAKASVLIRSMGEILFLCGSNKRAVIATLSVIGDETERADDNLNDEVITKSLESLSIESAADLHKVLRVSTYTTQESAFMGLQAVLPVFQSRMGALLFLISALLSRGLDLVQSDRDDPGLPLVTAPFGHASQEIVNLLLCGQAVPNVFDGKMDLGGGMSLKGISKTVEVGFLTLLESLNYCKVGQYLKSPKWPIWVVGSESHYTVLFSLDTTVQDENELEGRESQIRRAFDAQDQSGGGGFISVEGFHQVLRETNVKLPTEKVDLLCNTGFIVWSELWQVILDLDKSLGGLKDSTGLMGKKVFDLYHFNGIAKSDLNGSQTSSGGEIPVQRPRLTKLRVSVPPRWTPEEYMTDVVVSSASSGNESGGKVTEIAKPEPAQHAPLVDCIRTRWPRAVCNWVFSDSGFVGKKEGRQRKMDHAADAHRTDLMTITRFVLNEQSKHPESRGDFTILLSHIVLGCKFVCSAVNKAGLAKLIGLAGETNVQGEEQKKLDVLSNEVFVKALVSSGRTSILVSEEDEEAIFVEPKLRGKYCVVFDPLDGSSNIDCGVSIGTIFGIYVVKDGEPSLKDVLQPGKKMVAAGYCMYGSFCTLVISTGSGVHGFTLDPSLGEFILTHPDIKIPKKGKIYSVNEGNAKNWDGPTAKYVQKCKYPEDGSSPKSLRYIGSMVADVHRTLLYGGIFLYPADKKSPNGKLRVLYEVFPMSFLLEQAGGQSFTGKERALDLVPTKIHERSPIFLGSYDDVEEIKALYAAEGKE

SEQ ID NO: 5832 - protein, 340 aa, Chrysanthemum coronarium
MDHEADAFRTDLMTITRFVLNEQSKHPESRGDFSILLSHIVLGCKFVCAAVNKAGLAKLIGLAGETNVQGEEQKKLDVLSNEVFVKALVSSGRTCILVSEEDEEAIIVEPSKRGKYCVVFDPLDGSSNIDCGVSIGTIFGIYMIKDGDDPSLEDVLQPGKNMLAAGYCMYGSSCTFVLSTGSGVNGFTLDPSLGEFILTHPDIKIPKKGKIYSVNEGNAKNWDGPTAKFVEKCKYPTDGSSAKSLRYIGSMVADVHRTLLYGGVFLYPADKKSPTGKLRVLYEVFPMSFLMEQAGGQSFTGKERALDLVPKKIHERSPIFLGSYDDVEEIKALYAAEEKA

SEQ ID NO: 5833 - protein, 341 aa, Brachypodium distachyon
MDHAAEAQRTDLMTITRHALNEQGRHPESRGDFTILLSHIVLGCKFVASAVNKAGLAKLIGLAGVTNVQGEEQKKLDVLSNEVFVKALVSSGRTCVLVSEENEEAIFVDAPLRGKYCVCFDPLDGSSNIDCGVSIGTIFGIYMIKEKDNATLEDVLQPGTDMIAAGYCMYGSSCTLVLSTGNGVNGFTLDPSLGEFILTHPNIKIPKKGKIYSVNEGNAQNWDAPTAKFVEKCKFPQDGTSAKSLRYIGSMVADVHRTLLYGGIFLYPADKKSPNGKLRILYEVFPMSFLMEQAGGQAFTGKQRALELVPTEIHQRSPIFLGSYDDVEEMKSLYASESSTA

SEQ ID NO: 5834 - protein, 341 aa, Zingiber officinale
MDHEADAHRTDLMTITRYVLNEQSRYPESRGDFSILLSHIVLGCKFVCTAVNKAGLAKLIGLAGETNVQGEEQKKLDVLSNEVFVKALISSGRTCILVSEEDEEATFVDPSLRGKYCVVFDPLDGSSNIDCGVSIGTIFGIYMVKDKENVTLNDVLQPGKNMLAAGYCMYGSSCMLVLSTGSGVNGFTLDPSLGEFILTHPYIKIPKKGKIYSVNEGNAKNWDRPTTKYVEKCKFPDDGSSPKSLRYVGSMVADVHRTLLYGGIFLYPSDKKSPDGKLRVLYEVFPMSFLMEQAGGQSFTGKQRALDLVPTKIHERSPIFLGSYDDVEEIKALYAAEENND

SEQ ID NO: 5835 - protein, 340 aa, Helianthus annuus
MDHAADAMHTDLMTITRFVLNEQSKYPESRGDFSILLSHIVLGCKFVCAAVNKAGLAKLIGLAGETNVQGEEQKKLDVLSNEVFVKALVSSGRTCILVSEEDEEAIIVEPSKRGKYCVVFDPLDGSSNIDCGVSIGTIFGIYMIKDAGAARLEDVLQPGKNMVAAGYCMYGSSCTLVLSTGSGVNGFTLDPSLGEFILTHPDIKIPKKGKIYSVNEGNAKNWDGPTAKFVEKCKFPKDGSPAKSLRYIGSMVADVHRTLLYGGVFLYPADKKSPNGKLRVLYEVFPMSFLMEQAGGQSFTGKERALDLVPKKIHERSPIFLGSYDDVEEIKALYAAEEKA

SEQ ID NO: 5836 - protein, 341 aa, Cocos nucifera
MDHAADAHRTDLMTITRHVLNEQTKHAESRGDFSILLNHIVLGCKFVCSAVNKAGLAKLIGLAGETNVQGEEQKKLDVLSNEVFVKALISSGRTCILVSEEDEEATFVDPALRGKYCVVFDPLDGSSNIDCGVSIGTIFGIYMVKDANEVTINNVLQPGKNMLAAGYCMYGSSCTLVLSTGSGVNGFTLDPSLGEFILTYPNIKIPKKGKIYSVNEGNAKNWDGPTAKFVEKCKFPEDGSSPKSLRYIGSMVADVHRTLLYGGIFLYPADKKSPNGKLRVLYEVFPMSFLMEQAGGQAFTGKQRALDLVPTNIHQRSPIFLGSYDEVEEIKALYAAEESKA

SEQ ID NO: 5837 - protein, 344 aa, Avena sativa
MDHAAEAQRTDLMTITRHALNEQGRHPESRGDFTILLSHIVLGCKFVASAVNKAGLAKLIGLAGETNIQGEEQKKLDVLSNEVFVKALVSSGRTCVLVSEENEEAIFVDGPLRGKYCVCFDPLDGSSNIDCGVSIGTIFGIYMIKDKDNATLEDVLQPGTNMIAAGYCMYGSSCTLVLSTGNGVNGFTLDPSLGEFILTHPNIKIPSKGKIYSVNEGNARNWDAPTAKFVEKCKFPQDGSSPKSLRYIGSMVADVHRTLLYGGIFLYPADKKSPNGKLRVLYEVFPMSFLMEQAGGQSFTGKQRALELAPTEIHQRSPIFLGSYGDVEEIKSLYASESSTGPSA

SEQ ID NO: 5838 - protein, 340 aa, Olea europaea
MDHAADAHRTDLMTITRFVLNEQSKHPESRGDFTILLSHIVLGCKFVCSAVNKAGLAKLIGLAGETNVQGEEQKKLDVLSNEVFIKALVSSGRTCILVSEEDEEATFVEPSKRGKYCVVFDPLDGSSNIDCGVSIGTIFGIYMIKDGGEPELEDVLQPGKNMIAAGYCMYGSSCTLVLSAGRGVNGFTLDPSLGEFILTHPDIKIPKKGKIYSVNEGNAKNWDGPTAKYVEKCKFPKDGSAPKSLRYIGSMVADVHRTLLYGGIFLYPADKKSPNGKLRVLYEVFPMSFLMEQAGGQAFTGKQRALDLVPKKIHERSPIFLGSYDDVEEIKALYAAEEQK

SEQ ID NO: 5839 - protein, 279 aa, Triticum aestivum
MDHAADTFRTDLMTITRHVLNEQSRHPESRGDLTILLSHIVLGCKFVASAVNKAGLAKLTGLAGETNVQGEEQKKLDVLSNEVFVNALVSSGRTCVLVSEEDEKATFVDPKLRGKYCVCFDPLDGSSNIDCGVSIGTIFGIYMIKNQDTVTLEEVLQPGKDMIAAGYCMYGSSCTLVLSTGNGVNGFTLDPSLGEFIMTHPDIKIPPKGKIYSVNEGNAKNWDTPTAKYVEKCKYPTDGSSPKSLRYIGSMVADVHRTLLYGGIFPYPADKKSRAESSV

SEQ ID NO: 5840 - protein, 339 aa, Musa acuminata
MDHAADAHRTDLMTITRHVLNEQSKHPESKGDFTILLSHIVLGCKFVCSAVNKAGLAKLIGLAGETNGEEQKKLDVLSNQVFVKALISSGRTCVLVSEEDEEATFVDPSLRGKYCVVFDPLDGSSNIDCGVSIGTIFGIYMVKDKDNVSLDDVLQPGKHMVAAGYCMYGSSCTLVLSTGNGVNGFTLDPSLGEFMLTHPDIKIPKRGKLYSVNEGNAKNWDTPTAKFVEKCKFPKDGSSPKSLRYIGSMVADVHRTLLYGGIFLYPADKQSPNGKLRVLYEVFPMSFLMEQAGGQAFTGEQRALDLVPTKIHQRSPVFLGSYDDVEEIKALYAAEEKKA

SEQ ID NO: 5841 - protein, 340 aa, Chrysanthemum coronarium
MDHEADAFRTDLMTITRFVLNEQSKHPESRGDFSILLSHIVLGCKFVCAAVNKAGLAKLIGLAGETNVQGEEQKKLDVLSNQVFVKALVSSGRTCILVSEEDEEAIIVEPSKRGKYCVVFDPLDGSSNIDCGVSIGTIFGIYMIKDGDDPSLEDVLQPGKNMLAAGYCMYGSSCTFVLSTGSGVNGFTLDPSLGEFILTHPDIKIPKKGKIYSVNEGNAKNWDGPTAKFVEKCKYPTDGSSAKSLRYIGSMVADVHRTLLYGGVFLYPADKKSPTGKLRVLYEVFPMSFLMEQAGGQSFTGKERALDLVPKKIHERSPIFLGSYDDVEEIKALYAAEEKA

SEQ ID NO: 5842 - protein, 341 aa, Ananas comosus
MDHEAEAHRTDLMTITRHVLNEQTKHAESRGDFSILLSHIVLGCKFVCSSVNKAGLAHLIGLAGDTNVQGEEQKKLDVLSNEVFIKALVSSGRTCILVSEEDEEATFVDPSLRGKYCVVFDPLDGSSNIDCGVSIGTIFGIYVVKDKDNISLEDVLQPGKDMLAAGYCMYGSSCNLVLSTGSGVNGFTLDPSLGEFILTHPDIKIPKRGKVYSVNEGNAKNWDGPTAKFVEKCKYPQDGSPPKSLRYIGSMVADVHRTLLYGGIFMYPADKKSPNGKLRVLYEVFPMSFLIEQAGGQAFTGKQRALDLVPTKIHQRSPIFLGSYDDVEEIKAFYAAEDGQA

SEQ ID NO: 5843 - protein, 341 aa, Secale cereale
MDHAADAQRTDLMTITRHALNEQGRHPESRGDFTILLSHIVLGCKFVASAVNKAGLAKLIGLAGETNIQGEEQKKLDVLSNEVFVKALVSSGRTCVLVSEENEAAIFVDAPLRGKYCVCFDPLDGSSNIDCGVSIGTIFGIYMIKDKDNATLEDVLQPGTDMIAAGYCMYGSSCTLVLSTGNGVNGFTLDPSLGEFILTHPNIKIPNKGKIYSVNEGNARNWDAPTAKYVERCKFPQDGSSPKSLRYIGSMVADVHRTLLYGGIFLYPADKKSPNGKLRVLYEVFPMSFLMEQAGGQSFTGKQRALEIVPSEIHQRSPIFLGSYDDVEEIKSLYASESSTA

SEQ ID NO: 5844 - protein, 341 aa, Gossypium hirsutum
MDHAADAHRTDLMTITRFVLNEQSKYPESRGDFTILLNHIVLGCKFVCSAVNKAGLAKLIGLAGETNVQGEEQKKLDVLSNEVFVKALVSSGRTCILVSEEDEEATFVDPSKRGRYCVVFDPLDGSSNIDCGVSIGTIFGIYMMKDNHEPTLDDVLQPGKQMLAAGYCMYGSSCTLVLSTGEGVNGFTLDPSLGEFILTHPDIKIPKKGKIYSVNEGNAKNWDGPTAKYVEKCKFPKDGSSPKSLRYIGSMVADVHRTLLYGGIFLYPADKKSPSGKLRVLYEVFPMSFLMEQAGGQAFTGKQRALDLVPTKIHERSPIFLGSFDDVEDIKALYAAEGKKE

SEQ ID NO: 5845 - protein, 340 aa, Ambrosia trifida
MDHEADAFRTDLMTITRFVLNEQSKYPESRGDFSILLSHIVLGCKFVCAAVNKAGLAKLIGLAGETNVQGEEQKKLDVLSNEVFVKALVSSGRTCILVSEEDEEAIIVEPSKRGKYCVVFDPLDGSSNIDCGVSIGTIFGIYMIKDSGAARLEDVLQPGKNMVAAGYCMYGSSCTLVLSTGSGVNGFTLDPSLGEFILTHPDIKIPKKGKIYSVNEGNAKNWDGPTAQFVEKCKFPKDGSPAKSLRYIGSMVADVHRTLLYGGVFLYPADKKSPNGKLRVLYEVFPMSFLMEQAGGQSFTGKERALDLVPKKIHERSPIFLGSYDDVEEIKALYAAEEKA

SEQ ID NO: 5846 - protein, 341 aa, Gossypium hirsutum
MDHAADAHRTDLMTITRFVLNEQSKYPESRGDFTILLNHIVLGCKFVCSAVNKAGLAKLIGLAGETNVQGEEQKKLDVLSNEVFVKALVSSGRTCILVSEEDEEATFVDPSKRGRYCVVFDPLDGSSNIDCGVSIGTIFGIYMIKDNHEPTLDDVLQPGKQMLAAGYCMYGSSCTLVLSTGEGVNGFTLDPSLGEFILTHPDIKIPKKGKIYSVNEGNAKNWDGPTAKYVEKCKFPKDGSSSKSLRYIGSMVADVHRTLLYGGIFLYPADKKSPSGKLRVLYEVFPMSFLMEQAGGQAFTGKQRALDLVPTKIHERSPIFLGSFDDVEDIKALYAAEGKKE

SEQ ID NO: 5847 - protein, 341 aa, Curcuma longa
MDHEADAHRTDLMTITRYVLNEQSRYPESRGDFSILLSHIVLGCKFVCTAVNKAGLAKLIGLAGETNVQGEEQKKLDVLSNEVFVKAKISSGRTCILVSEEDEEATFVDPSLRGKYCVVFDPLDGSSNIDCGVSIGTIFGIYMVKDKENVTLNDVLQPGKNMLAAGYCMYGSSCTLVLSTGSGVNGFTLDPSLGEFILTHPYIKIPKKGKIYSVNEGNAKNWDRPTTKYVEKCKSPNEGSSPKSLRYIGSMVADIHRTLLYGGIFLYPSDKKSPDGKLRVLYEVFPMSFLMEQAGGQSFTGKQRALDLVPTKIHQRSPIFLGSYDDVEEIKALYAAEESND

SEQ ID NO: 5848 - protein, 341 aa, Triticum aestivum
MDHAAEAQRTDLMTITRHALNEQGRHPESRGDFTILLSHIVLGCKFVASAVNKAGLAKLIGLAGETNVQGEEQKKLDVLSNEVFVKALVSSGRTCVLVSEENEAAIFVDAPLRGKYCVCFDPLDGSSNIDCGVSIGTIFGIYMIKDKDNATLEDVLQPGTHMIAAGYCMYGSSCTLVLSTGNGVNGFTLDPSLGEFILTHPNIKIPNKGKIYSVNEGNARNWDAPTAKYVERCKFPQDGSSPKSLRYIGSMVADVHRTLLYGGIFLYPADKKSPNGKLRVLYEVFPMSFLMEQAGGQSFTGKHRALEIVPSEIHQRSPIFLGSYDDVEEIKSLYAAESSTA

SEQ ID NO: 5849 - protein, 341 aa, Triticum aestivum
MDHAADAQRTDLMTITRHALNEQGRHPESRGDFTILLSHIVLGCKFVASAVNKAGLAKLIGLAGETNVQGEEQKKLDVLSNEVFVKALVSSGRTCVLVSEENEAAIFVDAPLRGKYCVCFDPLDGSSNIDCGVSIGTIFGIYMIKDKDNATLEDVLQPGTNMIAAGYCMYGSSCTLVLSTGNGVNGFTLDPSLGEFILTHPNIKIPNKGKIYSVNEGNARNWDAPTAKYVERCKFPQDGSSPKSLRYIGSMVADVHRTLLYGGIFLYPADKKSPNGKLRVLYEVFPMSFLMEQAGGQSFTGKQRALEIVPYEIHQRSPIFLGSYDDVEEIKSLYASESSTA

SEQ ID NO: 5850 - protein, 341 aa, Triticum aestivum
MDHAAEAQRTDLMTITRHALNEQGRHPESRGDFTILLSHIVLGCKFVASAVNKAGLAKLIGLAGETNVQGEEQKKLDVLSNEVFVKALVSSGRTCVLVSEENEAAIFVDAPLRGKYCVCFDPLDGSSNIDCGVSIGTIFGIYMIKDKDNATLEDVLQPGTDMIAAGYCMYGSSCTLVLSTGNGVNGFTLDPSLGEFILTHPNIKIPNKGKIYSVNEGNARNWDAPTAKYVERCKFPQDGSSPKSLRYIGSMVADVHRTLLYGGIFLYPADKKSPNGKLRVLYEVFPMSFLMEQAGGQSFTGKQRALEIVPAEIHQRSPIFLGSYDDVEEIKSLYASESSTA

SEQ ID NO: 5851 - protein, 341 aa, Amaranthus tuberculatus
MDHAADAARTDLMTITRHVLNEQSKRPESRGDFTILLSHIVLGCKFVCSAVNKAGLAKLIGLAGETNVQGEEQKKLDVLSNDVFVKALISSGRTCILVSEEDEEATFVEPSLRGKYCVAFDPLDGSSNIDCGVSIGTIFGIYMVKDFNNVTLDDVLKPGKNMVAAGYCMYGSSCTLVLSTGSGVNGFTLDPSLGEFILTHPDIKIPKKGKVYSVNEGNAKNWDGPTTKYVQKCKFPEDGSPPKSLRYIGSMVADVHRTLLYGGIFMYPGDKKSPNGKLRVLYEVFPMSFLMEQAGGQAFTGKQRALDLVPTKIHERSPVFLGSYDDVEDIKALYAAEEQKA

SEQ ID NO: 5852 - protein, 340 aa, Chrysanthemum coronarium
MDHEADAFRTDLMTITRFVLNEQSKHPESRGDFSILLSHIVLGCKFVCAAVNKAGLAKLIGLAGETNVQGEEQKKLDVLSNEVFVKALVSSGRTCILVSEEDEEAIIVEPSKRGKYCVVFDPLDGSSNIDCGVSIGTIFGIYMIKDGDDPSLEDVLQPGKNMLAAGYCMYGSSCTFVLSTGSGVNGFTLDPSLGEFILTHPDIKIPKKGKIYSVNEGNAKNWDGPTAKFVEKCKYPTDGSSAKSLRYIGSMVADVHRTLLYGGVFLYPADKKSPSGKLRVLYEVFPMSFLMEQAGGQSFTGKIRSLDLVPKKIHERSPIFLGSYDDVEEIKALYAAEEKA

SEQ ID NO: 5853 - protein, 341 aa, Eucalyptus grandis
MDHAGDAHRTDLMTITRFVLNEQSRHPESRGDFTILLSHIVLGCKFVCSCVNKAGLAKLIGLAGETNVQGEEQKKLDVLSNEVFVKALVSSGRTSILVSEEDEEATFVESAKRGKYCVVFDPLDGSSNIDCGVSIGTIFGIYMIKHANDPTLEDVLQPGKNMLAAGYCMYGSSCTLVLSTGCGVNGFTLDPSLGEFILTHPDIKIPKKGKIYSVNEGNAKNWDGPTAKYVEKCKFPKDGSSSKSLRYIGSMVADVHRTLLYGGVFLYPADKKSPSGKLRVLYEVFPMSFLMEQAGGQAFTGKQRALDLIPTKIHERSPIFLGSYDDVEEIKALYAAEEDKK

SEQ ID NO: 5854 - protein, 340 aa, Artemisia annua
MDHEADAFRTDLMTITRFVLNEQSKHPESRGDFSILLSHIVLGCKFVCAAVNKAGLAKLIGLAGETNVQGEEQKKLDVLSNEVFVKALVSSGRTCILVSEEDEEAIIVEPSKRGKYCVVFDPLDGSSNIDCGVSIGTIFGIYMIKDGDDPSLEDVLQPGKNMLAAGYCMYGSSCTFVLSTGSGVNGFTLDPSLGEFILTHPDIKIPKKGKIYSVNEGNAKNWDGPTAKFVEKCKYPTDGSSAKSLRYIGSMVADVHRTLLYGGVFLYPADKKSPDGKLRVLYEVFPMSFLMEQAGGQSFTGKIRSLDLVPKKIHERSPIFLGSYDDVEEIKALYAAEEKA

SEQ ID NO: 5855 - protein, 340 aa, Helianthus annuus
MDHAADAMKTDLMTITRFVLNEQSKHPESRGDFSILLSHIVLGCKFVCAAVNKAGLAKLIGLAGETNVQGEEQKKLDVLSNEVFVKALVSSGRTCILVSEEDEEAIFVEPSKRGKYCVVFDPLDGSSNIDCGVSIGTIFGVYMLKDGAESRLEDVLQPGKNMLAAGYCMYGSSCTFVLSTGSGVNGFTLDPSLGEFILTHPDIKIPKKGKIYSVNEGNAKNWDGPTAKFVEKCKFPKDGSPAKSLRYIGSMVADVHRTLLYGGVFLYPADKKSPSGKLRVLYEVFPMSFLMEQAGGQSFTGKERALDLVPKKIHERSPIFLGSYDDVEEIKALYAAEEKA

SEQ ID NO: 5856 - protein, 341 aa, Centaurea maculosa
MDHAADAFRTDLMTITRFVLNEQSKHPESRGDFSILLSHIVLGCKFVCSAVNKAGLAKLIGLAGETNVQGEEQKKLDVLSNEVFVKALVSSGRTCILVSEEDEDAIIVEPSKRGKYCVVFDPLDGSSNIDCGVSIGTIFGIYMIKDGGEPSLEDVLQPGKNMLAAGYCMYGSSCTLVLSAGSGVNGFTLDPSLGEFILTHPDIKIPKKGKIYSVNEGNAKNWDGPTAKYVEKCKFPTDGSPAKSLRYIGSMVADVHRTLLYGGIFLYPADKKSPNGKLRVLYEVFPMSFLMEQAGGQSFTGKERSLDLVPKKIHERSPIFLGSYDDVEEIKALYAAEEKKA

SEQ ID NO: 5857 - protein, 341 aa, Cephalotaxus harringtonia
MDHEADAYRTDLMTITRFVLNEQSRHPESRGDFTILLSHIVLGCKFVCSAVNKAGLAKLIGLAGETNVQGEEQKKLDVLSNEVFVKALVSSGRTCILVSEEDEEATFVDPSLRGKYCVVFDPLDGSSNIDCGVSIGTIFGIYSIKEGDEPTLADVLQPGKHMVAAGYCMYGSSCTLVLSTGSGVNGFTLDPSLGEFILTHPNIKVPKKGNIYSVNEGNAKNWDEPTKKYVERCKFPKDGTSPKSLRYIGSMVADVHRTLLYGGIFMYPADKKSPNGKLRVLYEVFPMSFLMEQAGGQSFTGKKRALDIVPSKIHERSSIFLGSYDDIEEIKALYAQEEAKA

SEQ ID NO: 5858 - protein, 341 aa, Gossypium raimondii
MDHAADAHRTDLMTITRFVLNEQSKYPESRGDFTILLNHIVLGCKFVCSAVNKAGLAKLIGLAGETNVQGEEQKKLDVLSNEVFVKALVSSGRTCILVSEEDEEATFVDPSKRGRYCVVFDPLDGSSNIDCGVSIGTIFGIYMMKDNHEPTLDDVLQPGKQMLAAGYCMYGSSCTLVLSTGEGVNGFTLDPSLGEFILTHPDIKIPKKGKIYSVNEGNAKNWDGPTAKYVEKCKFPKDGSSSKSLRYIGSMVADVHRTLLYGGIFLYPADKKSPSGKLRVLYEVFPMSFLMEQAGGQAFTGKQRALDLVPTKIHERSPIFLGSFDDVEDIKALYAAEGKKE

SEQ ID NO: 5859 - protein, 341 aa, Secale cereale
MDHAAEAQRTDLMTITRHALNEQGRHPESRGDFTILLSHIVLGCKFVASAVNKAGLAKLIGLAGETNIQGEEQKKLDVLSNEVFVKALVSSGRTCVLVSEENEAAIFVDAPLRGKYCVCFDPLDGSSNIDCGVSIGTIFGIYMIKDKDNATLEDVLQPGTDMIAAGYCMYGSSCTLVLSTGNGVNGFTLDPSLGEFILTHPNIKIPNKGKIYSVNEGNARNWDAPTAKYVERCKFPQDGSSPKSLRYIGSMVADVHRTLLYGGIFLYPADKKSPNGKLRVLYEVFPMSFLMEQAGGQSFTGKQRALEIVPSEIHQRSPIFLGSYDDVEEIKSLYASESSTA

SEQ ID NO: 5860 - protein, 340 aa, Triphysaria pusilla
MDHEADAYRTDLMTITRHVLNEQSKHPESRGDFTILLSHIVLGCKFVCSAVSKAGLAKLIGLAGETNVQGEEQKKLDVLSNEVFIKALVSSGRTCILVSEEDEEATFVEPSHRGKYCVVFDPLDGSSNIDCGVSIGTIFGIYAIYDGHDPKLEDVLQPGKNMLAAGYCMYGSSCTFVLSTGSGVNGFTLDPSLGEFILTHPDIKIPKKGKIYSVNEGNAKNWDGPTAKYVEKCKYPTDGSPAKSLRYIGSMVADVHRTLLYGGYFLYPADKKSPNGKLRVLYEVFPMSFLMEQAGGQAFTGKERALDLLPQKIHDRSPIFLGSYDDIEEIKALYAAEEQK

SEQ ID NO: 5861 - protein, 214 aa, Tragopogon dubius
MDHESDAFRTDLMTITRFVLNEQSKHPESRGDFSILLSHIVLGCKFVCAAVNKAGLAKLIGLAGETNVQGEEQKKLDVLSNQVFVKALVSSGRTCILVSEEDEEAIFVEPSKRGKYCVVFDPLDGSSNIDCGVSIGTIFGIYMIKDGDEARIEDVLQPGKNMLAAGYCMYGSSCTLVLSTGSGVNGFTLDPSLGEFILTHPDIKIPKKGKDLFG

SEQ ID NO: 5862 - protein, 340 aa, Chrysanthemum coronarium
MDHEADAFRTDLMTITRFVLNEQSKHPESRGDFSILLSHIVLGCKFVCAAVNKAGLAKLIGLAGETNVQGEEQKKLDVLSNEVFVKALVSSGRTCILVSEEDEEAIIVEPSKRGKYCVVFDPLDGSSNIDCGVSIGTIFGIYMIKDGDDPSLEDVLQPGKNMLAAGYCMYGSSCTFVLSTGSGVNGFTLDPSLGEFILTHPDIKIPKKGKIYSVNEGNAKNWDGPTAKFVEKCKYPTDGSSAKSLRYIGSMVADVHRTLLYGGVFLYPADKKSPSGKLRVLYEVFPMSFLMEQAGGQSFTGKIRSLDLVPKNIHERSPIFLGSYDDVEEIKALYAAEEKA

SEQ ID NO: 5863 - protein, 338 aa, Chrysanthemum coronarium
HEADAFRTDLMTITRFVLNEQSKHPESRGDFSILLSHIVLGCKFVCAAVNKAGLAKLIGLAGETNVQGEEQKKLDVLSNQVFVKALVSSGRTCILVSEEDEEAIIVEPSKRGKYCVVFDPLDGSSNIDCGVSIGTIFGIYMIKDGDDPSLEDVLQPGKNMLAAGYCMYGSSCTFVLSTGSGVNGFTLDPSLGEFILTHPDIKIPKKGKIYSVNEGNAKNWDGPTAKFVEKCKYPTDGSSAKSLRYIGSMVADVHRTLLYGGVFLYPADKKSPTGKLRVLYEVFPMSFLMEQAGGQSFTGKERALDLVPKKIHERSPIFLGSYDDVEEIKALYAAEEKA

SEQ ID NO: 5864 - protein, 341 aa, Theobroma cacao
MDHAADAHRTDLMTITRYVLNEQSKYPESRGDFTILLNHIVLGCKFLCSAVNKAGLAKLIGLAGETNVQGEEQKKLDVLSNEVFIKALVSSGRTCILVSEEDEEATFVEPSKRGRYCVVFDPLDGSSNIDCGVSIGTIFGIYMVKDSHEPTLDDVLQPGKHMLAAGYCMYGSSCTLVLSTGEGVHGFTLDPSLGEFILTHPDIKIPKKGKIYSVNEGNAKNWDGPTAKYVEKCKFPKDGSSSKSLRYIGSMVADVHRTLLYGGIFLYPADKKSPNGKLRVLYEVFPMSFLMEQAGGQAFTGKQRALDLVPTKIHERSPIFLGSYDDVEEIKALYAAEGKKE

SEQ ID NO: 5865 - protein, 340 aa, Sesamum indicum
MDHAAEAHRTDLMTITRYVLNEQSKHPESRGDFTILLNHIVLGCKFVCSAVNKAGLAKLIGLAGETNVQGEEQKKLDVLSNEVFIKALVSSGRTCILVSEEDEEATFVEPSKRGRYCVVFDPLDGSSNIDCGVSIGTIFGIYMIKEGGEPKLEDVLQPGKNMLAAGYCMYGSSCTLVLSTGAGVNGFTLDPSLGEFILTHPDIKIPKKGKIYSVNEGNAKNWDGPTAKYVEKCKFPKDGSPAKSLRYIGSMVADVHRTLLYGGIFLYPADKKSPNGKLRVLYEVFPMSFLMEQAGGQAFTGKQRALDLVPKKIHERSPIFLGSYDDVEEIKALYAAEEPK

SEQ ID NO: 5866 - protein, 340 aa, Triphysaria pusilla
MDHAADAYRTDLMTITRHVLNEQSKHPESRGDFTILLSHIVLGCKFVCSAVSKAGLAKLIGLAGETNVQGEEQKKLDVLSNEVFIKALVSSGRTCILVSEEDEEATFVEPSHRGKYCVVFDPLDGSSNIDCGVSIGTIFGIYAIYDGHDPKLEDVLQPGKNMLAAGYCMYGSSCTFVLSTGSGVHGFTLDPSLGEFILTHPDIKIPKKGKIYSVNEGNAKNWDGPTAKYVEKCKYPTDGSPAKSLRYIGSMVADVHRTLLYGGVFLYPADKKSPNGKLRVLYEVFPMSFLMEQAGGQAFTGKERALDLLPQKIHDRSPIFLGSYDDIEDIKALYAAEEQT

SEQ ID NO: 5867 - protein, 238 aa, Ambrosia trifida
MDHEADAFRTDLMTITRFVLNEQSKYPESRGDFSILLSHIVLGCKFVCAAVNKAGLAKLIGLAGETNVQGEEQKKLDVLSNEVFVKALVSSGRTCILVSEEDEEAIIVEPSKRGKYCVVFDPLDGSSNIDCGVSIGTIFGIYMIKDAGAARLEDVLQPGKNMVAAGYCMYGSSCTLVLSTGSGVNGFTLDPSLGEFILTHPDIKIPNKGKIYSVNEGNSQELGWSYRKVCRKMQVPQG

SEQ ID NO: 5868 - protein, 75 aa, Valeriana officinalis
MDHAADAHRTDLMTITRFVLNEQSKHPESRGDFSILLSHIVLGCKFVCSAVNKAGLAKLIGLAGETNVQGEEQRN

SEQ ID NO: 5869 - protein, 81 aa, Flaveria ramosissima
MLLMPPYGLMTITRFVLNEQSKHPESRGDFSILLSHIVLDASLFVLLLIRQVWQNSLDLQGRLMCREKSRRNWMFCRMKFL

SEQ ID NO: 5870 - protein, 340 aa, Solanum tuberosum
MDHAADAHRTDLMTITRFVLNEQSKYPESRGDFTILLSHIVLGCKFVCTAVNKAGLAKLLGLAGETNVQGEDQKKLDVLSNEVFIKALVSSGRTCILVSEEDEEATFVEPSKRGKYCVVFDPLDGSSNIDCGVSIGTIFGIYMMKDVHEPTLDDVLQPGKNMLAAGYCMYGSSCTLVLSTGKGVNGFTLDPSLGEFILTHPDIKIPKKGKIYSVNEGNAKNWDGPTSKYVESCKFPKDGSSPKSLRYIGSMVADVHRTLLYGGIFLYPADKKSPNGKLRVLYEVFPMSFLMEQAGGQAFTGKERALDLVPTKIHERAPIFLGSYDDVEEIKRLYAAEEKN

SEQ ID NO: 5871 - protein, 340 aa, Solanum lycopersicum
MDHAADAHRTDLMTITRFVLNEQSKYPESRGDFTILLSHIVLGCKFVCTAVNKAGLAKLLGLAGETNVQGEDQKKLDVLSNEVFIKALVSSGRTCILVSEEDEEATFVEPSKRGKYCVVFDPLDGSSNIDCGVSIGTIFGIYMMKDVHEPTLDDVLQPGKNMLAAGYCMYGSSCTLVLSTGKGVNGFTLDPSLGEFILTHPDIKIPKKGKIYSVNEGNAKNWDGPTSKYVESCKFPTDGSSPKSLRYIGSMVADVHRTLLYGGIFLYPADKKSPNGKLRVLYEVFPMSFLMEQAGGQAFTGKERALDLVPTKIHERAPIFLGSYDDVEEIKRLYAAEEKN

SEQ ID NO: 5872 - protein, 342 aa, Aristolochia fimbriata
MDHAADAHRTDLMTITRFVLNEQSKHPESRGDFTILLSHIVLGCKFVCTAVNKAGLAKLIGLAGETNVQGEEQKKLDVLSNEVFVKALVSSGRTSILVSEEDEEATFVEASKRGRYCVVFDPLDGSSNIDCGVSIGTIFGIYMLKDTNDPKLEEVLQPGKNMLAAGYCMYGSSCTLVLSTGSGVNGFTLDPSLGEFILTHPDIKIPKKGKIYSVNEGNAKNWDEPTSKYVEKCKFPKDGSSPKSLRYIGSMVADVHRTLLYGGIFLYPGDKKSPNGKLRVLYEVFPMSFLMEQAGGQAFTGKERALDLIPTKIHQRSPIFLGSYDDVEEIKALYAAAAEKTA

SEQ ID NO: 5873 - protein, 342 aa, Theobroma cacao
MDHAADAHRTDLMTITRHVLNEQSKYPESRGDFTILLSHIVLGCKFVCSAVSKAGLAKLIGLAGETNVQGEEQKKLDVLSNEVFVKALISSGRTCILVSEEDEEATFVEPSKRGRYIVVFDPLDGSSNIDCGVSIGTIFGIYLVKDKDNPTLDDVLQPGRNLLAAGYCMYGSSCTLVLSTGSGVNGFTLDPSLGEFILTHPDMKIPKKGKIYSVNEGNAKNWDEPTTRFVEKCKFPTDGSPPKSLRYVGSMVADVHRTLLYGGIFLYPADKKSPNGKLRVLYEVFPMSYLMEQAGGQAFNGKQRALDLVPKKIHERSPVFLGSYDDVEEIKALYAAAEENNA

SEQ ID NO: 5874 - protein, 341 aa, Centaurea maculosa
  Sequence also found in Organisms: Cirsium arvense
MDHNADAFRTDLMTITRFVLNEQSKHPESRGDFSILLSHIVLGCKFVCSAVNKAGLAKLIGLAGETNVQGEEQKKLDVLSNEVFVKALVSSGRTCILVSEEDEDAIIVEPSKRGKYCVVFDPLDGSSNIDCGVSIGTIFGIYMIKDGGEPSLEDVLQPGKNMLAAGYCMYGSSCTLVLSAGSGVNGFTLDPSLGEFILTHPDIKIPKKGKIYSVNEGNAKNWDGPTAKYVEKCKFPTDGSSAKSLRYIGSMVADVHRTLLYGGIFLYPADKKSPNGKLRVLYEVFPMSFLMEQAGGQSFTGKERSLDLVPKKIHERSPIFLGSYDDVEEIKALYAAEEKKA

SEQ ID NO: 5875 - protein, 340 aa, Prunus mume
MDHAADAHRTDLMTITRFVLNEQSKHPESRGDFTILLNHIVLGCKFVCSAVNKAGLAKLIGLAGETNVQGEEQKKLDVLSNEVFVKALVSSGRTSILVSEEDEEAIFVEPSKRGKYCVVFDPLDGSSNIDCGVSIGTIFGIYVVKDGIEPTLHDVLQPGKNMVAAGYCMYGSSCTFVLSTGTGVHGFTLDPSLGEFILTHPDIQIPKKGKIYSVNEGNAKNWDGPTAKYVEKCKYPKDGSSPKSLRYIGSMVADVHRTLLYGGIFLYPADKKSPNGKLRVLYEVFPMSFLMEQAGGQSFTGKERALDLVPNKIHERSPIFLGSYDDVEEIKTLYAAEGKK

SEQ ID NO: 5876 - protein, 340 aa, Solanum phureja
MDHAADAHRTDLMTITRFVLNEQSKYPESRGDFTILLSHIVLGCKFVCTAVNKAGLAKLLGLAGETNVQGEDQKKLDVLSNEVFIKALVSSGRTCILVSEEDEEATFVEPAKRGKYCVVFDPLDGSSNIDCGVSIGTIFGIYMMKDVHEPTLDDVLQPGKNMLAAGYCMYGSSCTLVLSTGKGVNGFTLDPSLGEFILTHPDIKIPKKGKIYSVNEGNAKNWDGPTSKYVESCKFPKDGSSPKSLRYIGSMVADVHRTLLYGGIFLYPADKKSPNGKLRVLYEVFPMSFLMEQAGGQAFTGKERALDLVPTKIHERAPIFLGSYDDVEEIKRLYAAEEKN

SEQ ID NO: 5877 - protein, 340 aa, Capsicum annuum
MDHAADAHRTDLMTITRFVLNEQTKYPESRGDFTILLSHIVLGCKFVCTAVNKAGLAKLLGLAGETNVQGEDQKKLDVLSNEVFIKALVSSGRTCILVSEEDEEATFVEPAKRGKYCVVFDPLDGSSNIDCGVSIGTIFGIYMMKDAHEPTLDDVLQPGKNMLAAGYCMYGSSCTLVLSTGKGVNGFTLDPSLGEFILTHPEIKIPKKGKIYSVNEGNAKNWDGPTSKYVESCKFPEDGSSPKSLRYIGSMVADVHRTLLYGGIFLYPADKKSPNGKLRVLYEVFPMSFLMEQAGGQAFTGKERALDLVPTKIHERAPIFLGSYDDVEEIKKLYAAEEKN

SEQ ID NO: 5878 - protein, 341 aa, Hordeum vulgare
MDHAAEAQRTDLMTITRHALNEQGRHPESRGDFTILLSHIVLGCKFVASAVNKAGLAKLIGLAGDTNIQGEEQKKLDVLSNEVFVKALISSGRTCLLVSEENEAAIFVDAPLRGKYCVCFDPLDGSSNIDCGVSIGTIFGIYMIKDKDNATLEDVLQPGTDMIAAGYCMYGSSCTLVLSTGNGVNGFTLDPSLGEFILTHPNIKIPSKGKIYSVNEGNARNWDGPTAKYVERCKFPQDGSSPKSLRYIGSMVADVHRTLLYGGIFLYPADKKSPNGKLRVLYEVFPMSFLMEQAGGQSFTGKQRALEIVPCDIHQRSPIFLGSYDDVEEIKSLYASESSTA

SEQ ID NO: 5879 - protein, 340 aa, Coffea canephora
MDHSADAYRTDLMTITRFVLNEQSKHAESRGDFTILLSHIVLGCKFVCSAVNKAGLAKLIGLAGETNVQGEEQKKLDVLSNEVFVKALVSSGRTCILVSEEDELAIVVEPSKRGKYCVVFDPLDGSSNIDCGVSIGTIFGIYMIKDHSEPKLEDALQPGKDMVAAGYCMYGSSCTLVLSTGSGVNGFTLDPSLGEFILTHPDIKIPKKGKIYSVNEGNARNWDAPTAKYVEKCKFPKDGSSAKSLRYIGSMVADVHRTLLYGGIFLYPADKKSPNGKLRVLYEVFPMSFLMEQAGGQAFTGKERALDLVPKKIHERSPIFLGSYDDVEEVKALYAEEQKA

SEQ ID NO: 5880 - protein, 341 aa, Taraxacum officinale
MDHEADAFRTDLMTITRFVLNEQSKHPESRGDFSILLSNIVLGCKFVCSAVNKAGLAKLIGLAGETNVQGEEQKKLDVLSNEVFVKALVSSGRTSILVSEEDEEAIFVEKSKRGKYCVVFDPLDGSSNIDCGVSIGTIFGIYMIKDGNDACIEDVLQPGKEMLAAGYCMYGSSCTLVLSTGSGVNGFTLDPSLGEFILTHPDIKIPKKGKIYSVNEGNAKNWDGPTAKYVERCKYPTDGSPAKSLRYIGSMVADVHRTLLYGGIFLYPADKKSPDGKLRVLYEVFPMSFLMEQAGGQSFTGKERSLDLVPKKIHERSPIFLGSYDDVEEIKALYAAEGKGN

SEQ ID NO: 5881 - protein, 341 aa, Citrus clementina
  Sequence also found in Organisms: Citrus sinensis
MDHEADAHRTDLMTITRFVLNEQSKHPESRGDFSILLSHIVLGCKFVCSAVNKAGLAKLIGLAGETNVQGEEQKKLDVLSNDVFVKALISSGRTCILVSEEDEEAIFVEPSKRGRYCVVFDPLDGSSNIDCGVSIGTIFGIYMMKDSHEPTLDDVLQPGNNMLAAGYCMYGSSCTLVLSTGSGVNGFTLDPSLGEFILTHPDIKIPKKGKIYSVNEGNAKNWDGPTAKYVEKCKFPKDGSSPKSLRYIGSMVADVHRTLLYGGIFMYPRDKKSPNGKLRVLYEVFPMSFLMEQAGGQSFTGKQRALDLVPKKIHERSPIFLGSYDDVEEIKALYAAEEKKE

SEQ ID NO: 5882 - protein, 341 aa, Platanus occidentalis
MDHAAEAYRTDLMTITRYVLNEQSKYPESRGDFTILLSHIVLGCKFVCTAVNKAGLAKLIGLAGETNVQGEEQKKLDVLSNEVFVKALISSGRTCILVSEEDEEATFVEPLLRGRYCVVFDPLDGSSNIDCGVSIGTIFGIYMMKDKGEPTLGDVLQPGKNMLAAGYCMYGSSCTFVLSTGNGVNGFTLDPSLGEFILTHPDIKIPKKGKIYSVNEGNAKNWDEPTSKYVEKCKFPKDGSSPKSLRYIGSMVADVHRTLLYGGIFLYPADKKSPNGKLRVLYEVFPMSFLMEQAGGQAFTGKQQALDLIPKKIHERSPIFLGSYDDVEEIKALYAVEEKIA

SEQ ID NO: 5883 - protein, 340 aa, Triphysaria pusilla
MDHEADAYRTDLMTITRHVLTEQSKHPESRGDFTIMLSHIVLGCKFVCSAVSKAGLAKLIGLAGETNVQGEEQKKLDVLSNEVFIKALVSSGRTCILVSEEDEEATFVEPSHRGKYCVVFDPLDGSSNIDCGVSIGTIFGIYAIYDGHDPKLEDVLQPGKNMLAAGYCMYGSSCTFVLSTGSGVHGFTLDPSLGEFILTHPDIKIPKKGKIYSVNEGNAKNWDGPTAKYVEKCKYPTDGSPAKSLRYIGSMVADVHRTLLYGGVFLYPADKKSPNGKLRVLYEVFPMSFLMEQAGGQAFTGKERALDLLPQKIHDRSPIFLGSYDDIEDIKALYAAEEQK

SEQ ID NO: 5884 - protein, 342 aa, Prunus persica
MDHAADAHRTDLMTITRFVLNEQSKHPESRGDFTILLNHIVLGCKFVCSAVNKAGLAKLIGLAGETNVQASGEEQKKLDVLSNEVFVKALVSSGRTSILVSEEDEEAIFVEPSKRGKYCVVFDPLDGSSNIDCGVSIGTIFGIYVVKDGIEPTLHDVLQPGKNMVAAGYCMYGSSCTFVLSTGTGVHGFTLDPSLGEFILTHPDIQIPKKGKIYSVNEGNAKNWDGPTAKYVEKCKYPKDGSSPKSLRYIGSMVADVHRTLLYGGIFLYPADKKSPNGKLRVLYEVFPMSFLMEQAGGQSFTGKERALDLVPNKIHERSPIFLGSYDDVEEIKTLYAAEGKK

SEQ ID NO: 5885 - protein, 340 aa, Cirsium arvense
MDHAADAFRTDLMTITRFVLNEQSKHPESRGDFSILLSHIVLGCKFVCAAVNKAGLAKLIGLAGETNVQGEEQKKLDVLSNEVFVKALVSSGRTCILVSEEDEDAIIVEPSKRGKYCVVFDPLDGSSNIDCGVSIGTIFGIYMIKDGGEPSLEDVLQPGKNMLAAGYCMYGSSCTLVLSTGSGVNGFTLDPSLGEFILTHPNIKIPKKGKIYSVNEGNAKNWDGPTAKYVEKCKFPTDGSSAKSLRYIGSMVADVHRTLLYGGIFLYPADKKSPDGKLRVLYEVFPMSFLMEQAGGQSFTGKERSLDLVPKKIHERSPIFLGSYDDVDEIKALYAAEEKV

SEQ ID NO: 5886 - protein, 341 aa, Distylium racemosum
MDHAADAFRTDLMTITRFVLNEQSKHPESRGDFTILLNHIVLGCKFVCSAVNKAGLAKLIGLAGETNVQGEEQKKLDVLSNEVFVKALVSSGRTCILVSEEDEEATFVEHSLRGKYCVVFDPLDGSSNIDCGVSIGTIFGIYLIKDGGEPTLADVLQPGKNMVAAGYCMYGSSCTLVLSTGSGVNGFTLDPSLGEFILTHPNIKIPKKGKIYSVNEGNAKNWDEPTKKYVERCKFPKDGSSPKSLRYIGSMVADVHRTLLYGGIFMYPADKKSPNGKLRVLYEVFPMSFLMEQAGGQAFTGKKRALDLVPSKIHERSSVFLGSYDDIEDVKALYAEQDKKA

SEQ ID NO: 5887 - protein, 340 aa, Solanum melongena
MDHAADAHRTDLMTITRFVLNEQSKYPESRGDFTILLNHIVLGCKFVCSAVNKAGLAKLLGLAGETNVQGEDQKKLDVLSNEVFIKALVSSGRTCILVSEEDEEATFVEPAKRGKYCVVFDPLDGSSNIDCGVSIGTIFGIYMMKDAHEPTLDDVLQPGKNMVAAGYCMYGSSCTLVLSTGRGVNGFTLDPSLGEFILTHPDIKIPKKGKIYSVNEGNAKNWDGPTSKYVESCKFPKDGSSPKSLRYIGSMVADVHRTLLYGGIFLYPADKKSPNGKLRVLYEVFPMSFLMEQAGGQAFTGKERALDLVPTKIHERAPVFLGSYDDVEEIKRLYAAEEKN

SEQ ID NO: 5888 - protein, 340 aa, Nicotiana benthamiana
MDHAADAHRTDLMTITRFVLNEQSKYPESRGDFTILLSHIVLGCKFVCTAVNKAGLAKLLGLAGETNVQGEDQKKLDVLSNEVFIKALVSSGRTCVLVSEEDEEATFVEPAKRGKYCVVFDPLDGSSNIDCGVSIGTIFGIYMMKDAHEPTLDDVLQPGKNMLAAGYCMYGSSCTLVLSTGKGVNGFTLDPSLGEFILTHPDIKIPKKGKIYSANEGNAKNWDGPTSKYVENCKFPKDGSSPKSLRYIGSMVADVHRTLLYGGIFLYPADKKSPNGKLRVLYEVFPMSFLMEQAGGQAFTGKQRALDLVPKKIHERAPIFLGSYDDVEEIKRLYAAEEKN

SEQ ID NO: 5889 - protein, 341 aa, Sequoia sempervirens
MDHAADAYRTDLMTITRFVLNEQSRYPESRGDFTILLSHIVLGCKFVCSAVNKAGLAKLIGLAGETNVQGEEQKKLDVLSNEVFVKALVSSGRTCILVSEEDEEATFVEPALRGKYCVVFDPLDGSSNIDCGVSIGTIFGIYSIKAGEEPKLEDVLQPGKHMVAAGYCMYGSSCTLVLSTGSGVNGFTLDPSLGEFILTHPDIKVPKKGKIYSVNEGNAKNWDEPTKKYVERCKFPKDGSSPKSLRYIGSMVADVHRTLLYGGIFMYPADKKSPNGKLRVLYEVFPMSFLMEQAGGQSFTGKKQALEIVPTKIHERSSVFLGSYDDVEEIKALYAQEEVKA

SEQ ID NO: 5890 - protein, 332 aa, Chrysanthemum coronarium
RTDLMTITRFVLNEQSKHPESRGDFSILLSHIVLGCKFVCAAVNKAGLAKLIGLAGETNVQGEEQKKLDVLSNQVFVKALVSSGRTCILVSEEDEEAIIVEPSKRGKYCVVFDPLDGSSNIDCGVSIGTIFGIYMIKDGDDPSLEDVLQPGKNMLAAGYCMYGSSCTFVLSTGSGVNGFTLDPSLGEFILTHPDIKIPKKGKIYSVNEGNAKNWDGPTAKFVEKCKYPTDGSSAKSLRYIGSMVADVHRTLLYGGVFLYPADKKSPTGKLRVLYEVFPMSFLMEQAGGQSFTGKERALDLVPKKIHERSPIFLGSYDDVEEIKALYAAEEKA

SEQ ID NO: 5891 - protein, 342 aa, Glycine max
MDHSADAHRTDLMTITRFVLNEQSKHPESRGDFTILLSHIVLGCKFVCSAVSKAGLAKLIGLAGETNVQGEEQKKLDVLSNEVFIKALISSGRTCILVSEEDEEAIIVEPSKRGKYCVCFDPLDGSSNIDCGVSIGTIFGVYALKDVHEPTIEDVLLPGKNMVAAGYCMYGSSCTLVLSTGAGVNGFTLDPSLGEFILTHPNIKIPKKGKIYSVNEGNAKNWDRPTATYVEKCKFPEDGSSPKSLRYIGSMVADVHRTLLYGGIFLYPADKKSPNGKLRVLYEVFPMSFLMEQAGGQSFTGKERALDLVPTKLHERSPIFLGSYDDVEEIKALYAAAEGEQE

SEQ ID NO: 5892 - protein, 334 aa, Conyza canadensis
PLRPDLMTITRFVLNEQSKHPESRGDFSILLSHIVLGCKFVCAAVNKAGLAKLIGLAGETNVQGEEQKKLDVLSNEVFVKALVSSGRTCILVSEEDEDAIIVEPSKRGKYCVVFDPLDGSSNIDCGVSIGTIFGIYMIKDGDEARLEDVLQPGKNMLAAGYCMYGSSCTFVLSTGSGVNGFTLDPSLGEFILTHPDIKIPKKGKIYSVNEGNAKNWDGPTAKFVEKCKFPTDGSSAKSLRYIGSMVADVHRTLLYGGVFLYPADKKSPNGKLRVLYEVFPMSFLMEQAGGQSFTGKERALDLVPKKIHDRSPIFLGSYDDVEEIKALYAAEEKA

SEQ ID NO: 5893 - protein, 340 aa, Nicotiana benthamiana
MDHSADAHRTDLMTITRFVLNEQSKHPESRGDFSILLSHIVLGCKFVCTAVNKAGLAKLLGLAGETNVQAKDQKKLDVLSNEVFIKALVSSGRTCVLVSEEDEEATFVEPAKRGKYCVVFDPLDGSSNIDCGVSIGTIFGIYMIKDGHQPTLDDVLQPGKNMLAAGYCMYGSSCTLVLSTGSGVNGFTLDPSLGEFILTHPDIKIPKKGKIYSVNEGNAKNWDGPTSKYVQNCKYPTDGSSPKSLRYIGSMVADVHRTLLYGGIFLYPADKKSPNGKLRVLYEVFPMSFLMEQAGGQSFTGKQRALDLVPKKIHERAPIFLGSYDDVEEIKKLYAAEEQN

SEQ ID NO: 5894 - protein, 341 aa, Gossypium raimondii
MDHAADAHRTDLMTITRHVLNEQTKYPESRGDFTILLNHIVLGCKFVCSSVSKAGLAKLFGLAGETNIQGEEQKKLDVLSNEVFVKALISSGRTCLLVSEEDEEAIFVDQSKRGKYIVVFDPLDGSSNIDCGVSIGTIFGIYMVKHKDNPTIDDVLQPGNNLVAAGYCMYGSSCTLVLSTGSGVNGFTLDPSLGEFILTHPDIKIPKKGKIYSVNEGNAKNWDEPTRKFVEKCKFPTDGSPPKSLRYIGSMVADVHRTLLYGGIFLYPADKKSPNGKLRVLYEVFPMSFLMEQAGGQAFTGKQRALDLVPGKIHERSPVFLGSYDDVEEIKALYAAADAAK

SEQ ID NO: 5895 - protein, 341 aa, Allium cepa
MDHAADAYRTDLMTITRFVLNEQSKRPESRGDFTILLSHIVLGCKFVCSAVNKAGLAKLIGLAGETNVQGEEQKKLDVLSNEVFVKALTSSGRTSILVSEEDEEATFVDPALRGKYCVVFDPLDGSSNIDCGVSIGTIFGIYLIKDKDQAKLEDVLQAGSNMVAAGYCMYGSFCELVISTGNGVNGFTLDPSLGEFILTHPDIKVPKKGKIYSVNEGNAKNWDGPTAKYVEKCKYPTDGSSPKSLRYVGSMVADVHRTMLYGGIFLYPADKKSPDGKLRVLYEVFPMSFLMEQAGGQAFTGKERALDLVPKQIHERSPIFLGSYDDVEEIKALYAAEKIEG

SEQ ID NO: 5896 - protein, 340 aa, Lotus japonicus
MDHSEEAHRTDLMTITRFVLNEQSKHPESRGDFSILLSHIVLGCKFVCSAVSKAGLAKLIGLAGETNVQGEEQKKLDVLSNEVFIKALVSSGRTSILVSEEDEEATFVEASKRGKYCVVFDPLDGSSNIDCGVSIGTIFGIYMVKDQEPTIGDVLQPGKNMLAAGYCMYGSSCTLVISTGSGVNGFTLDPSLGEFILTHPGIKIPKKGKIYSVNEGNAKNWDGPTAKYVEKCKYPTDGSSPKSLRYIGSMVADVRRTLLYGGVFLYPADKKSPNGKLRVLYEVFPMSFLLEQAGGQSITGKQRALDLVPTKLHERSPIFLGSYDDVEEIKALYAAEEEKK

SEQ ID NO: 5897 - protein, 339 aa, Arachis hypogaea
MDHSADAHRTDLMTITRFVLNEQSKHPESRGDFTILLSHIVLACKFVCSSVNKAGLAKLIGLAGETNVQGEEQKKLDVLSNEVFIKALISSGRTSILVSEEDEEATFVEPSLRGKYCVVFDPLDGSSNIDCGVSIGTIFGIYMVNDVNEPTLEDVLQPGKNMLAAGYCMYGSSCTFVLTTGSGVNGFTLDPSLGEFILTHPDIKIPKKGKIYSVNEGNAKNWDGPTAFYVERCKFPKDGSSPKSLRYIGSMVADVHRTLLYGGIFLYPADKKSPNGKLRVLYEVFPMSFLMEQAGGQAFTGKQRALDLIPKKLHERSPIFLGSYDDVEEIKALYAAEAK

SEQ ID NO: 5898 - protein, 341 aa, Populus trichocarpa
MDHAADAHRTDLMTITRFVLNEQSKYPESRGDFSILLNHIVLGCKFVCSVVNKAGLAKIIGLAGETNVQGEEQKKLDVLSNEVFIKALVSSGRTCILVSEEDEEATFVEPSRRGRYCVVFDPLDGSSNIDCGVSIGTIFGIYMVKDDHEPTLDDVLQPGKNMLAAGYCMYGSSCTFVLSTGTGVNGFTLDPSLGEFILTHPDIKIPKKGKIYSVNEGNVRNWDGPTAKYVEKCKFPQDGSSAKSLRYIGSMVADVHRTLLYGGIFLYPADKKSPNGKLRVLYEVFPMSFLMEQAGGQAFTGKQRALDLVPTKIHERSPIFLGSYDEVEEIKALYAAEEKKA

SEQ ID NO: 5899 - protein, 340 aa, Solanum tuberosum
  Sequence also found in Organisms: Solanum phureja
MDHAADAHRTDLMTITRFVLNEQTKHPESRGDFSILLSHIVLGCKFVCTAVNKAGLAKLLGLAGETNVQGEDQKKLDVLSNEVFIKALVSSGRTCILVSEEDEEATFVEPANRGKYCVVFDPLDGSSNIDCGVSIGTIFGIYMIKDGHEPTLDDVLQPGMNMLAAGYCMYGSSCTLVLSTGSGVNGFTLDPSLGEFILTHPDIKIPKKGKIYSVNEGNAKNWDGPTSKYVQSCKYPADGSSPKSLRYIGSMVADVHRTLLYGGIFLYPGDKKSPNGKLRVLYEVFPMSFLMEQAGGQAFTGKQRALDLVPEKIHERSPIFLGSYDDVEEIKKLYAAEEQN

SEQ ID NO: 5900 - protein, 340 aa, Fagus grandifolia
MDHAAEAHRTDLMTITRYVLNEQSKHPESRGDFTILLSHIVLGCKFVCSAVSKAGLAKLIGLAGETNVQGEEQKKLDVLSNEVFIKALVSSGRTCILVSEEDEVATFVEPSKRGRYAVVFDPLDGSSNIDCGVSIGTIFGIYMVKDSQEPTLDEVLQPGKNMLAAGYCMYGSSCTFVLSTGTGVNGFTLDPSLGEFILTHPDIKIPKKGKIYSVNEGNAKNWDGPTAKYVEKCKFPKDGSSPKSLRYIGSMVADVHRTLLYGGIFLYPADKKSPNGKLRVLYEVFPMSFLMEQAGGQAFTGKQRALDLVPTNIHERSPIFLGSYDDVEEVKALYDAEDKE

SEQ ID NO: 5901 - protein, 341 aa, Euphorbia peplus
MDHEADAYRTDLMTITRFVLNEQSRHPDSRGDFTILLSNIVLGCKFVCTAVNKAGLAKLIGLAGETNVQGEEQKKLDVLSNEVFVKALVSSGRTCILVSEEDEEPTYVEASKRGKYCVVFDPLDGSSNIDCGVSIGTIFGIYMVKHSNTPTLEDVLQPGSNMVAAGYCMYGSSCTLVLSTGSGVNGFTLDPSLGEFILTHPDVKIPKKGKIYSVNEGNAKNWDGPTAKYVEKCKYPTDGSPAKSLRYIGSMVADVHRTLLYGGIFLYPADKKSPNGKLRVLYEVFPMSFLMEQAGGQAFTGKIRALDLEPEKIHERSPIFLGSYDDVEEIKALYAAEGQSA

SEQ ID NO: 5902 - protein, 340 aa, Panax ginseng
MDHAADAFQTDLMTITRFVLNEQSKYPESRGDFSILLSHIVLGCKFVCSAVNKAGLAKLIGLAGETNVQGEEQKKLDVLSNEVFVKALISSGRTCILVSEEDEEATFVEKPKRGRYCVVFDPLDGSSNIDCGVSIGTIFGIYMMKHGEEPTLEGVLQPGKNMLAAGYCMYGSSCTFVLSTGSGVNGFTLDPSLGEFILTHPDIKIPKKGKIYSVNEGNAKNWDGPTAKYVEKCKFPKDGSSAKSLRYIGSMVADVHRTLLYGGIFLYPADKKSPSGKLRVLYEVFPMSFLMEQAGGQAFTGKERALDLVPKKIHERSPIFLGSYDDVEEIKALYSADETK

SEQ ID NO: 5903 - protein, 338 aa, Taxus baccata
FADAQRTDLMTITRYVLNEQTRYPESRGDFTILLSHIVLGCKFVCSAVNKAGLAKLIGLAGETNVQGEEQKKLDVLSNEVFVKALVSSGRTCILVSEENEEATFVDPSLRGKYCVVFDPLDGSSNIDCGVSIGTIFGIYSIKDGDEPKLADVLQPGKHMVAAGYCMYGSSCTLVLSTGSGVNGFTLDPSLGEFILTHPDIKVPKKGQIYSVNEGNAKNWDEPTTKYVERCKFPKDGSSPKSLRYIGSMVADVHRTLLYGGIFMYPADKKSPNGKLRVLYEVFPMSFLTEQAGGQSFTGKKRALDIVPNKIHERSAIFLGSYDDIEEIKALYAQEEAKA

SEQ ID NO: 5904 - protein, 341 aa, Amorphophallus konjac
MDHEADAHRTDLMTLTRHVLNEQSKYPEAKGDCTILLSHIVLGCKFVCAAVNKAGLAKLIGLAGETNVQGEEQKKLDVLSNEVFVKALISSGRTCVLVSEEDEEATFVDPSLRGRYCVVFDPLDGSSNIDCGVSIGTIFGIYMVKDKDKVTIEDVLQPGKDMVAAGYCMYGSSCMLVLSTGNGVNGFTLDPSLGEFILTHPGIKIPKKGNIYSVNEGNAKNWDGPTAKYVERCKFPEDGSSPKSLRYVGSMVADVHRTLLYGGIFLYPADKKSPDGKLRVLYEVFPMSFLMEKAGGQAFTGKQRALDLVPTTIHQRSPIFIGSYDDVEDIKALYASGETKA

SEQ ID NO: 5905 - protein, 341 aa, Gossypium hirsutum
MDHAADAHRTDLMTITRHVLNEQTKYPESRGDFTILLNHIVLGCKFVCSSVSKAGLAKLFGLAGETNIQGEEQKKLDVLSNEVFVKALISSGRTCLLVSEEDEEAIFVDQSKRGKYIVVFDPLDGSSNIDCGVSIGTIFGIYMVKHKDNPTIDDVLQPGNNLVAAGYCMYGSSCTLVLSTGSGVNGFTLDPSLGEFILTHPDIKIPKKGKIYSVNEGNAKNWDEPTRKFVEKCKFPTDGSPPKSLRYIGSMVADVHRTLLYGGIFLYPADKKSPNGKLRVLYEVFPMSYLMEQAGGQAFTGKQRALDLVPGKIHERSPVFLGSYDDVEEIKALYAAADAAK

SEQ ID NO: 5906 - protein, 341 aa, Sciadopitys verticillata
MDHAADAYRTDLMTITRFVLNEQSKHPESRGDFTILLSHIVLGCKFVCTAVNKAGLAKLIGLAGETNVQGEEQKKLDVLSNEVFVKALISSGRTCILVSEEDEEATFVEPALRGKYCVVFDPLDGSSNIDCGVSIGTIFGIYLVKDGGEPTIADVLRPGKNMVAAGYCMYGSSCTLVLSTGSGVNGFTLDPSLGEFILTHPAIMVPKKGKIYSVNEGNAKNWDEPTKKYVEKCKFPKDGSSSKSLRYIGSMVADVHRTLLYGGIFMYPADKKSPSGKLRVLYEVFPMSFLMEQAGGQSFTGKKRALDIVPTKIHERSSVFLGSYDDVEEIKALYAEEVAKA

SEQ ID NO: 5907 - protein, 339 aa, Cyclamen graecum
MDHAAEAHRTDLMTITRFVLNEQSKHPESRGDFSILMSHIVLGCKFVCSAVNKAGLAKLIGLAGETNIQGEEQKKLDVLSNEVFVKALVSSGRTCILVSEEDEEAIFVDPSIRGRYCVVFDPLDGSSNIDCGVSIGTIFGIYMIKDSGEPSLDDVLQPGKNMIAAGYCMYGSSCTLVLSTGSGVNGFTLDPSLGEFILTHADIKIPKKGKIYSVNEGNAKNWDAPTAKYVESCKFPKDGSPAKSLRYIGSMVADVHRTLLYGGIFLYPADKKSPSGKLRVLYEVFPMSFLMEQAGGQAFTGKEQALDMVPKKIHERSPIFLGSYDEVEEIKALYAAEEN

SEQ ID NO: 5908 - protein, 340 aa, Capsicum annuum
MDHAADAHRTDLMTITRFVLNEQTKHPESRGDFSILLSHIVLGCKFVCSAVNKAGLAKLLGLAGETNVQGEDQKKLDVLSNEVFIKALVSSGRTCILVSEEDEEATFVEPAKRGKYCVVFDPLDGSSNIDCGVSIGTIFGICMIKEGHEPNLEDVLQPGMNMLAAGYCMYGSSCTLVLSTGSGVNGFTLDPSLGEFILTHPDIKIPKKGKIYSVNEGNAKNWDGPTTKYVQSCKYPTDGSSPKSLRYIGSMVADVHRTLLYGGIFLYPGDKKSPNGKLRVLYEVFPMSFLMEQAGGQAFTGKQRALDLVPEKIHERSPIFLGSYDDVEEIKKLYAAEEKN

SEQ ID NO: 5909 - protein, 335 aa, Populus trichocarpa
MDHSADAHRTDLMTITRFVLNEQSKYPESLGDFSILLNHIVLGCKFVCSAVNKAGLAKLIGLAGETNVQGEEQKKLDVLSNEVFIKALVSSGRTCILVSEEDDEATFVEPSRRGRYCVVFDPLDGSSNIDCGVSIGTIFGIYMVKDGHEPTLNDVLQPGKNMLAAGYCMYGSSCMLVLSTGSGVNGFTLDPSLGEFILTHPEIKIPKKGKIYSVNEGNAINWDGPTAKYVEKCKFPEDGSSAKSLRYVGSMVADVHRTLLYGGIFLYPADKKSPNGKLRVLYEVFPMSFLMEQAGGQAFTGKQRALDLVPTKIHERSPIFLGSYDDVEEIKALYI

SEQ ID NO: 5910 - protein, 341 aa, Aquilegia formosa
MDHESATHNTDIMTITRHVLNEQSKYPESRGDFSILLSHIVLGCKFVCSAVNKAGLAKLIGLAGETNVQGEEQKKLDVLSNEVFVKALVSSGRTCILVSEEDEEAIFVEPSKRGKYCVVFDPLDGSSNIDCGVSIGTIFGIYMIKDGGEPVLEDVLQSGKHMVAAGYCMYGSSCTFVLSTGSGVNGFTLDPSLGEFIMTHPDIKIPKKGKIYSVNEGNAKNWDGPTTKYVEKCKFPTDGSSPKSLRYIGSMVADVHRTLLYGGVFLYPGDKKSPNGKLRVLYEVFPMSFLMEQAGGQAFTGKERALDLVPKKIHERSPIFLGSYDDIEEIKALYAAEQKTA

SEQ ID NO: 5911 - protein, 340 aa, Solanum lycopersicum
MDHAADAHRTDLMTITRFVLNEQTKHPESRGDFSILLSHIVLGCKFVCTAVNKAGLAKLLGLAGETNVQGEDQKKLDVLSNEVFIKALVSSGRTCILVSEEDEEATFVEPANRGKYCVVFDPLDGSSNIDCGVSIGTIFGIYMIKDGHEPTLDDVLQPGMNMLAAGYCMYGSSCTLVLSTGSGVNGFTLDPSLGEFILTHADIKIPKKGKIYSVNEGNAKNWDGPTSKYVQNCKYPADGSSPKSLRYIGSMVADVHRTLLYGGIFLYPGDKKSPNGKLRVLYEVFPMSFLMEQAGGQAFTGKQRALDLVPEKIHERSPIFLGSYDDVEEIKNLYAAEEQN

SEQ ID NO: 5912 - protein, 341 aa, Lupinus angustifolius
MDHSADAFRTDLMTITRFVLNEQSKHPESRGDFSILLSHIVLGCKFVCSAVNKAGLAKLIGLAGETNVQGEEQKKLDVLSNEVFVKALISSGRTCILVSEEDEDAIFVEPSKRGKYAVVFDPLDGSSNIDCGVSIGTIFGIYALKDNHEPTIEDVLQPGKNMVAAGYCMYGSSCTLVLSTGSGVNGFTLDPSLGEFILTHPDIKIPKKGNIYSANEGNAKNWDSPTATYVEKCKFPKDGSSPKSLRYIGSMVADVHRTLLYGGIFLYPADKKSPNGKLRVLYEVFPMSFLMEQAGGQSFTGKERALDLIPTKLHERSPIFLGSYDDVEEIKTLYAAEAKQE

SEQ ID NO: 5913 - protein, 338 aa, Cajanus cajan
MDHTADAQRTDLMTITRFVLNEQSKRPESRGDFTILLSHIVLGCKFVCSAVNKAGLAKLIGLAGETNVQGEEQKKLDVLSNDVFIKALISSGRTCILVSEEDEEATFVEPSKRGKYCVVFDPLDGSSNIDCGVSIGTIFGIYLVKEDREPTIEDVLQPGKNMLAAGYCMYGSSCTLVLTTGSGVNGFTLDPSLGEFILTHPDIKIPKKGKIYSVNEGNAKNWDGPTTKYVEKCKFPKDGSSSKSLRYIGSMVADVHRTLLYGGIFLYPADKKSPNGKLRVLYEVFPMSFLMEQAGGQAFTGKERALDLVPKKLHERSPIFLGSYEDVEEIKALYAAQE

SEQ ID NO: 5914 - protein, 341 aa, Papaver somniferum
MDHAAEAHMTDLMTITRFVLNEQSKHPESRGDFSILLSHIVLGCKFVCAAVNKAGLAKLIGLAGETNVQGEEQKKLDVLSNDVFVKALVSSGRTSILVSEEDEEATFVDPALRGRYCVVFDPLDGSSNIDCGVSIGTIFGIYMMKANEEPHLEDVLQPGKNMLAAGYCMYGSSCTFVLSTGTGVNGFTLDPSLGEFIMTHPDIKIPKKGKIYSVNEGNAKNWDTPTAKYVERCKYPQDGSSPKSLRYIGSMVADVHRTLLYGGIFMYPADKKSPSGKLRVLYEVFPMSFLMEQAGGQAFTGKERALDLVPKKIHERSPIFLGSYDDVEEIKVLYAAEEKKA

SEQ ID NO: 5915 - protein, 341 aa, Fragaria vesca
MDHEADAYRTDLMTMTRFVLNEQSKHPESRGDFTILLSHIVLGCKFVCSAVNKAGLAKLIGLAGETNVQGEEQKKLDVLSNEVFVKALVSSGRTCILVSEEDEDAIFVEPSKRGKYCVVFDPLDGSSNIDCGVSIGTIFGIYALYDGGEPKLDDVLQPGKNMVAAGYCMYGSSCTFVLTTGSGVHGFTLDPSLGEFILTHPDIKIPKKGKIYSVNEGNAKNWDGPTAKYVEKCKFPTDGSPPKSLRYIGSMVADVHRTLLYGGIFLYPGDKKSPNGKLRVLYEVFPMSFLLEQAGGQAFTGKERALDLVPKKIHERSPIFLGSYDDVEEIKALYAAEEKKE

SEQ ID NO: 5916 - protein, 340 aa, Trifolium pratense
MDHSADAQRTDLMTITRFVLNEQSKYPESRGDFTILLSHIVLGCKFGCSAVNKAGLAKLIGLAGETNVQGEEQKKLDVLSNEVFCKALISSGRTSILVSEEDEDAIFVQPSLRGKYCVVFDPLDGSSNIDCGVSIGTIFGIYMMKDSHEPVIEDVLQPGKNLLAAGYCMYGSSCTLVISTGSGVNGFTLDPSLGEFILTHPDIKIPKKGKIYSVNEGNAKNWDGPTASYVEKCKFPTDGSPAKSLRYIGSMVADVHRTLLYGGTFLYPADKKSPNGKLRVLYEVFPMSFLMEQAGGQAFTGKERALDLIPTKLHERSPIFLGSYDDIEEIKALYAAEEGK

SEQ ID NO: 5917 - protein, 340 aa, Trifolium pratense
MDHSADAQRTDLMTITRFVLNEQSKHPESRGDFTILLSHIVLGCKFVCSAVNKAGLAKLIGLAGETNVQGEEQKKLDVPSNEVFCKALISSGRTSILVSEEDEDAIFVQPSLRGKYCVVFDPLDGSSNIDCGVSIGTIFGIYMMKDSHEPVIEDVLQPGKNLLAAGYCMYGSSCTLVISTGSGVNGFTLDPSLGEFILTHPDIKIPKKGKIYSVNEGNAKNWDGPTASYVEKCKFPTDGSPAKSLRYIGSMVADVHRTLLYGGTFLYPADKKSPNGKLRVLYEVFPMSFLMEQAGGQAFTGKERALDLIPTKLHERSPIFLGSYDDIEEIKALYAAEEGK

SEQ ID NO: 5918 - protein, 340 aa, Trifolium pratense
MDHSADAQRTDLMTITRFVLNEQSKYPESRGDFTILLSHIVLGCKFVCSAVNKAGLAKLIGLAGETNVQGEEQKKLDVLSNEVFCKALISSGRTSILVSEEDEDAIFVQPSLRGKYCVVFDPLDGSSNIDCGVSIGTIFGIYMMNDNHEPIIEDVLQPGKNMLAAGYCMYGSSCTFVITTGSGVNGFTLDPSLGEFILTHPDIKIPKKGKIYSVNEGNAKNWDGPTASYVEKCKFPTDGSPAKSLRYIGSMVADVHRTLLYGGTFLYPADKKSPNGKLRVLYEVFPMSFLMEQAGGQAFTGKERALDLVPTKLHERSPIFLGSYDDIEEIKALYAAEEGK

SEQ ID NO: 5919 - protein, 341 aa, Abies balsamea
MDHAADAFRTDLMTITRFVLNEQSKYPESRGDFSILLSHIVLGCKFVCSAVNKAGLAKLIGLAGETNVQGEEQKKLDVLSNEVFVKALVSSGRTCILVSEEDEEATFVEHSQRGKYCVVFDPLDGSSNIDCGVSIGTIFGIYLVKDGGEATLGDVLKPGKNMVAAGYCMYGSSCTLVLSTGSGVNGFTLDPSLGEFILTHPDIKIPKKGKIYSVNEGNAKNWDEPTRKYVERCKFPQDGSSPKSLRYIGSMVADVHRTLLYGGIFMYPADKKSPTGKLRVLYEVFPMSFLMEQAGGQAFTGNIRALDLVPTKIHQRSPVFLGSYDDVEEIKVLYAAQEGKP

SEQ ID NO: 5920 - protein, 341 aa, Amsonia hubrichtii
MDHAADAQRTDLMTITRYVLSEQSKHPASRGDFTILLSHIVLGCKFVCSAVSKAGLAKLIGLAGETNVQGEEQKKLDVLSNEVFIKALISSGRTCILVSEEDELATFVDKPNRGKYCVVFDPLDGSSNIDCGVSIGTIFGIYMIKDDIVEPTLADVLQPGKNMVAAGYCMYGSSCMLVLSTGSGVNGFTLDPSLGEFILTHADMKIPKKGKIYSVNEGNAKNWDGPTAKYVEMCKFPKDGSSPKSLRYIGSMVADVHRTLLYGGIFMYPGDKKSPNGKLRVLYEVFPMSFLMEQAGGQAFTGKQLALDLVPQKIHERSPIFLGSYDDVEEIKTLYAEAQKA

SEQ ID NO: 5921 - protein, 341 aa, Cedrus atlantica
MDHAADAFRTDLMTITRFVLNEQSKYPESRGDFSILLSHIVLGCKFVCSAVNKAGLAKLIGLAGETNVQGEEQKKLDVLSNEVFVKALVSSGRTSILVSEEDEEATFVEHSKRGKYCVVFDPLDGSSNIDCGVSIGTIFGIYLVKDGGEPTLGDVLKPGKNMVAAGYCMYGSSCTLVLSTGSGVNGFTLDPSLGEFILTHPDIKIPKKGKIYSVNEGNAKNWDEPTRKYVERCKFPQDGSSPKSLRYIGSMVADVHRTLLYGGIFMYPADKKSPNGKLRVLYEVFPMSFLMEQAGGQAFTGSKRALDLVPIKIHQRSPVFLGSYDDVEEIMALYAAEEGKA

SEQ ID NO: 5922 - protein, 341 aa, Pinus taeda
MDHAADAYRTDLMTITRFVLNEQSKHPESRGDFSILLSHIVLGCKFVCSAVNKAGLAKLIGLAGETNVQGEEQKKLDVLSNEVFVKALVSSGRTCILVSEEDEEATFVEHSQRGKYCVVFDPLDGSSNIDCGVSIGTIFGIYLVKKEGEAALSDVLKPGKNMVAAGYCMYGSSCTLVLSSGSGVNGFTLDPSLGEFILTHPDIKIPKKGKIYSVNEGNAKNWDEPTRKYVERCKFPQDGSSPKSLRYIGSMVADVHRTLLYGGIFMYPADKKSPNGKLRVLYEVFPMSFLMEQAGGQAFTGSIRALDLVPTKIHQRSPIFLGSYDDVEEIKALYAAQEGKV

SEQ ID NO: 5923 - protein, 63 aa, Vaccinium corymbosum
MTITRFVLNEQSKYPESRGDFSILLSHIVLGCKFVCSAVNKAGLAKLIGLAGETNVQGEEQKN

SEQ ID NO: 5924 - protein, 339 aa, Cyclamen graecum
MDHAAEAHRTDLMTITRFVLNEQSKHPESRGDFSILMSHIVLGCKFVCSAVNKAGLAKLIGLAGETNIQGEEQKKLDVLSNEVFVKALVSSGRTCILVSEEDEEAIFVDPSIRGRYCVVFDPLDGSSNIDCGVSIGTIFGIYMIKDSREPTLDDVLQPGKNMIAAGYCMYGSSCTLVLSAGSGVNGFTLDPSLGEFILTHADIKIPNKGKIYSVNEGNAKNWDEPTAKYVQKCKFPEDGSPAKSLRYIGSMVADVHRTLLYGGIFLYPGDKKSPSGKLRVLYEVFPMSFLMEQAGGQAFTGKEQALDMVPKKIHERSPIFLGSYDEVEEIKALYAAEEN

SEQ ID NO: 5925 - protein, 339 aa, Cyclamen graecum
MDHEADAYRTDLMTITRFVLNEQSKFPESRGDFTILMSHIVLGCKFVHAAVNKAGLAKLLGLAGETNIQGEEQKKLDVLSNEVFVKALVSSGRTSILVSEEDEEATFVDPSIRGRYCVVFDPLDGSSNIDCGVSIGTIFGIYMIKDSREPTLDDVLQPGKNMIAAGYCMYGSSCTLVLSAGSGVNGFTLDPSLGEFILTHADIKIPNKGKIYSVNEGNAKNWDEPTAKYVQKCKFPEDGSPAKSLRYIGSMVADVHRTLLYGGIFLYPGDKKSPSGKLRVLYEVFPMSFLMEQAGGQAFTGKERALDMIPKKIHERSPIFLGSYDDVEEIKALYAAEAN

SEQ ID NO: 5926 - protein, 341 aa, Beta vulgaris
MDHAADATRTDLMTITRFVLNEQSKRPESRGDFTILMSHIVLGCKFVCSAVNKAGLAKLIGLAGETNIQGEEQKKLDVLSNEVFIKALISSGRTCILVSEEDEEATFVEPSLRGKYCVVFDPLDGCSNIDCGVSIGTIFGIYMVKDLNNATLDDVLQPGKNMVAAGYCMYGSSCTLVMSTGSGVNGFTHDPSLGEFILTHPDIKIPKKGKIYSVNEGNAKNWDGPTTKYVEKCKFPKDGSSPKSLRYIGSMVADVHRTLLYGGIFMYPGDKKSPNGKLRVLYEVFPMSFLMEQAGGQAFTGEQRALDLVPKNIHDRSPVFLGSYDDVEDIKALYAAEQKNA

SEQ ID NO: 5927 - protein, 341 aa, Ricinus communis
MDHAADAHRTDLMTITRFVLNEQSKHPDSRGDFTILLSHIVLGCKFVCSAVNKAGLAKLIGLAGETNVQGEEQKKLDVLSNEVFIKALVSSGRTCILVSEEDDKATFVEPAMRGKYCVVFDPLDGSSNIDCGVSIGTIFGIYMVKHGNEPTLDDVLQPGKNMVAAGYCMYGSSCMFVLSTGNGVNGFTLDPSLGEFILTHPDIKIPKKGKIYSVNEGNAKNWDDPTAKYVENCKFPKDGSSPKSLRYVGSMVADVHRTFLYGGIFLYPADKKSPNGKLRVLYEVFPMSFLVEQAGGQAFTGQQRALDLIPTKIHERSPIFLGSYDDVEEIKALYAAEAKRA

SEQ ID NO: 5928 - protein, 335 aa, Ambrosia trifida
MLSVTDLMTITRFVLNEQSKYPESRGDFSILLSHIVLGCKFVCAAVNKAGLAKLIGLAGETNVQGEEQKKLDVLSNEVFVKALVSSGRTCILVSEEDEEAIIVEPSKRGKYCVVFDPLDGSSNIDCGVSIGTIFGIYMIKDAGAARLEDVLQPGKNMVAAGYCMYGSSCTLVLSTGSGVNGFTLDPSLGEFILTHPDIKIPNKGKIYSVNEGNAKNWDGPTAKFVEKCKFPKDDSPAKSLRYIGSMVADVHRTLLYGGVFLYPADKKSPNGKLRVLYEVFPMSFLMEQAGGQSFTGKERALDLVPKKIHERSPIFLGSYDDVEEIKALYAAEERQ

SEQ ID NO: 5929 - protein, 339 aa, Cicer arietinum
MDHIADAQRTDLMTITRFVLNEQSKHPESRGDFTILLSHIVLGCKFVCSAVNKAGLAKLIGLAGETNVQGEEQKKLDVLSNDVFIKALKSSGRTCILVSEEDEEAIFVEPSQRGKYCVVFDPLDGSSNIDCGVSIGTIFGIYMMKDNHEPIIEDVLQPGKNMLAAGYCMYGSSCTLVISTGSGVNGFTLDPSLGEFILTHPDIKIPKKGKIYSVNEGNAKNWDGPTASYVEKCKFPKDGSSAKSLRYIGSMVADVHRTLLYGGTFLYPADKKSPSGKLRVLYEVFPMSFLMEQAGGQAFTGKERALDLIPTKLHERSPIFLGSYDDIEEIKALYAAEGK

SEQ ID NO: 5930 - protein, 341 aa, Cleome spinosa
MDHAADAHRTDLMTITRFVLNEQSKYPESRGDFTILLSHIVLGCKFVCSAVNKAGLAKLIGLAGETNIQGEEQKKLDVLSNDVFVKAFVSSGRTSILVSEEDEDATFVEPSKRGKYCVVFDPLDGSSNIDCGVSIGTIFGIYTLKHNDEPTIDDVLQPGSEMVAAGYCMYGSSCMLVLSAGTGVNGFTLDPSLGEFILTHPDIKIPKKGKIYSVNEGNAKNWDGPTTRYVEKCKFPEDGSPPKSLRYVGSMVADVHRTLLYGGIFLYPADKKSPNGKLRVLYEVFPMSFLMEQAGGQAFTGKERALDLVPRKIHERSPIFLGSYEDVEEIKTLYANDAKNA

SEQ ID NO: 5931 - protein, 339 aa, Medicago truncatula
MDHSADAHRTDLMTITRFVLNEQSKHPESRGDFTILLNNIVLGCKFVCSAVNKAGLAKLIGLAGETNVQGEEQKKLDVLSNEVFCKALISSGRTCILVSEEDEDAIFVEPKQRGKYCVVFDPLDGSSNIDCGVSIGTIFGIYMMKDNHEPVIEDALQPGKNMLAAGYCMYGSSCTFVITTGSGVNGFTLDPSLGEFILTHPDIKIPKKGKIYSVNEGNAKNWDGPTAAYVEKCKFPTDGSPAKSLRYIGSMVADVHRTLLYGGTFLYPADKKSPNGKLRVLYEVFPMSFLMEQAGGQAFTGKERALDLIPTKLHERSPIFLGSYDDIEEIKALYAAEAK

SEQ ID NO: 5932 - protein, 341 aa, Pisum sativum
MDHAGDAMRTDLMTITRYVLNEQSKRPESRGDFTILLSHIVLGCKFVCSAVNKAGLAKLIGLAGETNIQGEEQKKLDVLSNEVFVKALTSSGRTCILVSEEDEEATFIEPSLRGKYCVVFDPLDGSFNIDCGVSIGTIFGIYMVKDFETATLEDVLQPGKNMVAAGYCMYGSSCTLVLSTGSGVNGFTLDPSLGEYILTHPDIKIPNKGKIYSVNEGNAKNWDGPTTKYVEKCKFPTDGSSPKSLRYIESMVANVHRTLLYGGIFLYPGDKKSPNGKLRVLYEVFPMSFLMEQAGGQAFTGKQRALDLIPTKIHERSPVFLGSYDDVEDIKALYAAQEKTA

SEQ ID NO: 5933 - protein, 341 aa, Vinca minor
MDHEADAYRTDLMTITRYVLNEQTKYPASRGDFSILLSHIVLGCKFVCSAVSKAGLAKLIGLAGETNVQGEEQKKLDVLSNEVFVKALVSSGRTCILVSEEDELATFVAMPNRGKYCVVFDPLDGSSNIDCGVSIGTIFGIYMIKDDVTEPTLEDVLQPGKNMVAAGYCMYGSSCMLVLSTGSGVNGFTLDPSLGEFILTHADIKIPKKGKIYSVNEGNAQNWDAPTANYVEKCKFPKDGSSPKSLRYIGSMVADVHRTLLYGGIFMYPGDKKSPNGKLRVLYEVFPMSFLMEQAGGQSFTGKQPALDLVPQKIHERSPIFLGSYDDVEEIKALYEEEKKS

SEQ ID NO: 5934 - protein, 339 aa, Glycine max
MDHSADAQRTDLMTITRFVLNEQSKHPESRGDFSILLSHIVLGCKFVCSAVNKAGLAKLIGLAGETNVQGEEQKKLDVLSNDVFIKALISSGRTCILVSEEDEEATFVEPSKRGKYCVVFDPLDGSSNIDCGVSIGTIFGIYLIKEDHEPTVEDVLQPGKNMLAAGYCMYGSSCTLVLSTGSGVNGFTLDPSLGEFILTHPDIKIPKKGKIYSVNEGNAKNWDGPTTMYVENCKYPKDGSSPKSLRYIGSMVADVHRTLLYGGIFLYPADKKSPNGKLRVLYEVFPMSFLMEQAGGQAFTGNQRALDLVPKKLHERSPIFLGSYEDVEEIKALYSADEK

SEQ ID NO: 5935 - protein, 341 aa, Phaseolus vulgaris
MDHSADALRTDLMTITRFVLNEQSKHPESRGDFTILLSHIVLGCKFVCTAVNKAGLAKLIGLAGETNVQGEEQKKLDVLSNEVFIKALVSSGRTCILVSEEDEDAIIVEPSKRGKYCVVFDPLDGSSNIDCGVSIGTIFGIYTLADVHEPTVEDVLLPGKKMVAAGYCMYGSSCTLVLSTGAGVNGFTLDPSLGEFILTHPDIKIPKKGKIYSVNEGNAKNWDGPTAAYVEKCKFPEDGSSPKSLRYIGSMVADVHRTLLYGGIFLYPGDKKNPNGKLRVLYEVFPMSFLLEQAGGQSFTGKERALDLVPTKLHERSPIFLGSYDDVEEIKALYAAEGKEE

SEQ ID NO: 5936 - protein, 340 aa, Tropaeolum majus
DHAADANRTDLMTITRFVLNEQSKHPESRGDFSILLSHIVLGCKFVCSAVNKAGLAKLLGLAGDTNIQGEEQKKLDVLSNDVFVKALISSGRTSILVSEEDEEATFVEPSLRGKYCVVFDPLDGSSNIDCGVSIGTIFGIYMMKDIHEPTLDDVLQPGTNMLAAGYCMYGSSCTLVLSTGNGVNGFTLDPSLGEFILTHSDIKIPKKGKIYSVNEGNARNWDAPTSKFVEKCKFPTDGSSPKSMRYIGSMVADVHRTLLYGGIFLYPADKKSPSGKLRVLYEVFPMSFLMEQAGGQAFTGKERALDLVPKKIHERSPVFLGSYDDVEEIKALYAAEEKKE

SEQ ID NO: 5937 - protein, 341 aa, Cajanus cajan
MDHHADAHRTDLMTITRFVLNEQSKHPESRGDFTILLNHIVFGCKFVCSSVNKAGLAKLIGLAGETNVQGEEQKKLDVLSNEVFMKALKSSGRTCVLVSEEDEEATIVEPSLRGKYCVVFDPLDGSSNIDCGVSIGTIFGIYALKDVHEPSIEDVLLPGKNMVAAGYCMYGSSCTLVLSTGAGVNGFTLDPSLGEFILTHPDIKIPKKGKIYSVNEGNAKNWDGPTAAYVQKCKFPEDGSSPKSLRYIGSMVADIHRTLLYGGIFLYPADKKNPNGKLRVLYEVFPMSFLMEQAGGQSFTGKERALDLVPTKLHERSPIVLGSYDDVEEIKALYAAEGTEK

SEQ ID NO: 5938 - protein, 341 aa, Chenopodium quinoa
MDHAADARCTDLMTITRYVLNEQTKHPESQGDFTILLSHIVLGCKYVCSAVNKAGLAKLLGLAGETNVQGEEQKKLDVLSNEVFVNALTSSGRTCILVSEEDEEATFVEPALRGKYCVVFDPLDGSSNIDCGVSIGTIFGIYMVKDFKNVTLDEVLQPGKNMVAAGYCMYGSSCTLVLSAGSGVNGFTLDPSLGEYILTHPNIKIPKRGKIYSVNEGNAKNWDGPTTKFVEKCKFPTDGSSPKSLRYIGSMVADVHRTLLYGGIFMYPGDKKSPDGKLRVLYEVFPMSFLMEQAGGQAFTGKERALDLVPKKIHERSPVFLGSYDDVEDIKALYAAAAKNA

SEQ ID NO: 5939 - protein, 341 aa, Vinca minor
MDHAADAQRTDLMTITRYVLNEQSKHPASRGDFTILLNHIVLGCKFVCSAVSKAGLAKLIGLAGETNVQGEEQKKLDVLSNEVFVKALVSSGRTCILVSEEDELATFVAKPNRGKYCVVFDPLDGSSNIDCGVSIGTIFGIYMVKDDVVTEPTLEDVLQPGKNMVAAGYCMYGSSCNLVVSTGSGVNGFTLDPSLGEFILTHADIKIPKKGKIYSVNEGNAKNWDGPTAKYVEKCKFPKDGSSPKSLRYIGSMVADVHRTLLYGGIFMYPGDKKSPNGKLRVLYEVFPMSFLMEQAGGQSFTGKQRALDLVPQKIHERSPIFLGSYYDVEEIKALMQKRKK

SEQ ID NO: 5940 - protein, 341 aa, Picea glauca
MDHAADAYRTDLMTITRFVLNEQSKYPESRGDFSILLSHIVLGCKFVCSAVNKAGLAKLIGLAGETNVQGEEQKKLDVLSNEVFVKALVSSGRTCILVSEEDEEATFVEHSKRGKYCVVFDPLDGSSNIDCGVSIGTIFGIYLVKDGAEPTVGDVLKPGKNMVAAGYCMYGSSCTLVLSSGSGVNGFTLDPSLGEFILTHPDIRIPKKGNIYSVNEGNAKNWDEPTRKYVERCKFPQDGSSPKSLRYIGSMVADVHRTLLYGGIFMYPADKKSPNGKLRVLYEVFPMSFLMEQAGGQAFTGNIRALDLVPTKIHQRSPVFLGSYDDVEEIKALYAAQEGKA

SEQ ID NO: 5941 - protein, 251 aa, Chenopodium quinoa
MDHAADARCTDLMTITRYVLNEQTKHPESQGDFTILLSHIVLGCKYVCSAVNKAGLAKLLGLAGETNVQGEEQKKLDVLSNEVFVNALTSSGRTCILVSEEDEEATFVEPALRGKYCVVFDPLDGSSNIDCGVSIGTIFGIYMVKDFKNVTLDEVLQPGKHMVAAGYCMYGSSCTLVLSTGSGVNGFTLDPSLGEYILTHPNIKIPKRGKIYSVNEGNAKNWDGPTTKFVENVSSPLMVLRQSLSDTLEVW

SEQ ID NO: 5942 - protein, 341 aa, Arabidopsis thaliana
MDHAADAHRTDLMTITRFVLNEQSKYPESRGDFTILLSHIVLGCKFVCSAVNKAGLAKLIGLAGETNIQGEEQKKLDVLSNDVFVNALVSSGRTSVLVSEEDEEATFVEPSKRGKYCVVFDPLDGSSNIDCGVSIGTIFGIYTLDHTDEPTTADVLKPGNEMVAAGYCMYGSSCMLVLSTGTGVHGFTLDPSLGEFILTHPDIKIPNKGNIYSVNEGNAQNWDGPTTKYVEKCKFPKDGSPAKSLRYVGSMVADVHRTLLYGGIFLYPADKKSPNGKLRVLYEVFPMSFLMEQAGGQAFTGKKRALDLVPEKIHERSPIFLGSYDDVEEIKALYAEEEKKN

SEQ ID NO: 5943 - protein, 341 aa, Gossypium hirsutum
MDHAADAHRTDLMTITRFVLNEQSKYPESRGDFTILLNHIVLGCKFVCSSVNKAGLAKLIGLAGEINIQGEEQKKLDVLSNEVFIKALVSSGRTCILVSEEDEDAIIVEPSKCGRYCVVFDPLDGSSNIDCGVSIGTIFGIYMVKDDHEPTLADVLQPGKQMVAAGYCMYGSSCTLVLSTGKGVNGFTLDPSLGEFILTHPDIRIPKKGKIYSVNEGNAKNWDGPTAKYVENCKFPKDGSPSKSLRYIGSMVADVHRTLLYGGTFMYPADKKSPSGKLRVLYEVFPMSFLMENAGGQAFTGKQRALDLVPTKIHDRSPIFLGSYDDIEEIKALYAAEGKKE

SEQ ID NO: 5944 - protein, 341 aa, Vigna unguiculata
MDHSADAQRTDLMTITRFVLNEQSKQPEARGDFTILLSHIVLGCKFVCSAVNKAGLAKLIGLAGETNVQGEEQKKLDVLSNDVFVKALVSSGRTCILVSEEDEEATFVEPSKRGKYIVVFDPLDGSSNIDCGVSIGTIFGIYLVKENREPTIEDVLQPGKNMLAAGYCMYGSSCTFVLSTGRGVNGFTLDPSLGEFILTHPDIKVPKKGKIYSVNEGNAKNWDGPTTKYVENCKFPKDGSSPKSLRYVGSMVADVHRTFLYGGIFLYPADKKSPNGKLRVLYEVFPMSFLMEQAGGQAFTGKERALDLVPTKLHERSPIFLGSYEDVEEIKALYAADQKLE

SEQ ID NO: 5945 - protein, 338 aa, Glycine max
MDHSADAQRTDLMTITRFVLNQQSNHPESRGDFSILLSHIVLGCKFLCSAVNKAGLAKLIGLAGETNVQGEEQKKLDVLSNDVFIKALVSSGRTCILVSEEDEEATFVEASKRGKYCVVFDPLDGSSNIDCGVSIGTIFGIYLIKEDHEPTIEDVLQPGKNMLAAGYCMYGSSCTLVLSTGSGVNGFTLDPSLGEFILTHPDIKIPKKGKIYSVNEGNAKNWDDPTTKYVENCKYPRDGSSPKSLRYIGSMVADVHRTLLYGGIFLYPADKKSPNGKLRVLYEVFPMSFLMEQAGGQAFTGNQRALDLVPKKLHERSPIFLGSYEDVEEIKALYAAEE

SEQ ID NO: 5946 - protein, 341 aa, Arabidopsis lyrata
MDHAADAHRTDLMTITRFVLNEQSKYPESRGDFTILLSHIVLGCKFVCSAVNKAGLAKLIGLAGETNIQGEEQKKLDVLSNDVFVKALVSSGRTSVLVSEEDEEATFVEPSKRGKYCVVFDPLDGSSNIDCGVSIGTIFGIYTLDHTDEPTTEDVLKPGNEMVAAGYCMYGSSCMLVLSTGTGVHGFTLDPSLGEFILTHPDIKIPNKGNIYSVNEGNAQNWDGPTTKYVEKCKFPKDGSPAKSLRYVGSMVADVHRTLLYGGIFLYPADKKSPNGKLRVLYEVFPMSFLMEQAGGQAFTGKKRALDLVPEKIHERSPIFLGSYDDVEEIKALYAEEEKKN

SEQ ID NO: 5947 - protein, 339 aa, Cannabis sativa
MDHEADAYRTDLMTITRFVLNEQSKHPESRGDFTILLSHIVLGCKFVCSAVNKAGLAKLIGLAGETNVQGEEQKKLDVLSNEVFVKALISSGRTSILVSEEDEEATIVDKSMRGRYCVVFDPLDGSSNIDCGVSIGTIFGIYAIKDDHEPGLDDVLQPGKNMVAAGYCMYGSSCTLVLSTGEGVNGFTLDPSLGEFILTHPNIKIPKRGKIYSVNEGNAKNWDGPTSKYVEKCKYPTDGSSPKSLRYIGSMVADVHRTLLYGGIFLYPGDKKSPNGKLRVLYEVFPMSFLMEQAGGQSFTGTQRSLDLVPKSIHERSPIFLGSYDDVEDIKALYAAAEK

SEQ ID NO: 5948 - protein, 341 aa, Gossypium raimondii
MDHAADAHRTDLMTITRFVLNEQSKYPESRGDFTILLNHIVLGCKFVCSSVNKAGLAKLIGLTGEINIQGEEQKKLDVLSNEVFIKALVSSGRTCILVSEEDEDAIIVEPSKRGRYCVVFDPLDGSSNIDCGVSIGTIFGIYMVKDDHEPTLADVLQPGKQMVAAGYCMYGSSCTLVLSTGKGVNGFTLDPSLGEFILTHPDIRIPKKGKIYSVNEGNAKNWDGPTAKYVENCKFPKDGSPSKSLRYIGSMVADVHRTLLYGGTFMYPADKKSPSGKLRVLYEVFPMSFLMENAGGQAFTGKQRALDLVPTKIHDRSPIFLGSYDDIEEIKALYAAEGKKE

SEQ ID NO: 5949 - protein, 350 aa, Vitis vinifera
MDHEADSHRTDLMTITRYVLNEQSRHPESRGDFTILLSHIVLGCKFVCTAVNKAGLAKLIGLAGETNVQGEEQKKLDVLSNEVFIKALVSSGRTCILVSEEDEEATIVEPSKRGRYCVVFDPLDGSSNIDCGVSIGTIFGIYMVKDGGEPTLDNVLQPGKNMLAAGYCMYGSSCTLVLSTGTGVNGFTLDPSLGEFILTHPNIKIPKKGKIYSVNEGNTKNWDAPTAKYVEKCKFPKDGSSPKSLRYIGSMVADVHRTLLYGGIFLYPADKKSPNGKLRVLYEVFPMSFLMEQAGGQAFTGKQRALDLVPKNIHERSPIFLGSYDDVEEIKALYAAEEKPCCNRECPRKE

SEQ ID NO: 5950 - protein, 341 aa, Pinus pinaster
MDHAADAYRTDLMTITRFVLNEQSKHPESRGDFSILLSHIVLGCKFVCSAVNKAGLAKLIGLAGETNIQGEEQKKLDVLSNEVFVKALVSSGRTCILVSEEDEEATFVEHSQRGKYCVVFDPLDGSSNIDCGVSIGTIFGIYLVKEGGEAALSDVLKPGKNMVAAGYCMYGSSCTLVLSSGSGVNGFTLDPSLGEFILTHPDIRIPKKGKIYSVNEGNAKNWDEPTRKYVERCKFPQDGSSPKSLRYIGSMVADVHRTLLYGGIFMYPADKKSPNGKLRVLYEVFPMSFLMEQAGGQAFTGSIRALDLVPTKIHQRSPVFLGSYDDVEEIKALYAAQEGKV

SEQ ID NO: 5951 - protein, 341 aa, Pseudotsuga menziesii
MDHAADAYQTDLMTITRFVLNEQSKYPESRGDFSILLSHIVLGCKFVCSAVNKAGLAKLIGLAGETNVQGEEQKKLDVLSNEVFVKALVSSGRTSILVSEEDEEATFVEHTKRGKYCVVFDPLDGSSNIDCGVSIGTIFGIYLVKDGGEASLSDVLKPGKNMVAAGYCMYGSSCTLVLSTGSGVNGFTLDPSLGEFILTHPDIKIPKKGKIYSVNEGNAKNWDEATRKYVERCKFPQDGSSPKSLRYIGSMVADVHRTLLYGGIFMYPGDKKSPNGKLRVLYEVFPMSFLMEQAGGQAFTGNIRALDLVPTKIHQRSPIFLGSYDDVEEIKVLYAAQEGKA

SEQ ID NO: 5952 - protein, 262 aa, Amaranthus tuberculatus
MTITRHVLNEQSKRPESRGDFTILLSHIVLGCKFVCSAVNKAGLAKLIGLAGETNVQGEEQKKLDVLSNDVFVKALISSGRTCILVSEEDEEATFVEPSLRGKYCVAFDPLDGSSNIDCGVSIGTIFGIYMVKDFNNVTLDDVLKPGKNMVAAGYCMYGSSCTLVLSTGSGVNGFTLDPSLGEFILTHPDIKIPKKGKVYSVNEGNAKNWDGPTTKYVQKCKFPEDGSPPKSLRYIGSMVADVHRTLLYGGIFMYPGDKKRP

SEQ ID NO: 5953 - protein, 213 aa, Daucus carota
MDHSADAFRTDLMTITRFVLNEASKYPESRGDFSILISNIVLGCKFVCAAVNKAGLAKLIGLAGETNVQGEEQKKLDVLSNEVFVKALVSSGRTCILVSEEDEEATFVETTKRGRYCVVFDPLDGSSNIDCGVSIGTIFGIYMMNDGEEPTLEGALQPGKNMVAAGYCMYGSSCTFVMSTGSGVNGFTLDPSLGEFILTHPDIRIPKKERYIQ

SEQ ID NO: 5954 - protein, 213 aa, Petroselinum crispum
MDHSADAFRTDLMTITRFVLNEASKYPESRGDFSILLSNIVLGCKFVCAAVNKAGLAKLIGLAGETNVQGEEQKKLDVLSNEVFVKALVSSGRTCILVSEEDEEATFVETSKRGRYCVVFDPLDGSSNIDCGVSIGTIFGIYMLKEGEEPTLEGALQPGRNMVAAGYCMYGSSCTFVMSTGSGVNGFTLDPSLGEFILTHPDIKIPKKERYIQ

SEQ ID NO: 5955 - protein, 346 aa, Manihot esculenta
MDHAADAHRTDLMTITRFVLNEQSKHPASRGDFTILLNHIVLGCKFVCSAVNKAGLAKLIGLAGETNVQASCYWGEEQKKLDVLSNEVFIKALVSSGRTCILVSEEDDEAIFVEPGKRGKYCVVFDPLDGSSNIDCGVSIGTIFGIYMVKHGNEPTLDDVLQPGSNMVAAGYCMYGSSCMLVLSTGSGVNGFTLDPSLGEFILTHPDIKIPKKGKIYSVNEGNAKNWDGPTAKYVERCKFPKDGSSPKSLRYVGSMVADVHRTLLYGGIFLYPADKKSPNGKLRVLYEVFPMSFLMEQAGGQSFTGKQQALHLVPEKIHQRSPIFLGSYDDVEEIKALYAAENAEA

SEQ ID NO: 5956 - protein, 340 aa, Quercus alba
MDHAAEANRTDLMTITRFVLNEQSKYPESRGDFTILLSNIVLGCKFVCTAVNKAGLAKLIGLAGETNVQGEEQKKLDVLSNDVFVKALISSGRTCILVSEEDELATFVEPSKRGRYAVVFDPLDGSSNIDCGVSIGTIFGIYMVKDSIEPTLDEVLQPGKNMLAAGYCMYGSSCTFVLSTGAGVNGFTLDPSLGEFILTHPDIKIPKKGKIYSVNEGNAKNWDGPTAKYVERCKFPKDGSSPKSLRYIGSMVADVHRTLLYGGIFLYPADKKSPNGKLRVLYEVFPMSFLMEQAGGQAFTGKQRALDLVPNDIHERSPIFLGSYEDVEEVKALYAAEDKK

SEQ ID NO: 5957 - protein, 339 aa, Castanea mollissima
DHAAEANRTDLMTITRFVLNEQSRHPESRGDFTILLSNIVLGCKFVCTAVNKAGLAKLIGLAGETNVQGEEQKKLDVLSNDVFVKALISSGRTCILVSEEDEQATFVEPSKRGRYAVVFDPLDGSSNIDCGVSIGTIFGIYMVKDSIEPTLDEVLQPGKNMVAAGYCMYGSSCTFVLSTGAGVNGFTLDPSLGEFILTHPDIKIPKKGKIYSVNEGNAKNWDGPTAKYVERCKFPKDGSSPKSLRYIGSMVADVHRTLLYGGIFLYPADKKSPNGKLRVLYEVFPMSFLMEQAGGQAFTGKQRALDLVPKDIHERSPIFLGSYEDVEEVKALYAAEDKK

SEQ ID NO: 5958 - protein, 341 aa, Phaseolus vulgaris
MDHSADAHRTDLMTITRFVLNEQSKHPESRGDFTILLSHIVLGCKFVCTAVNKAGLAKLIGLAGETNIQGEEQKKLDVLSNEVFIKALVSSGRTCILVSEENEDAIIVEPSKRGKYCVVFDPLDGSSNIDCGVSIGTIFGIYTLADVHEPTVEDVLLPGKKMVAAGYCMYGSSCTLVLSTGAGVNGFTLDPSLGEFILTHPDIKIPNKGKIYSVNEGNAKNWDGPTAAYVEKCKFPEDGSSPKSLRYIGSMVADVHRTLLYGGIFLYPGDKKNPNGKLRVLYEVFPMSFLMEQAGGQSFTGKERALDLVPTKLHERSPIFLGSYDEVEEIKALYAAEGEEE

SEQ ID NO: 5959 - protein, 341 aa, Catharanthus roseus
MDHAADAQRTDLMTITRYVLNEQTKYPASRGDFTILLNHIVLGCKFVCSSVSKAGLAKLIGLAGETNVQGEEQKKLDVLSNDVFMKALISSGRTCILVSEEDELPTFVDKPNRGKYCVVFDPLDGSSNIDCGVSIGTIFGIYMIKDDVTEPTLEDVLQPGKNMVAAGYCMYGSSCMLVISTGAGVNGFTLDPSLGEFILTHPDMKIPKKGKIYSVNEGNAKNWDGPTAKYVEKCKFPTDGSSPKSLRYIGSMVADVHRTLLYGGVFMYPGDKKSPNGKLRVLYEVFPMSFLIEQAGGQSFTGKQRSLDLVPQKIHERSPIFLGSYDDVEEIKALYAEEQKA

SEQ ID NO: 5960 - protein, 341 aa, Cleome gynandra
MDHAADAHRTDLMTITRFVLNEQSKYPESRGDLTILLSHIVLGCKFVCSAVNKAGLAKLIGLAGETNVQGEEQKKLDVLSNDVFVKALISSGRTSILVSEEDEEATFVEPSKRGKYCVVFDPLDGSSNIDCGVSIGTIFGIYTMTHDNEPTIDDVLQPGTEMVAAGYCMYGSSCMLVLSTGTGVNGFTLDPSLGEFILTHPDIKMPKKGKIYSVNEGNAKNWDRATTAYVEKCKFPEDGSSPKSLRYVGSMVADVHRTLLYGGIFLYPADKKSPNGKLRVLYEVFPMSFLMEQAGGQAFTGKQRALDLVPQKIHERSPIFLGSYEDVEEIKTLYAAEAKNA

SEQ ID NO: 5961 - protein, 307 aa, Sarracenia psittacina
MDHAADAYRTDLMTITRFVLNEQSKHPESRGDFTILLSHIVLGCKFVCSAVSKAGLAKLIGLAGETNVQGEEQKKLDVLSNEVFIKALVSSGRTCILVSEEDEEATFVEASKRGRYCVVFDPLDGSSNIDCGVSIGTIFGIYTVKDVEEPTLDDVLQPGKNMLAAGYCMYGSSCTLVLSTGSGVNGFTLDPSLGEFILTHPDIKIPEKGKIYSVNEGNAKNWDGPTAKYVEKCKFPKDGSSSKSLRYIGSMVADVHRTLLYGGIFLYPADKKVPRENCVFFTKCFQCHSWWNKLEGRHLRASCGHLT

SEQ ID NO: 5962 - protein, 325 aa, Chrysanthemum coronarium
TRFVLNEQSKHPESRGDFSILLSHIVLGCKFVCAAVNKAGLAKLIGLAGETNVQGEEQKKLDVLSNEVFVKALVSSGRTCILVSEEDEEAIIVEPSKRGKYCVVFDPLDGSSNIDCGVSIGTIFGIYMIKDGDDPSLEDVLQPGKNMLAAGYCMYGSSCTFVLSTGSGVNGFTLDPSLGEFILTHPDIKIPKKGKIYSVNEGNAKNWDGPTAKFVEKCKYPTDGSSAKSLRYIGSMVADVHRTLLYGGVFLYPADKKSPSGKLRVLYEVFPMSFLMEQAGGQSFTGKIRSLDLVPKKIHERSPIFLGSYDDVEEIKALYAAEEKA

SEQ ID NO: 5963 - protein, 339 aa, Cucumis melo
MDHAADAQRTDLMTITRFVLNEQSKYPESRGDFTILLSHIVLGCKFVCSAVNKAGLAKLIGLAGETNVQGEEQKKLDVLSNEVFIKALVSSGRTCILVSEEDEEPTYVEPSRRGRYSVVFDPLDGSSNIDCGVSIGTIFGIYHLNDSHEPNLEDVLQPGKNMVAAGYCLYGSSCTLVLSTGTGVNGFTLDPSLGEFILTHPDLKIPKKGKIYSVNEGNAKNWDGPTAKYVEKCKFPTDGSPPKSLRYVGSMVADVHRTLLYGGIFLYPGDKKSPNGKLRVLYEVFPMAFLIEEAGGQAFTGKIRALDLVPKKIHERSPIFLGSYDDVEEIKALYAAAEE

SEQ ID NO: 5964 - protein, 341 aa, Allium cepa
MDHAADAFRTDLMTITRFVLNEQSKHPESRGDFTILLSHIVLGCKFVCSAVNKAGLAKLIGLAGETNVQGEEQKKLDVLSNEVFVKALISSGRTCILVSEEEEEATFVDPALRGKYAVVFDPLDGSSNIDCGVSVGTIFGIYLIENKDEAKLEDVLQSGNSMVAAGYCMYGSFCELVISTGNGVNGFTLDPSLGEFILTHPDIKVPKKGKIYSVNEGNAKNWDEPTALYVDKCKFPKDDSSAKSLRYVGSMVADVHRTLLYGGIFLYPADKKSPTGKLRVLYEVFPMSFLMEQAGGQAFTGKERALDLVPKTIHERSPIFLGSYDDVEEIKALYAAKEAKA

SEQ ID NO: 5965 - protein, 341 aa, Phaseolus vulgaris
MDHSADAQRTDLMTITRFVLNEQSKQPEARGDFSILLSHIVLGCKFVCSAVNKAGLAKLIGLAGETNVQGEEQKKLDVLSNDVFVKALVSSGRTCILVSEEDEEATFVEPSKRGKYIVVFDPLDGSSNIDCGVSIGTIFGIYLVKENGEPTIEDVLQPGKNMLAAGYCMYGSSCTFVLSTGTGVNGFTLDPSLGEFILTHPDIKVPKKGKIYSVNEGNAKNWDGPTTKYVENCKFPKDGSSPKSLRYVGSMVADVHRTFLYGGIFLYPADKKSPNGKLRVLYEVFPMSFLMEQAGGQAFTGKQRALDLVPTKLHERSPIFLGSYEDVEEIKALYAADQTLE

SEQ ID NO: 5966 - protein, 343 aa, Tripterygium wilfordii
MDHASEAFRTDLMTITRFVLNEQSKFPESRGDLTILLNHIVLGCKFVCNAVSKAGLAKLIGLAGETNVQGEEQKKLDVLSNEVFIKALVSSGRTCILVSEEDEEATFVEVSKRGRYIVVFDPLDGSSNIDCGVSIGTIFGIYTVKNTDNPTLEDVLKPGSHMTAAGYCMYGSSCTLVFSTGSGVNGFTLDPSLGEFILTHPDIKIPKKGKIYSVNEGNAKNWDEPTAKYVENCKFPKDGSSSKSLRYIGSMVADVHRTLLYGGIFLYPADKKSPNGKLRVLYEVFPMSYLMEQAGGQAFTGKQRALDLVPQKIHERSPVFLGSYDDVEEIKALYAAAAETKAA

SEQ ID NO: 5967 - protein, 340 aa, Citrullus lanatus
MDHAADAQRTDLMTITRFVLNEQSKYPESRGDFTILLSHIVLGCKFVCSAVNKAGLAKLIGLAGETNVQGEEQKKLDVLSNEVFIKALVSSGRTCILVSEEDEEPTYVEPSRRGRYSVVFDPLDGSSNIDCGVSIGTIFGIYHLNDSHEPNLEDVLQPGKNMVAAGYCLYGSSCTLVLSTGTGVNGFTLDPSLGEFILTHPDLKIPKKGKIYSVNEGNAKNWDGPTAKYVEKCKFPTDGSSPKSLRYVGSMVADVHRTLLYGGIFLYPGDKKSPNGKLRVLYEVFPMAFLIEEAGGQAFTGKIRALDLVPKKIHERSPIFLGSYDDVEEIKALYAAAEKE

SEQ ID NO: 5968 - protein, 339 aa, Cucumis sativus
MDHAADAQRTDLMTITRFVLNEQSKYPESRGDFTILLSHIVLGCKFVCSAVNKAGLAKLIGLAGETNVQGEEQKKLDVLSNEVFIKALVSSGRTCILVSEEDEEPTYVEPSRRGRYSVVFDPLDGSSNIDCGVSIGTIFGIYLLKDSHEPNLEDVLQPGKNMVAAGYCLYGSSCTLVLSTGTGVNGFTLDPSLGEFILTHPDLKIPSKGKIYSVNEGNAKNWDGPTAKYVEKCKFPTDGSPPKSLRYVGSMVADVHRTLLYGGIFLYPGDKKSPNGKLRVLYEVFPMAFLIEEAGGQAFTGKIRALDLVPKKIHERSAIFLGSYDDVEEIKALYAAVEE

SEQ ID NO: 5969 - protein, 341 aa, Cucurbita pepo
MDHAADAQRTDLMTITRFVLNEQSKYPESRGDFTILLSHIVLGCKFVCSAVNKAGLAKLIGLAGETNVQGEEQKKLDVLSNEVFIKALVSSGRTCILVSEEDEEPTYVEPSRRGRYSVVFDPLDGSSNIDCGVSIGTIFGIYHLNDSHEPNLEDVLQPGKNMVAAGYCLYGSSCTLVLSTGTGVNGFTLDPSLGEFILTHPDLKVPKKGKIYSVNEGNAKNWDGPTAKYVENCKFPTDGSPPKSLRYVGSMVADVHRTLLYGGIFLYPGDKKSPNGKLRVLYEVFPMAFLMEEAGGQAFTGKIRALELVPKTIHERSPIFLGSYDDVEEIKALYAAAAENK

SEQ ID NO: 5970 - protein, 341 aa, Eutrema halophilum
MDHEADAYRTDLMTITRFVLNEQSKYPESRGDFTILLSNIVLGCKFVCSAVNKAGLAKLIGLAGETNIQGEEQKKLDVLSNDVFVKALVSSGRTSVLVSEEDEEATFVESSKRGKYCVVFDPLDGSSNIDCGVSIGTIFGIYTMNHSDEPTTEDVLKPGSEMVAAGYCMYGSSCMLVLSTGTGVHGFTLDPSLGEFILTHPDIKIPKNGNIYSVNEGNAQNWDGPTTKYVEKCKFPKDGSPAKSLRYVGSMVADVHRTLLYGGIFLYPADKKSPNGKLRVLYEVFPMSFLMEQAGGQAFTGKKRALDLVPEKIHERSPIFLGSYDDVEEIKALYAMEETKN

SEQ ID NO: 5971 - protein, 338 aa, Brassica napus
  Sequence also found in Organisms: Brassica rapa
MDHEADAYRTDLMTITRFVLNEQSKYPESRGDFTILLSNIVLGCKFVCSAVNKAGLAKLIGLAGETNIQGEEQKKLDVLSNDVFVKALVSSGRTSVLVSEEDEEATLVESSKRGKYCVVFDPLDGSSNIDCGVSIGTIFGIYTMSHNDEPTTEDVLKPGHEMVAAGYCMYGSSCMLVLSTGTGVNGFTLDPSLGEFILTHPDIKIPKKGNIYSVNEGNAQNWDGPTTKYVEKCKFPKDGSPAKSLRYVGSMVADVHRTLLYGGIFLYPADKKSPNGKLRVLYEVFPMSFLMEQAGGQAFTGKKRALDLVPEKIHERSPIFLGSYEDVEEIKALYAADE

SEQ ID NO: 5972 - protein, 338 aa, Brassica napus
  Sequence also found in Organisms: Brassica juncea
MDHEADAYRTDLMTITRFVLNEQSKYPESRGDFTILLSNIVLGCKFVCSAVNKAGLAKLIGLAGETNIQGEEQKKLDVLSNDVFVKALVSSGRTSVLVSEEDEEATLVESSKRGKYCVVFDPLDGSSNIDCGVSIGTIFGIYTMSHNDEPTTEDVLKPGNEMVAAGYCMYGSSCMLVLSTGTGVNGFTLDPSLGEFILTHPDIKIPKKGNIYSVNEGNAQNWDGPTTKYVEKCKFPKDGSPAKSLRYVGSMVADVHRTLLYGGIFLYPADKKSPNGKLRVLYEVFPMSFLMEQAGGQAFTGKKRALDLVPEKIHERSPIFLGSYEDVEEIKALYAAEE

SEQ ID NO: 5973 - protein, 338 aa, Brassica oleracea
MDHEADAYRTDLMTITRFVLNEQSKYPESRGDFTILLSNIVLGCKFVCSAVNKAGLAKLIGLAGETNIQGEEQKKLDVLSNDVFVKALVSSGRTSVLVSEEDEEATLVESSKRGKYCVVFDPLDGSSNIDCGVSIGTIFGIYTMSHNDEPTTEDVLKPGHEMVAAGYCMYGSSCMLVLSTGTGVNGFTLDPSLGEFILTHPDIKIPKKGNIYSVNEGNAQNWDGPTTKYVEKCKFPKDGSPAKSLRYVGSMVADVHRTLLYGGIFLYPADKKSPNGKLRVLYEVFPMSFLMEQAGGQAFTGKKRALDLVPEKIHERSPIFLGSYEDVEEIKALYAAEE

SEQ ID NO: 5974 - protein, 338 aa, Brassica oleracea
MDHEADAYRTDLMTITRFVLNEQSKYPESRGDFTILLSNIVLGCKFVCSAVNKAGLAKLIGLAGETNIQGEEQKKLDVLSNDVFVKALVSSGRTSVLVSEEDEEATLVESSKRGKYCVVFDPLDGSSNIDCGVSIGTIFGIYTMSHNDEPTTEDVLKPGNEMVAAGYCMYGSSCMLVLSTGTGVNGFTLDPSLGEFILTHPDIKIPKKGNIYSVNEGNAQNWDGPTTKYVEKCKFPKDGSPAKSLRYVGSMVADVHRTLLYGGIFLYPADKKSPNGKLRVLYEVFPMSFLMEQAGGQAFTGKKRALDLVPEKIHERSPIFLGSYEDVEEIKALYAAED

SEQ ID NO: 5975 - protein, 340 aa, Brassica juncea
MDHEADAYRTDLMTITRFVLNEQSKYPESRGDFTILLSNIVLGCKFVCSAVNKAGLAKLIGLAGETNIQGEEQKKLDVLSNDVFVKALVSSGRTSVLVSEEDEEATLVESSKRGKYCVVFDPLDGSSNIDCGVSIGTIFGIYTMSHNDEPTTEDVLKPGNEMVAAGYCMYGSSCMLVLSTGTGVNGFTLDPSLGEFILTHPDIKIPKKGNIYSVNEGNAQNWDGPTTKYVEKCKFPKDGSPAKSLRYVGSMVADVHRTLLYGGIFLYPADKKSPNGKLRVLYEVFPMAFLMEQAGGQAFTGKKRALDLVPKKIHERSPIFLGSYDDVEEIKALYAAEENN

SEQ ID NO: 5976 - protein, 327 aa, Ananas comosus
MDHEADAYRTDLMTITRFVLNEQSKFPESRGDFTILMSHIVLGCKFVHAAVNKAGLAKLLGLAGETNIQGEEQKKLDVLSNEVFVKALVSSGRTSILVSEEDEEATFVDPSIRGRYCVVFDPLDGSSNIDCGVSIGTIFGIYMIKDSGEPSLDDVLQPGKNMIAAGYCMYGSSCTLVLSAGSGVNGFTLDPSLGEFILTHADIKIPKKGKIYSVNEGNAKNWDEPTAKYVQKCKFPEDGSPAKSLRYIGSMVADVHRTLLYGGIFLYPGDKKSPSGKLRVLYEVFPMSFLMEQAGGQAFTGKERALDMIPKKIHERSPIFLGSYDDV

SEQ ID NO: 5977 - protein, 340 aa, Brassica napus
  Sequence also found in Organisms: Brassica rapa
MDHEADAFRTDLMTITRFVLNEQSKYPESRGDFTILLSNIVLGCKFVCSAVNKAGLAKLIGLAGDTNIQGEEQKKLDVLSNDVFVKALVSSGRTSVLVSEEDEEATFVESSKRGKYCVVFDPLDGSSNIDCGVSIGTIFGIYTMEHSDEPTTKDVLKPGNEMVAAGYCMYGSSCMLVLSTGTGVHGFTLDPSLGEFILTHPDIKIPKKGNIYSVNEGNAQNWDGPTTKYVERCKYPKDGSPAKSLRYVGSMVADVHRTLLYGGIFLYPADKKSPNGKLRVLYEVFPMAFLMEQAGGQAFTGKKRALDLVPKKIHERSPIFLGSYDDVEEIKALYAAEENN

SEQ ID NO: 5978 - protein, 340 aa, Brassica juncea
MDHEADAYRTDLMTITRFVLNEQSKYPESRGDFTILLSNIVLGCKFVCSAVNKAGLAKLIGLAGETNIQGEEQKKLDVLSNDVFVKALVSSGRTSVLVSEEDEEATLVESSKRGKYCVVFDPLDGSSNIDCGVSIGTIFGIYTMSHNDEPTTEDVLKPGHEMVAAGYCMYGSSCMLVLSTGTGVNGFTLDPSLGEFILTHPDIKIPKKGNIYSVNEGNAQNWDGPTTKYVEKCKFPKDGSPAKSLRYVGSMVADVHRTLLYGGIFLYPADKKSPNGKLRVLYEVFPMAFLMEQAGGQAFTGKKRALDLVPEKIHERSPIFLGSYEDVEEIKALYAGEEEN

SEQ ID NO: 5979 - protein, 338 aa, Ceratodon purpureus
MDHAADAMRTDLMTITRYVLNEQSRFPEARGDLTILLNNIVLGCKFVCSSVSKAGLAKLIGLAGETNVQGEEQKKLDVLSNDVFVNALVSSGRTNVLVSEEIEDAIFVEKAKRGRYCVVFDPLDGSSNIDCGVSIGTIFGIYMLKDGIEGTVEDVLQPGTAMLAAGYCMYGSSCTLVLSTGAGVNGFTLDPSLGEFILTHPDIKIPKKGKIYSVNEGNAMNWDAPTTKYVQNAKFPKDGASPKSLRYIGSMVADVHRTLLYGGIFMYPGDKKSPKGKLRVLYEVFPMSFLMEQAGGQAFTGKERALELVPTHIHDRSPIFLGSYDDVEEIKALYAEAA

SEQ ID NO: 5980 - protein, 143 aa, Cucurbita pepo
MDHAADAQRTDLMTITRFVLNEQSKYSESRGDFTILLSHIVLGCKFVCSAVNKAGLAKLIGLAGETNVQGEEQKNWMCSQMKSLSRLWSAVVELVSLFLKKMKSRHTSSHLAVEGILWCLIHWMDPPTLIVGFLLERFLESIS

SEQ ID NO: 5981 - protein, 343 aa, Lupinus angustifolius
MDHAIDTNRTDLMTITRFVLNEQSKYPESRGDFTILISNIVLGCKFVCSAVNKAGLAKLIGLAGETNVQGEEQKKLDVLSNEVFVKALVSSGRTCLLVSEELEEAIFVPPSQHGKYIVVFDPLDGSSNIDCGVSIGTIFGIYMVKDKDNVTLDDVLQPGNKMLAAGYCMYGSSCTFVISTGNGVNGFTLDPSLGEFILTHPDIKVPRKGKIYSVNEGNAKNWDEPTTKYVENCKFPQDGSPPKSLRYIGSMVADIHRTLLYGGMFMYPADIKSPNGKLRLLYEVFPMSYLMEQAGGQAFTGKERALDLVPSHIHERSPVFLGSYEEIEHIKDLYASCQANNGA

SEQ ID NO: 5982 - protein, 264 aa, Zostera marina
MDHEADAMRTDLMTLTRYVLNEQSKHPESTGDYTILLAHIVLGCKFVCSAVNKAGLASLVGLAGDTNIQGEEQKKMDVLSNEVFVKALVSSHRTCILVSEEDEEATFVDPALRGRYCVVFDPLDGSSNIDCGVSIGTIFGIYMVDDPNNISLNDVLQPGKNMVAAGYCMYGSSCTLVLSSGNGVNGFTLDPSLGEFILTHPDIKIPPKGKIYSVNEGNAKNWDNPTAKYVEKCKYPTDGPPKSLRYIGSMVADIHRTLLYGGIF

SEQ ID NO: 5983 - protein, 340 aa, Brassica oleracea
MDHEADAYRTDLMTITRFVLNEQSKYPESRGDFTILLSNIVLGCKFVCSAVNKAGLAKLIGLAGDTNIQGEEQKKLDVLSNDVFIKALVSSGRTSVLVSEEDEEATFVESSKRGKYCVVFDPLDGSSNIDCGVSIGTIFGIYTMEHSDEPTTKDVLKPGNEMVAAGYCMYGSSCMLVLSTGTGVHGFTLDPSLGEFILTHPDIKIPKKGNIYSVNEGNAQNWDGPTTKYVERCKYPKDGSPAKSLRYVGSMVADVHRTLLYGGIFLYPADKKSPNGKLRVLYEVFPMAFLMEQAGGQAFTGKKRALDLVPKKIHERSPIFLGSYDDVEEIKALYAAEENN

SEQ ID NO: 5984 - protein, 340 aa, Raphanus sativus
MDHEADAYRTDLMTITRFVLNEQSKYPESRGDFTILLSNIVLGCKFVCSAVNKAGLAKLIGLAGETNIQGEEQKKLDVLSNDVFIKALVSSGRTSVLVSEEDEEATFVESSKRGKYCVVFDPLDGSSNIDCGVSIGTIFGIYTMNHSDEPSTEDVLKPGNEMVAAGYCMYGSSCMLVLSTGTGVHGFTLDPSLGEFILTHPDIKIPNKGNIYSVNEGNAQNWDGPTTKYVERCKYPKDGSPAKSLRYVGSMVADVHRTLLYGGIFLYPADKKSPNGKLRVLYEVFPMAFLMEQAGGQAFTGKKRALDLVPEKIHERSPIFLGSYDDVEEIKALYATEEKN

SEQ ID NO: 5985 - protein, 342 aa, Tripterygium wilfordii
MDHESEAHRTDLMTITRFVLNEQSKFPESRGDLTILLNNIVLGCKFVCNAVSKAGLAKLIGLAGETNIQGEEQKKLDVLSNEVFIKALVSSGRTCILVSEEDEEATFVEVSMRGRYIVVFDPLDGSSNIDCGVSIGTIFGIYMVENTDNPTLEDVLKPGSHMTAAGYCMYGSSCTLVFSTGSGVNGFTLDPSIGEFILTHPDIKIPKKGKIYSVNEGNAKNWDEPTAKYVENCKFPTDGSSSKSLRYIGSMVADVHRTLLYGGIFLYPADKKSPNGKLRVLYEVFPMSYLMEQAGGQAFTGKQRALDLVPKKIHERSPVFLGSYDDVEEIKALYAAAERKGA

SEQ ID NO: 5986 - protein, 335 aa, Ambrosia trifida
MDHAADTFRTDLMTITRFVLNEQSKYPESRGDFSILLSNIVLGCKFVCAAVNKAGLAKLIGLAGETNVQGEEQKKLDVLSNEVFVKALVSSGRTCILVSEEDEEAIFVEPSKRGKYCVVFDPLDGSSNIDCGVSIGTIFGIYMLKDGAESRLEDVLQPGKNMLAAGYCMYGSSCTLVLSTGSGVNGFTLDPSLGEFILTHPDIKIPKKGKIYSVNEGNAKNWDGPTTKFVEKCKFPKDGSPAKSLRYIGSMVADVHRTLLYGGVFLYPADKKSPSGKLRVLYEVFPMSFLMEQAGGQSFTGKERALDLVPKKIHERSPIFWEAMMTWKNQGPVCS

SEQ ID NO: 5987 - protein, 75 aa, Pinus pinaster
MDHAAEAHRTDLMTITRFVLNEQSKHPEARGDFTILLSHIVLGCKFVCSSVSKAGLAKLIGLAGEVNVQGEQQKS

SEQ ID NO: 5988 - protein, 308 aa, Avena sativa
MDHAADTFRTDLMTITRHVLNEQSRHPESRGDLTILLSHIVLGCKFVASAVNKAGLAKLTGLAGETNVQGEEQKKLDVLSNEVFVNALVSSGRTCVLVSEEDEKATFVDPKLRGKYCVCFDPLDGSSNIDCGVSIGTIFGIYMIKNQDTVTLEEVLQPGKDMIAAGYCMYGSSCTLVLSTGNGVNGFTLDPSLGEFIMTHPDIKIPPKGKIYSVNEGNAKNWDTPTAKYVEKCKYPTDGSSPKSLRYIGSMVADVHRTLLYGGIFLYPADKKSPSGKLRVMYEVFPMSFLMEEAGGQSFTRTKDGRST

SEQ ID NO: 5989 - protein, 342 aa, Euonymus alatus
MDHESEAHRTDLMTITRFVLNEQSKFPESRGDLTILLSHIVLGCKFVCNAVGKAGLAKLLGLAGDTNIQGEEQKKLDVLSNEVFIKALVSSGRTCILVSEEDEEATFVEVSMRGKYIVVFDPLDGSSNIDCGVSIGTIFGIYTVTNTDNPTLEDVLKPGSHMTAAGYCMYGSSCTLVLSTGGGVNGFTLDPSIGEFILTHPDIKIPKKGKIYSVNEGNAKNWDEPTAKYVENCKFPKDGSSSKSLRYIGSMVADVHRTLLYGGIFLYPADKKSPNGKLRVLYEVFPMSYLMEQAGGQAFTGKQRALDLVPETIHERSPVFLGSYDDVEEIKALYAAAERKGA

SEQ ID NO: 5990 - protein, 337 aa, Pteridium aquilinum
MDHAADAQRTDLMTITRFVLNEQSKFPEARGDLTILLNQIVLGCKFVCSCVSKAGLAKLIGLAGETNVQGEEQKKLDVLSNDVFIKALVSSGRTNVLVSEELEEAVFVEEKLRGRYCVVFDPLDGSSNIDCGVSIGTIFGIYMLKEGSAGTLNDVLQPGKNMIAAGYCMYGSSCTLVLSTGSGVNGFTLDPSLGEFILTHPDIKIPQKGKIYSVNEGNAKNWDEPTTKFVEDCKFPKDGSSPKSLRYIGSMVADVHRTLLYGGIFMYPADKKSPSGKLRVLYEVFPMSFLVEQAGGAAFTGKERALDIIPAKIHQRSPIFLGSPNDVEKIKALYAAA

SEQ ID NO: 5991 - protein, 327 aa, Trigonella foenum-graecum
MTITRFVLNEQSKHPESRGDFTILLNNIVLGCKFVCSAVNKAGLAKLIGLAGETNVQGEEQKKLDVLSNEVFCKALISSGRTCILVSEEDEDAIFVEPTQRGKYCVVFDPLDGSSNIDCGVSIGTIFGIYMMKDNHEPIIEDVLQPGKNMLAAGYCMYGSSCTFVITTGSGVNGFTLDPSLGEFILTHPDIKIPKKGKIYSVNEGNAKNWDGPTAAYVEKCKFPTDGSSAKSLRYIGSMVADVHRTLLYGGTFLYPADKKSPNGKLRVLYEVFPMSFLMEQAGGQAFTGKERALDLVPTKLHERSPIFLGSYDDIEEIKALYAAEAK

SEQ ID NO: 5992 - protein, 339 aa, Physcomitrella patens
MDHAADAMRTDLMTITRHVLNEQSKFPEARGDLTILLNNIVLGCKFVCSSVSKAGLAKLIGLAGETNVQGEEQKKLDVLSNDVFINALVSSGRTNVLVSEENEDAIFVEPSKRGRYCVVFDPLDGSSNIDCGVSIGTIFGIYMLKEGASGTVEDVLQPGTAMLAAGYCMYGSSCTLVLSTGAGVNGFTLDPSLGEFILTHPDIKIPKKGKIYSVNEGNAKHWDGPTTKYVENAKFPKDGSSPKSLRYIGSMVADVHRTLLYGGIFMYPGDKKSPKGKLRVLYEVFPMSFLVEQAGGQSFTGKQRSLDLVPAHIHDRSPIFLGSYDDVEEIKALYAAESA

SEQ ID NO: 5993 - protein, 342 aa, Picea glauca
MDHAAEAHRTDLMTITRFVLNEQSKHPEARGDFTILLSNIVLGCKFVCSAVSKAGLAKLIGLAGEINVQGEEQKKLDVLSNEVFIKALISSGRTSILVSEENEQATFVEPSKRGRYCVVFDPLDGSSNIDCGVSIGTIFGIYLRKDDSEGTLNDVLQPGKNMVAAGYCMYGSSCTLVLSTGTGVNGFTLDPSLGEFILTHPDIKVPKKGKIYSVNEGNAKNWDEPTKKYVERCKFPEDGSSPKSLRYIGSMVADVHRTLLYGGIFMYPADKKSPNGKLRTLYEVFPMSFLMEQAGGQAFTGTGRALDIVPTTIHQRSPIFLGSFEEVEEIKSLYAAHESKTL

SEQ ID NO: 5994 - protein, 122 aa, Chrysanthemum coronarium
HPESRGDFSILLSHIVLGCKFVCAAVNKAGLAKLIGLAGETNVQGEEQKKLDVLSNQVFVKALVSSGRTCILVSEEDEEAIIVEPSKRGKYCVVFDPLDGSSNIDCGVSIGTIFGIYMIQRR

SEQ ID NO: 5995 - protein, 83 aa, Silene vulgaris
EAYKTDLMTITRHVLNEQSKHPESRGDFTILLSHIVLGCKFVCSAVNKAGLAKLIGLAGETNVQGEEQKKLDVLSNEVLSRPL

SEQ ID NO: 5996 - protein, 339 aa, Physcomitrella patens
MDHAADAMRTDLMTITRHVLNEQSRFPEARGDLTILLNNIVLGCKFVCSSVSKAGLAKLIGLAGETNVQGEEQKKLDVLSNHVFINALVSSGRTNVLVSEENEEAIFVESSKRGRYCVVFDPLDGSSNIDCGVSIGTIFGIYMLKEGASGTVEDVLQPGTAMLAAGYCMYGSSCTLVLSTGAGVNGFTLDPSLGEFILTHPNIKIPKKGKIYSVNEGNAKHWDGPTTKYVENAKFPKDGSSPKSLRYIGSMVADVHRTLLYGGIFMYPGDKKSPKGKLRVLYEVFPMSFLVEQAGGQSFTGKQRALELVPAHIHDRSPIFLGSSDDVEEIKALYAAESA

SEQ ID NO: 5997 - protein, 342 aa, Pinus taeda
MDHAAEAHRTDLMTITRFVLNEQSKHPEARGDFTILLSHIVLGCKFVCSCVSKAGLARLIGLAGEVNVQGEQQKKLDVLSNEVFIKALISSGRTSILVSEEDEQATFVEPSKRGRYCVVFDPLDGSSNIDCGVSIGTIFGIYMLKDDSEGTLNDVLQPGKKMVAAGYCMYGSSCTLVLSTGTGVNGFTLDPSLGEFILTHPNIKVPEKGKIYSVNEGNTKNWDEPTKKYVERCKFPEDGSSPKSLRYIGSMVADVHRTLLYGGIFMYPADKKSPNGKLRTLYEVFPMSFLMEQAGGQAFTGTGRALDIVPTTIHQRSPIFLGSFEDIEEIKSLYAAYEAKTF

SEQ ID NO: 5998 - protein, 315 aa, Heritiera littoralis
MDYAADAHRTDLMTITRFVLNEQSKRPESRGDFTILLNHIVLGCKFVCSAVNKAGLAKLIGLAGETNVQGEEQKKLDVLSNEVFIKALVSSGRTCILVSEEDEEATFVEPSKRGRYCVVFDPLDGSSNIDCGVSIGTIFGIYMIKDTHEPTLDDVLQPGKHMLAAGYCMYGSSCTLVLSTGGGVNGFTLDPSLGEFILTHPDIKIPKKGKIYSVNEGNAKNWDGPTAKYVEKCKFPKDGSSSKSLRYIGSMVADVHRTLLYGGIFLYPADKKSPSGKLRVLYEVFPMSFLMEQAGGQAFTGKQRALDLVPTKIHE

SEQ ID NO: 5999 - protein, 270 aa, Podocarpus macrophillus
MDHTADAHRTDLMTITRFVLNEQSKHPASQGDFTILLSHIVLGCKFVCSAVSKAGLAKLIGLAGETNVQGEEQKKLDVLSNEVFVKALVSSGRTCILVSEEDELATFVEPSLRGKYCVVFDPLDGSSNIDCGVSIGTIFGIYQMKDGGEPTLADVLQPGKNMAAAGYCMYGSSCTLVLSTGTGVNGFTLDPSLGEFILTHPDIKIPKKGNIYSVNEGNAKNWDDPTRKYVERCKFPKDGSSSKSLRYIGRKYVALIVELVPISPVVQYGS

SEQ ID NO: 6000 - protein, 75 aa, Cedrus atlantica
MNHAAEAHRTDLLTITSFVLNEQSKHPEARGDFTILLSHIVLGCKFVCSAVSKAGLAKLIGLAGEVNVQGEEQKN

SEQ ID NO: 6001 - protein, 320 aa, Ananas comosus
MDHEADAYRTDLMTITRFVLNEQSKFPESRGDFTILMSHIVLGCKFVHAAVNKAGLAKLLGLAGETNIQGEEQKKLDVLSNEVFVKALVSSGRTSILVSEEDEEATFVDPSIRGRYCVVFDPLDGSSNIDCGVSIGTIFGIYMIKDSREPTLDDVLQPGKNMIAAGYCMYGSSCTLVLSAGSGVNGFTLDPSLGEFILTHADIKIPNKGKIYSVNEGNAKNWDEPTAKYVQKCKFPEDGSPAKSLRYIGSMVADVHRTLLYGGIFLYPGDKKSPSGKLRVLYEVFPMSFLMEQAGGQAFTGKERALDMVPKKIHERSPIF

SEQ ID NO: 6002 - protein, 342 aa, Glycine max
MDHQADTNRTDLMTITRFVLNEQSKYPESRGDFTILLSHIVLGCKFVCSAVNKAGLAKLIGLAGETNVQGEEQKKLDVLSNEVFVKALISSGRTCLLVSEEVEEAIFVPSSHRGKYIVVFDPLDGSSNIDCGVSIGTIFGIYMVKNEAEVSLEDALQPGNQMLAAGYCMYGSSCTFVLSTENGVNGFTLDPSLGEFILTHPNIKIPSKGKIYSVNEGNARNWDEPTTKYVQMCKFPQDGSPPKSLRYIGSMVADIHRTLLYGGIFMYPADAKSPNGKLRLLYEVFPMSYLMEQAGGQAFTGKQRALDLIPKKIHERSPVFLGSYDDIEQMKELYAASKEDDA

SEQ ID NO: 6003 - protein, 319 aa, Flaveria ramosissima
TVEASGVAWGVSSILLSHIVLGCKFVCAAVNKAGLAKLIGLAGETNVQGEEQKKLDVLSNEVFVKALVSSGRTCILVSEEDEEAIIVEPSKRGKYCVVFDPLDGSSNIDCGVSIGTIFGIYMIKDSDAARLEDVLQPGKNMLAAGYCMYGSSCTLVLSTGSGVNGFTLDPSLGEFILTHPDIKIPKKGKIYSVNEGNAKNWDGPTAKFVEKCKFPKDGSPAKSLRYIGSMVADVHRTLLYGGVFLYPADKKSPNGKLRVLYEVFPMSFLMEQAGGQAFTGKERALDLVPKKIHDRSPIFLGSYDDVEEIKALYAAEEKA

SEQ ID NO: 6004 - protein, 320 aa, Trifolium pratense
NEQSKHPESRGDFTILLSHIVLGCKFVCSAVNKAGLAKLIGLAGETNVQGEEQKKLDVLSNEVFCKALISSGRTSILVSEEDEDAIFVQPSLRGKYCVVFDPLDGSSNIDCGVSIGTIFGIYMMKDSHEPVIEDVLQPGKNLLAAGYCMYGSSCTLVISTGSGVNGFTLDPSLGEFILTHPDIKIPKKGKIYSVNEGNAKNWDGPTASYVEKCKFPTDGSPAKSLRYIGSMVADVHRTLLYGGTFLYPADKKSPNGKLRVLYEVFPMSFLMEQAGGQAFTGKERALDLIPTKLHERSPIFLGSYDDIEEIKALYAAEEGK

SEQ ID NO: 6005 - protein, 342 aa, Trifolium pratense
MDHEGDANRTDLMTITRFVLNEQSKYAESRGDFTILISHIVLGCKFVCSSVNKAGLAKILGLAGDTNVQGEEQKKLDVISNEVFVKALISSGRTCLLVSEENEDAIIVPPAQRGKYLVVFDPLDGSSNIDCGVSIGTIFGIYMVKDTNNVSVEDALQPGSSLVAAGYCMYGSSCTFVLSTGNGVNGFTLDPSLGEFILTHPNIKIPKKGKIYSVNEGNAKNWDEPTTKYVESCKFPQDGSSPKSLRYIGSMVADIHRTLLYGGIFMYPADKKSPNGKLRVLYEVFPMSYLMEQAGGQAFTGKQRALDLVPEKIHDRSPIFLGSYDEIEKMKELYAESKANGA

SEQ ID NO: 6006 - protein, 342 aa, Medicago truncatula
MDHQADANRTDLMTITRFVLNEQSKYAESRGDFTILINHIVLGCKFVCSSVNKAGLAKILGLAGDTNVQGEEQKKLDVISNEVFVKALISSGRTCLLVSEEVEDAIIVPPAQRGKYIVVFDPLDGSSNIDCGVSIGTIFGIYTVKDTAEVSVEDALQPGSSLVAAGYCMYGSSCTFVLSTGNGVNGFTLDPSLGEFILTHPNIKIPKKGKIYSVNEGNAKNWDEPTAKYVENCKFPQEGSAPKSLRYIGSMVADVHRTLLYGGIFMYPADKKSPNGKLRVLYEVFPMSYLMEQAGGQAFTGKQRALDLVPKKIHDRSPIFLGSYDEIEHIKELYAESKENGA

SEQ ID NO: 6007 - protein, 308 aa, Arnica chamissonis
FSILLSNIVLGCKFVCSAVNKAGLAKLIGLAGETNVQGEEQKKLDVLSNEVFVKALVSSGRTCILVSEEDEEAIIIEPSKRGKYCVVFDPLDGSSNIDCGVSIGTIFGIYMIKDGDEARLEDVLQPGSNMLAAGYCMYGSSCTLVLSTGSGVNGFTLDPSLGEFILTHPDIKIPKKGKIYSVNEGNAKNWDGPTAKFVEKCKFPTDGSPAKSLRYIGSMVADVHRTLLYGGVFLYPADKKSPNGKLRVLYEVFPMSFLMEQAGGQSFTGKERALDLVPKKIHERSPIFLGSYDDVEEIKALYAAEEKA

SEQ ID NO: 6008 - protein, 305 aa, Flaveria ramosissima
LLSHIVLGCKFVCAAVNKAGLAKLIGLAGETNVQGEEQKKLDVLSNEVFVKALVSSGRTCILVSEEDEEAIIVEPSKRGKYCVVFDPLDGSSNIDCGVSIGTIFGIYMIKDSDAARLEDVLQPGKNMLAAGYCMYGSSCTLVLSTGSGVNGFTLDPSLGEFILTHPDIKIPKKGKIYSVNEGNAKNWDGPTAKFVEKCKFPKDGSPAKSLRYIGSMVADVHRTLLYGGVFLYPADKKSPNGKLRVLYEVFPMSFLMEQAGGQAFTGKERALDLVPKKIHERSPIFLGSYDDVEEIKALYAAEQKA

SEQ ID NO: 6009 - protein, 339 aa, Cajanus cajan
MNYEADTNMTDLMTITRFVLNEQSKYPESRGDFTILLSHVVLGCKFVCSAVNKAGLAKLLGLAGDTNVQGEEQKKLDVLSNEVFVKALISSGRTCLLVSEEVEEAIFVPPSHRGKYIVVFDPLDGSSNIDCGVSIGTIFGIYMVKDETKVSLEDALQPGNKLLAAGYCMYGSSCTFVLSTGNGVNGFTLDPSLGEFILTHPNIKIPRKGKIYSVNEGNAKNWDEPTTKYVQKCKFPQDGLPPKSLRYIGSMVADIHRTLLYGGIFMYPADIKSPNGKLRLLYEVFPMSFLMEQAGGQAFTGKQRALDLVPKQIHERSSIFLGSYDDIEQMKELYAADGA

SEQ ID NO: 6010 - protein, 223 aa, Setaria italica
MPLPSAEKMLSVYLYIPNIIGYFRIIINFIAFAVCYSNKPLFAILYFFSFVLDGVDGWFARKFNQASTFGSVLDMVTDRVSTACLLALLSQCYKPGLIFLMLLGLDITSHWFQMYSSLLSGKTSHKDVKHTNNWLLKLYYGYRPFMAFCCVSCEVLYIILFLFADEKSTSLLSVCRVVMKQSPLIVLVFISTLVGWAVKQVSNITQMKTAADTCVEFDPKHSK

SEQ ID NO: 6011 - protein, 215 aa, Sorghum bicolor
MPSVYLYIPNIIGYFRIIINFIAFAVCYSNKALFALLYFFSFVLDGVDGWFARKFNQASTFGAVLDMVTDRVSTACLLALLSQFYRPGLVFLILLGLDITSHWFQMYSSFLSGKTSHKDVKHTGNWLLKLYYGYRPFMAFCCVSCEVLYIILFLFADEKSTSLLSVCKGVLNQNPVVVLVFISTLVGWAVKQVTNVIQMKTAADACVVYDLKRSK

SEQ ID NO: 6012 - protein, 215 aa, Saccharum officinarum
MPSVYLYIPNIIGYFRIIINFIAFAVCYSNKALFAVLYFFSFVLDGVDGWFARKFNQASTFGAVLDMVTDRVSTACLLALLSQFYRPGLVFLILLGLDITSHWFQMYSSFLSGKTSHKDVKHTGNWLLKLYYGYRPFMAFCCVSCEVLYIILFLFADEKSTSLLSVCKGVLNQNPVVVLVFISTLVGWAVKQVTNVIQMKTAADACVVYDLKRSK

SEQ ID NO: 6013 - protein, 215 aa, Setaria italica
MPSVYLYIPNIIGYFRIIINFIAFAVCYSNKALFAILYFFSFVLDGVDGWFARKFNQASTFGAVLDMVTDRVSTACLLALLSQFYRPGLVFLILLGLDITSHWFQMYSSFLSGKSSHKDVKHTGNWLLKLYYGYRPFMAFCCVSCEVLYIILFLFADEKSTSLLSVSRGILNQSPLIVLVFISTLVGWAVKQVTNVIQMKTAADACVVYDLKRGK

SEQ ID NO: 6014 - protein, 215 aa, Echinochloa colona
MPSVYLYIPNIIGYFRIIINFIAFAVCYSNKALFAILYFISFVLDGVDGWFARKFNQASTFGAVLDMVTDRVSTACLLALLSQFYRPGLVFLILLGLDITSHWFQMYSSFLSGKTSHKDVKHTGNWLLKLYYGYRPFMAFCCVSCEVLYIILFLFADEKSTSLLSVCRSILNQNPLIVLVFLSTLVGWAVKQITNVIQMKTAADACVVYDLKRSK

SEQ ID NO: 6015 - protein, 215 aa, Panicum virgatum
MPSVYLYIPNIIGYFRIIINFIAFAVCYSNKTLFAILYFISFVLDGVDGWFARKFNQASTFGAVLDMVTDRVSTACLLALLSQFYRPGLVFLILLGLDITSHWFQMYSSFLSGKTSHKDVKHTGNWLLKLYYGYRPFMAFCCVSCEVLYIILFLFADVKSTSLLSVCRGILNQSPLIVLVFVSTLIGWAVKQLTNIIQMKTAADACVVYDLKRSK

SEQ ID NO: 6016 - protein, 218 aa, Zea mays
MPSVYLYIPNIIGYFRIIINFIAFAVCYSNKALFAVLYFFSFVLDGVDGWFARKFNQASTFGAVLDMVTDRVSTACLLALLSQFYRPGLVFLILLGLDITSHWFQMYSSFLSGKTSHKDVKHTGNWLLKLYYGYRPFMAFCCVSCEVLYIILFLFADEKSTSLLSACKGLLNQSPIIILVFISTLVGWAVKQVTNVIQMKTAADACVVYDLKRSKRKA

SEQ ID NO: 6017 - protein, 223 aa, Brachypodium distachyon
MAQSSAEKTPSVYLYIPNIIGYFRIIINFIAFAVCYSNRTLFAILYFFSFFCDGLDGWFARRFNQASTFGAVLDMVTDRVSTACLLALLSQFYRPGLVFLILLGLDITSHWFQMYSSFLSGKTSHKDVKDTGYWLLKLYYGYRPFMAFCCVASEVLYIILFLFADEKSTSLLKVCRGMLKESPLIVFIFISTLIGWALKQVINVIQMKTAADACVVFDLKRGK

SEQ ID NO: 6018 - protein, 215 aa, Pennisetum glaucum
MPSVYLYIPNIIGYFRIIINFIAFAVCYSNKALFAILYFISFVLDGVDGWFARKFNQASTFGAVLDMVTDRVSTACLLALLSQFYRPGLVFLILLGLDITSHWFQMYSSFLSGKSSHKDVKHTGNWLLKLYYGYRPFMAFCCVSCEVLYIILFLFADEKSTSLLSVSRSILNQSPLIVLVFISTLVGWAVKQVTNVIQMKTAADACVMYDLKRGK

SEQ ID NO: 6019 - protein, 223 aa, Oryza sativa
MAQPSSKKTPSVYLYIPNIIGYFRIIINFIAFAVCYSNRVLFAILYFFSFFCDGLDGWFARKFNQASTFGAVLDMVTDRVSTACLLALLSQFYRPGLVFLMLLGLDITSHWFQMYSSFLSGKTSHKDVKDTGNWLLKLYYGHRPFMAFCCVASEVLYIVLFLFADEKSTSLLNVCGNLLKQSPLTVFVFISTLVGWALKQVINVIQMKSAADACVVFDLKRGK

SEQ ID NO: 6020 - protein, 215 aa, Panicum virgatum
MPSVYLYIPNIIGYFRIIINFKAFAICYSNKALFAILYFISFVLDGVDGWFARKFNQASTFGAVLDMVTDRVSTACLLALLSQFYRPGLVFLILLGLDITSHWFQMYSSFLSGKTSHKDVKHTGNWLLKLYYGHRPFMAFCCVSCEVLYIILFLFADEKSTSLLSVCRGILNQSPLIVLVFVSTLIGWAVKQLTNIIQMKTAADACVMYDLKRSK

SEQ ID NO: 6021 - protein, 215 aa, Zea mays
MPSVYLYIPNIIGYFRIIINFIAFAVCYSNKALFAILYFISFVLDGVDGWFARKFNQASTFGAVLDMVTDRVSTACLLALLSQFYRPGLVFLILLGLDITSHWFQMYSSFLSGKTSHKDVKHTGNWLLKLYYGYRPFMAFCCVSCEVLYIFLFLFADEESTSLLSVCKGILNQSPVVILVFVSTLVGWAVKQATNVIQMKTAADACVVYDLKRSK

SEQ ID NO: 6022 - protein, 223 aa, Hordeum vulgare
MAQPPAKKTLSVYLYIPNIIGYFRIIINFIAFAVCYTNRTLFAILYFFSFFCDGLDGWFARRFNQASTFGAVLDMVTDRVSTACLLALLSQFYRPGLVFILLLGLDITSHWFQMYSSFLSGKTSHKDVKHTGNGLLKLYYGYRPFMAFCCVASEVLYIILFLYADEKSTSLLNTCRGILKESPLVVFMFISTLIGWALKQVINVIQMKTAADACVAFDSKRGK

SEQ ID NO: 6023 - protein, 223 aa, Secale cereale
MAQPPAKKALSVYLYIPNIIGYFRIIINFIAFAVCYTNRTLFAILYFFSFFCDGLDGWFARRFNQASTFGAVLDMVTDRVSTACLLALLSQFYRPGLVFILLLGLDITSHWFQMYSSFLSGKTSHKDVKHTGNGLLKLYYGYRPFMAFCCVASEVLYIILFLYADEKSTSLLKTCRGILKESPLVVFMFISTLIGWALKQVINVIQMKTAADACVAFDSKRGK

SEQ ID NO: 6024 - protein, 223 aa, Secale cereale
MAQPPAKKTLSVYLYIPNIIGYFRIIINFIAFAVCYTNRTLFAILYFFSFFCDGLDGWFARRFNQASTFGAVLDMVTDRVSTACLLALLSQFYRPGLVFILLLGLDITSHWFQMYSSFLSGKTSHKDVKHTGNGLLKLYYGYRPFMAFCCVASEVLYIILFLYADEKSTSLLKTCRGILKESPLVVFMFISTLIGWALKQVINVIQMKTAADACVAFDSKRGK

SEQ ID NO: 6025 - protein, 223 aa, Triticum aestivum
MAQPPAKKTLSVYLYIPNIIGYFRIIINFIAFAVCYTNRTLFAILYFFSFFCDGLDGWFARRFNQASTFGAVLDMVTDRVSTACLLALLSQFYRPGLVFILLLGLDITSHWFQMYSSFLSGKTSHKDVKHTGNGLLKLYYGYRPFMAFCCVASEVLYIILFLYADAKSTSLLNTCRGILKESPLVVFMFISTLIGWALKQVINVIQMKTAADACVAYDSKRGK

SEQ ID NO: 6026 - protein, 223 aa, Avena sativa
MATPSAKEGPSVYLYIPNLIGYLRIIMNFIAFAVCYSNRTLFAILYFFSFFCDGLDGWFARKFNQASTFGAVLDMVTDRVSTACLLALLSQFYRPGLVFILLLGLDISSHWFQMYSSFLSGKTSHKDVKHTGNGLLKLYYGYRPFMAFCCVASEVLYIILFLFADEKNTSLLSVCRGILKESPLIVFMFISTLIGWALKQVINVIQMKTAADACVVYDLKRGK

SEQ ID NO: 6027 - protein, 220 aa, Brachypodium distachyon
MARPSAGKTQSVYLYIPNIIGYFRIIINFIAFGVCYSNRPLFAVLYFFSFLCDGLDGWFAQKFNQASTFGAVLDMVTDRVSTACLLALLSQFYRPGLVFLMLLGLDITSHWFQMYSSFLSGKSSHKDVEDKGNWLLKLYYRYRPFMAFCCVASEVLYIVLFLFADEKFKSLLYVCRGIMKQSPLIILVFVASLVGWALKQVINVIQMKTAADACVMFDPK

SEQ ID NO: 6028 - protein, 223 aa, Lolium multiflorum
MAQPSAKKAPSVYLYIPNLIGYLRIIMNFIAFAVCYSNRTLFAILYFFSFFCDGLDGWFARKFNQASTFGAVLDMVTDRVSTACLLALLSQFYRPGLVFILLLGLDISSHWFQMHSSFLSGKASHKDVKHTENGLLKFYYGYRPFMAFCCVASEVLYIILFLFADEKNTSLLSVCRGILKESPLIIFVFISTLIGWALKQVINVIQMKTAADACVVYDLKRGK

SEQ ID NO: 6029 - protein, 224 aa, Festuca arundinacea
HEAQPSAKKGPSVYLYIPNLIGYLRIIMNFIAFAVCYSNRTLFAILYFFSFFCDGLDGWFARKFNQASTFGAVLDMVTDRVSTACLLALLSQFYRPGLVFILLLGLDISSHWFQMHSSFLSGKTSHKDVKHTENGLLKLYYGYRPFMAFCCVASEVLYIILFLFADEKNTSLLSVCRGILKESPLIVFVFISTLIGWALKQVINVIQMKTAADASVAYDLKRGK

SEQ ID NO: 6030 - protein, 348 aa, Setaria italica
MGDSGGSVVSVDVERISFGGKEHHIQTNHGPVSVAVYGDHDKPALVTYPDIALNHMSCFQGLLFCPEAASLLLHNFCIYHISPPGHELGAAPISPNAPIPSVDDLADQVADVLDFFGLGSVMCFGVTAGAYILTLFASKYRERVLGLILVSPLCKGPTWTEWLYSKVTSNLLYYYGMCGLVKECLLQRYFSKEVRGFSELPESDIVQACKSLLDQRQSMNVWRFVQTMNERYDLTEQLKQLQCRTLIFVGENSQFHTEAVHMTSKLDRRYCALVEVQACGSLVTEEQPHAMLIPMEYFFMGYGLYRPSQLDCSPRSPLSPFCISPELLSPESMGVKLKPIKTRVRLEV

SEQ ID NO: 6031 - protein, 348 aa, Panicum virgatum
MGDSGGSVVSIDVERISFGGKEHHIQTNYGPVSVAVYGDHDKPALVTYPDIALNHMSCFQGLLFCPEAASLLLHNFCIYHISPPGHELGAAPISPNAPIPSVDNLADQVADVLDFFGLGSVMCFGVTAGAYILTLFASKYRERILGLILVSPLCKGPTWTEWLYSKVMSNLLYYYGMCGLVKECLLQRYFSKEVRGFSELPESDIVQACKSLLDQRQSMNVWRFVQTMNERYDLTEQLKQLQCRTLIFVGENSQFHSEAVHMTSKLDRRYCALVEVQACGSLVTEEQPHAMLIPMEYFFMGYGLYRPSQLDCSPRSPLSPFCISPELLSPESMGVKLKPIKTRVRLEM

SEQ ID NO: 6032 - protein, 348 aa, Panicum virgatum
MGDSGGSVVSIDVERISFGGKEHHIQTNYGPVSVAVYGDHDKPALVTYPDIALNHMSCFQGLLFCPEAASLLLHNFCIYHISPPGHELGAAPISPNAPIPSVDDLAEQVAEVLDFFGLGSVMCFGVTAGAYILTLFASKYRERVLGLILVSPICKGPTWTEWLYSKVMSNLLYYYGMCGLVKECLLQRYFSKEVRGFSELPESDIVQACKSLLDQRQSMNVWRFVQTMNERYDLTEQLKQLQCRTLIFVGENSQFHSEAVHMTSKLDRRYCALVEVQACGSLVTEEQPHAMLIPMEYFFMGYGLYRPSQLDCSPRSPLSPFCISPELLSPESMGVKLKPIKTRVRLEM

SEQ ID NO: 6033 - protein, 348 aa, Oryza sativa
MGDSGGSVVSIDVERISFGGKEHHIHTNHGPVSVAVYGDHDKPALVTYPDIALNHMSCFQGLLFCPEAASLLLHNFCIYHISPPGHELGAAPISPNAPIPSVDDLADQVADVLDFFGLGSVMCLGVSAGAYILTLFAAKYRDRVLGLILVSPLCKPPTWTEWFYNKVASNLLYYYGMCGLVKEGLLQRYFSKEVRGCSDLPESDIVQACRSLLDQRQSMNVWRFVQTMNMRYDLTEDLKQLQCRTLIFVGEYSQFHTEAVHMTSKLDRRYCALVEVQACGSLITEEQPHAMLIPMEYFFMGYGLYRPSQLDCSPRSPLSPFCISPDLLSPESMGVKLKPIKTRVRLEV

SEQ ID NO: 6034 - protein, 261 aa, Saccharum officinarum
MGDSGGSVVSVDVERISFGGKEHHIQTSHGPVSVAVYGDHDKPALVTYPDIALNHMSCFQGLLFCPEAASLLLHNFCIYHISPPGHELGAAPISPNAPTPSVDDLADQVADVLDFFGLGSVMCFGVTAGAYILTLFAAKYRERVLGLILVSPLCKGPTWTEWLYSKVTSNLLYYYGMCGLVKECLLQRYFSKEVRGFSELPESDIVQACKSLLDQRQSMNVWRFVQTMNERYDLTEQLKQLQCRTLILSARTLSFTPRLFT

SEQ ID NO: 6035 - protein, 348 aa, Brachypodium distachyon
MGDSGGSVVSIDVERISFGGKEHHIQTNHGSVSVAVYGDHDKPALITYPDIALNHMSCFQGLLFCPEAASLLLHNFCIYHISPPGHELGAAPISLSTLMPSVDDLADQVADVLDFFGLGSVMCLGVTAGAYILTLFAAKYRERVLGLILVSPLCKAPTWTEWFYNKVESNLLYYYGMCGLVKESFLQRYFSKEVRGCPELPESDIVQACRSFLDQRQSMNVWRFVQTMNGRHDLTEELKQLQCRTLIFVGENSQFHTEAVHMTSKLDRRYCALVEVQACGSLVTEEQPHAMLIPMEYFFMGYGLYRPSQLDCSPRSPLSPFCISPELLSPESMGVKLKPIKTRARLEV

SEQ ID NO: 6036 - protein, 348 aa, Triticum aestivum
MGDSGGSVVSVDVERISLGGKEHHIQTNHGSVSVAVYGDHDKPALVTYPDVALNYMSCFEGLLFCPEAASLLLHNFCIYHISPPGHELGAAPISPKTPVPSVDDLADQVADVLDFFGLGSVMCLGATAGAYILTLFAAKCRERVLGLVLVSPLCKAPTWTEWLYSKVESNLLYYYGMCGLVKESLLQRFFSKEVRGCSESPESDIVQACRSLLDQRQSMNVWQFVQTMNGRYDLTEELKQLQCRTLIFVGENSQFHAEAVHMTAKLDRRYCALVEVQACGSLVTEEQPHAMLIPMEYFFMGYGLYKPSQLDCSPRSPLSPSCISPELLSPESMGVKLKPIKTRARLQV

SEQ ID NO: 6037 - protein, 342 aa, Zea mays
MSSAGISGCVPTTEHHIQTNHGPVSVAVYGDHDKPALVTYPDIALNYMSCFQGLLFCPEAASLLLHNFCIYHISPPGHELGAAPISPNAPIPSVDDLADQVADVLDFFGLGSVMCFGVTAGAYILTLFAAKYRERVLGLILVSPLCKGPTWTEWLYSKVTSNLLYYYGMCGLVKECLLQRYFSKEVRGFSELPESDIVQACKSLLEQRQSMNVWRFVQTMNERYDLSEHIKRLQCRTLIFVGDNSQFHTEAVHLTSKLDRRYCALVEVQACGSLVTEEQPHAMLIPMEYFLMGYGLYRPPSQVVECSPRSPLSPFCISPDLLSPESMGVKLKPIRTRVRLEV

SEQ ID NO: 6038 - protein, 348 aa, Echinochloa colona
MGDSGGSVVSVDVERISFGGKEHHIQTNHGSVSVAIYGDHDKPALITYPDIALNHMSCFQGLLFCPEAASLLLHNFCIYHISPPGHELGAAPILPSTPVASVDDLADQVADVLDFFGLDSVMCLGVTAGAYILTLFATKYRERVLGLILVSPLCKAPSWSEWFYNKVMSNLLYYYGMCNVVKDILLQRYFGKGVRGCSNEPESDIVQACRSFLDQRQGMNVWRFIQTINERKDLTENLKQLQCRTLIFVGENSQFHAEAVHMTAKLDRRYSALVEVQACGSVVTEEQPHAMLIPMEYFLMGYGLYRPSQINCSPRSPLNPFCISPELLSPESMGVKLKPIKTRPSHKA

SEQ ID NO: 6039 - protein, 348 aa, Pennisetum glaucum
MGDSGGSVVSVDVERISFGGKEHHIQTNHGSVSVAIYGDHDKPALITYPDIALNHMSCFQGLLFCPEAASLLLHNFCIYHISPPGHELGAAPILPSTPVASVDDLADQVADVLDFFGLDSVMCLGVTAGAYILTLFATKYRERVLGLILVSPLCKAPSWSEWFYNKVMSNLLYYYGMCNVVKDILLQRYFGKGVRGCSTEPESDIVQACRSFLDQRQGMNVWRFIQTINERKDLTENLKQLQCRTLIFVGENSQFHAEAVHMTAKLDSRYSALVEVQACGSVVTEEQPHAMLIPMEYFLMGYGLYRPSQINCSPRSPLNPFCISPELLSPESMGLKLKPIKTRPNLKA

SEQ ID NO: 6040 - protein, 333 aa, Festuca arundinacea
ISFGGKEHHIQTNHGSVSVAVYGDHDKPALITYPDVALNHMSCFQGLLFCPEAASLLLHNFCIYHISPPGHELGAAPISSNTPIPSVDYLADQVADVLDFFGLGSVMCLGATAGAYILTLFAAKYRERVLGLILVSPLCKAPTWAEWFYSKMESNLLYYYGMCGLVKESLLQRYFSKEVRGCSELPESDIVQACRSFLDQRHNMNVWRFVQTMNGRYDLTEELQQLQCRTLIFVGENSEFHAEAVHMTSKLDRRYCALVEVQGCGSLVTEEQPHAMLIPLEYFFMGYGLYRPSQLDSNPRSTLSPFCISPELLSPESMGVKLKPIKTRARLEV

SEQ ID NO: 6041 - protein, 348 aa, Setaria italica
MGDSGGSVVSVDVERISFGGKEHHIQTNHGSVSVAIYGDHDKPALITYPDIALNHMSCFQGLLFCPEAASLLLHNFCIYHISPPGHELGAAPILPSTPVASVDDLADQVADVLDFFGLDSVMCLGVTAGAYILTLFATKYRERVLGLILVSPLCKAPSWSEWFYNKVMSNLLYYYGMCNVVKDILLQRYFGKGVRGCSTEPESDIVQACRSFLDQRQGMNVWRFIQTINERKDLTENLKQLQCRTLIFVGENSQFHAEAVHMTAKLDSRYSALVEVQACGSVVTEEQPHAMLIPMEYFLMGYGLYRPSQINCSPRSPLNPFCISPELLSPESMGLKLKPIKTRANQKA

SEQ ID NO: 6042 - protein, 348 aa, Lolium multiflorum
MGDSGGSVVSVDVERISFGGKEHHIQTKHGPVSVAVYGDHDKHALITYPDIALNHMSCFQGLLFCPEAASLLLHNFCIYHISPPGHELGATPISPSTPVQSVDELADQVAEVLDFFGLGSVMCLGVSAGAYILTLFATKYRERVLGLILVSPLYKTPSWTEWFYNKLMSNLLYYYGMCDMVKDCLLQRYFGKRVRGGSVVPESDIMQACRSFLDQRQSMNIWRFIQTINQRHDLTESLKQLQCRTLIFVGENSQFHTEAVHMTAKLDKRYSALVEVQACGSVVTEEQPHAMLIPMEYFLMGYGLFRPSHVSSSPRSPLNPFCISPDLLSPESMGVKLKPIKTRANLGV

SEQ ID NO: 6043 - protein, 348 aa, Sorghum bicolor
MGDSGGSVVSVDVERISFGGKEHHIQTNHGSVSVAIHGDHDKPALITYPDIALNHMSCFQGLLFCPEAASLLLHNFCIYHISPPGHELGAAPILSSTPVASVDDLADQIADVLDFFGLDSVMCLGVTAGAYILTLFATKYRERVLGLILVSPLCKAPSWSEWFYNKVMSNLLYYYGMCNVVKDILLQRYFGKGVRGGSTEPESDIVQACRSFLDQRQCMNVWRFIQTINERKDLTENLKQLQCRTLIFVGENSQFHAEAVHMTAKLDRRYSALVEVQACGSVVTEEQPHAMLIPMEYFLMGYGLYRPSQINCSPRSPLNPFCISPELLSPESMGVKLKPIKTRANLKA

SEQ ID NO: 6044 - protein, 347 aa, Ananas comosus
MGESSGSVSVDVERISFGGKEHHIHTNHGSVSVAVYGDIDKPALVTYPDVALNHMSCFQGLFFCPEAASLLLHNFCIYHISPPGHELGAAPISSDVPVPSVDDLADQVADVLDFFGLGSVMCLGVTAGAYILTLFATKHRERVLGLILVSPLCKTPSWAEWLYNKVMSNFLYFYGMCGLIKECLLQRYFSKEVRGSAQVPESDIVQACRSLLDERHSTNVWRFLQSINGRHDLTESLKKLQCRTLIFVGENSPFHSEALYMTSKLDRRYSALVEVQACGSMVTEEQPHAMLIPMEYFLMGYGLYRPSQLGCSPRSPLSPSCISPELLSPESMGVKLKPIKTRISLEV

SEQ ID NO: 6045 - protein, 348 aa, Brachypodium distachyon
MGDSGGSVVSVDVERISFGGKEHHIQTKHGPVSVAVYGDHDKHALITYPDIALNHMSCFQGLLFCPEAASLLLHNFCIYHISPPGHELGAAPFSPNSPVASVDELADQVAEVLDFFGLGSVMCLGVSAGAYILTLFATKYRERVLGLILVSPLCKTPSWTEWFYNKVMSNLLYYYGMCDMVKDCLLQRYFGKKLRGGSVVPESDIMQACRSFLDQRQSMNIWRFIQTINQRHDLTESLKQLQCRTLIFVGENSQFHNEAVHMAAKLDKRYSALVEVQDCGSVVTEEQPHAMLIPMEYFLMGYGLFRPSHVSSSPRSPLNPFCISPELLSPESMGVKLKPIKTRANLGV

SEQ ID NO: 6046 - protein, 348 aa, Oryza sativa
MGDSGGSVVSVDVERISFGGKEHHIQTNHGSVSVAVYGDHDKPALVTYPDIALNHMSCFQGLLFCPEASSLLLHNFCIYHISPPGHELGAAPVSPSSPVASVDELADQVSDVLDFFGLGPVMCLGVTAGAYILTLFATKYRERVLGLILVSPLCRTPSWTEWFHNKVMSNLLYYYGMCNMVKDCLLQRYFSKGVQGCSAVPESDIVQASRSFLDQRQSMNVWRFIHTINERHDLTESLKELQCRTLIFVGQNSQFHAEAVHMTSKLDERYSALVEVQGCGSVVTEEQPHAMLMPLEYFLMGYGLYRPSQISCSPRSPLNPFCISPELLSPESMGVKLKPIKTRANLEV

SEQ ID NO: 6047 - protein, 348 aa, Triticum aestivum
MGDSGGSVVSIDVERISFGGKEHHIQTKHGPVSVAVYGDHDKHALITYPDVALNHMSCFQGLLFCPEAASLLLHNFCIYHISPPGHELGATPILPNSPVASVDELADQVAEVLDFFGLGSVMCLGVSAGAYILTLFATKYRERVLGLILVSPLCRTPSWTEWFYNKVMSNLLYYYGMCDVVKDCLLQRYFGKRVRGGSAVPESDIMQACRSFLDQRQSMNIWRFIQTINQRHDLTESLKQLQCRTLIFVGENSQFHTEAVHMTAKLDKRYSALVEVQACGSVVTEEQPHAMLIPMEYFLMGYGLFRPSHVSSSPRSPLNPFCISPELLSPESMGVKLKPIKTRANLRV

SEQ ID NO: 6048 - protein, 348 aa, Panicum virgatum
MGDSGGSVLSVDIERISFGGKEHHIQTNHGSVSVAIYGDHDKPALITYPDIALNYMSCFQGLLFCPEAASLLLHNFCIYHISPPGHELGAAPILPSSPVASVDDLADQVADVLDFFGLDSVMCLGVTAGAYILTLFATKYRERVLGLILVSPLCKTPSWSEWFYNKVMSNLLYYYGMCNVVKDILLQRYFGKGVRGYSNEPESDIVRACRSFLDQRQGMNVWRFIQTINERKDLTENLKQLQCRTLIFVGENSQFHAEAVHMTAKLDSRYSALVEVQACGSVVTEEQPHAMLIPMEYFLMGYGLYRPSQINCSPRSPLNPFCVSPELLSPESMGVKLKPIKTRANLKA

SEQ ID NO: 6049 - protein, 348 aa, Panicum virgatum
MGDSGGSVLSVDVERISFGGKEHHIQTNHGSVSVAIYGDHDKPALITYPDLALNHMSCFQGLLFCPEAASLLLHNFCIYHISPPGHELGAASILPSTPVASVDDLADQVADVLDFFGLDSVMCLGVTAGAYILTLFATKYRERVLGLILVSPLCKTPSWSEWFYNKVMSNLLYYYGMCNVVKDILLQRYFGKGVRGCSNEPESDIVQACRSFLDQRQGMNVWRFIQTINERKDLTENLKQLQCRTLIFVGENSQFHAEAVHMTAKLDSRYSALVEVQACGSVVTEEQPHAMLIPMEYFLMGYGLYRPSQINCSPRSPLNLFCVSPELLSPESMGMKLKPIKTRANLKS

SEQ ID NO: 6050 - protein, 349 aa, Zea mays
MGDSGGSVVSVDVERISFGGKEHHIQTNHGSVSVAIYGDHDKPALITYPDIALNHMSCFQGLLFCPEAASLLLHNFCIYHISPPGHELGAAPILPSTPVASPDDLADQIADILDFFGLDSVMCLGVTAGAYILTLFATKYRERVLGLILVSPLCKAPSWSEWFYNKVMSNLLYYYGMCNVVKDILLQRYFGKGVRGGSAEPESDIVQACRSFLDQRQCVNVWRFIQTINERKDLTENLKQLQCRTLIFVGENSQFHAEAVHMTAKLDRRYSALVEVQACGSVVTEEQPHAMLIPMEYFLMGYGLYRPSQINCSPRSPLNPFCISPELLSPESMGVKLKPIKNARLTLMH

SEQ ID NO: 6051 - protein, 348 aa, Hordeum vulgare
MGDSGGSVVSIDVERISFGGKEHHIQTKHGPVSVAVYGDPDKNALITYPDVALNHMSCFQGLLFCPEAASLLLHNFCIYHISPPGHELGATPILPNSPVASVDELADQVAEVLDFFGLGSVMCLGVSAGAYILALFATKYRERVLGLILVSPLCRTPSWTEWFYNKVMSNLLYYYGMCDVVKDCLLQRYFGKRVRGGSAVPESDIMQACRSFLDQRQSMNIWRFIQTINQRHDLTESLKQLKCRTLIFVGENSQFHTEAVHMTAKLDKRYSALVEVQACGSVVTEEQPHAMLIPMEYFLMGYGLFRPSHVSSSPRSPLNPFCISPELLSPESMGVKLKPIKTRASLRA

SEQ ID NO: 6052 - protein, 348 aa, Avena sativa
MGDSGGSVVSVDIDRISFGGKEHHIQTKHGPVSVAVYGDHDKHALITYPDIALNHMSCFQGLLFCPEAASLLLHNFCIYHISPPGHELGATPISPSSPVQSVDELADQVAEVLDFFGLGSVMCLGVSAGAYILTLFATKYRERVLGLILVSPLYKTPSWTEWFYNKVMSNLLYYYGMCDMVKDCLLQRYFGKRVRGGSVVPESDTMQACRSFLDQRQSMNIWRFIQTINQRHDLTESLKQLQCRTLIFVGENSLFHAEAVHMAAKLDKRYSALIEVQACGSVVTEEQPHAMLIPMEYFLMGYGLFRPSHVSSSPRSPLNPFCISPDLLSPESMGVKLKPIKTRASLGA

SEQ ID NO: 6053 - protein, 347 aa, Musa acuminata
MGESSGSVSVDVERISFGGKEHHVLTSHGPISVAVYGDLEKPALVTYPDVALNHMSCFQGLFFCPEAASLLLHNFCIYHISPPGHELGAAPISSDEPVLSLDQLADQVAEVLDFFGLETVMCFGVTAGAYILTLFATKYREHVLGLILVSPLCKAPSWSEWLYMKVVSNFLYFYGMCGLVKEYLLQRYFSKEVRGSSQVPESDIVQACRSLLDEKQSANVWWFLQSINGRHDLTEALKKLQCRTLIFVGEDSPFHSEALHMSAKLDKRYSALVEVQGCGSVVTEEQPHAMLIPMEYFLMGYGLYRPSQLSYSPRSPLSPLCISPELLSPESMGVKLKPIKTRIPAEV

SEQ ID NO: 6054 - protein, 347 aa, Elaeis guineensis
MGESSSSVSIDVERISFGGKEHHIQTSHGPVSVAVFGDLEKPALVTYPDVALNHMSCFQGLFFCPEASSLLLHNFCIYHISPPGHELGAAPISSDVPVLSVDQLADQVAETLDYFGLGSVMCLGVTAGAYILTHFATKYRERVLGLMLVSPLCKAPSWTEWFYNKVISNLLYFYGMCGLIKECLLQRYFSREVRGSSLVPESDIVQACRSLLDERQSTNVWRFLQSINVRHDLTESLKKLQCRTLIFVGENSPFHSEALHMATNLDRRYSALVEVQACGSVVTEEQPHAMLIPMEYFLMGYGLYRPCQMSCSPRSPLSPSCISPELLSPESMGVKLKPIKTRVSLQV

SEQ ID NO: 6055 - protein, 347 aa, Musa acuminata
MGESSGTVSVDVERISFGGKEHHVLTSHGPISVAVYGDLEKPALVTYPDVALNHMSCFQGLLFCPEASSLLLHNFCIYHISPPGHELGAAPISADEPTLSVDQLADQVAEVLDYFGLGSAMCFGVTAGAYILTLFATKYRERVLGLILVSPLCKAPSWTEWLYTKVVSNLLYFYGMCGLVKEYLLQRYFSKEVRGSSQVPESDIVLACRSLLDEKQSENVWRFLQSINGRHDLMEDLKKLQCRTLIFVGENSPFHSEALNMTKELDKRYSALVEVQACGSVVTEEQPHAMLIPLEYFLMGYGLYRPTKLSYSPRSPLSPLCISPELLSPESMGLKLKPIKTRISLKV

SEQ ID NO: 6056 - protein, 347 aa, Musa acuminata
MGESSGTVSVDVERISFGGKEHHVLTSHGPISVAVYGDLEKPALVTYPDVALNHMSCFQGLLFCPEASSLLLHNFCIYHISPPGHELGAAPISADEPTLSVDQLADQVAEVLDYFGLGSAMCFGVTAGAYILTLFATKYRERVLGLILVSPLCKAPSWTEWLYTKVVSNLLYFYGMCGLVKEYLLQRYFSKEVRGSSQVPESDIVLACRSLLDEKQSENVWRFLQSINGRHDLMEDLKKLRCRTLIFVGENSPFHSEALNMTKELDKRYSALVEVQACGSVVTEEQPHAMLIPLEYFLMGYGLYRPTKLSYSPRSPLSPLCISPELLSPESMGLKLKPIKTRISLKV

SEQ ID NO: 6057 - protein, 347 aa, Musa acuminata
MGESSGSIPVDVERISFGGKEHHLLTSHGPISVAVYGDLEKPALITYPDVALNHLSCFQGLFFCPEAASLLLHNFCIYHISPPGHELGAAPFSSDEPVLSVDQLADQVADVLDFFGLVSAMCFGVTAGAYILTLFASKYRERVLGLILVSPLCKAPSWSEWLYTKVVSNLLYFYGMCGLVKEYLLQRYFSKEVRGSSQVPESDIVQACKSLLDEKQSANVWRFLQSLNGRHDLTGALKKLRCRTLIFVGEDSPFHSEALHMTTKLDRRYSALVEVQACGSVVTEEQPQAMLIPMEYFLMGYGLYRPSQLSYSPPSPLNPLCISPELLSPESMGLKLKPIKTRISLEV

SEQ ID NO: 6058 - protein, 347 aa, Oryza sativa
MGDSSGSVSIDVERISFGGKEHRVRTRYGSVSVSVFGDEDKPALITYPDVALNYMSCFQGLFFCPEAASLLLHNFCIYHITPQGHELGAAPISSDVPVPSVDELVDQVADVLDFFGLGSVMCLGVTAGAYILTLFATKYRDRVIGLMLVSPLCKAPSWSEWLYNKVLLNLLYYYGSRGLVKECLLQRYFSTEVRGNGQDPESEIVQACRSLLHERQGSNVWRFLQAINERHDLTEALKKLQCRTLIFVGENSQFHDDAVHMTTKLDRRYCALVEVQACGSLVTEEQPHAMLIPMEYFLMGYGLYRPSQLDSSPRSTLNPFCISPELLSPESMGVKLKPIKTRISLKV

SEQ ID NO: 6059 - protein, 347 aa, Cocos nucifera
MGESSGSVSVDVERISLGGKEHFIKTRHGTVSVAVFGEQEKPALVTYPDVALNYESCFQGLLFCPEAASLLLHNFCIYHISPPGHELGAAPVSSHVPIPSVDDLADQIADVLDIFGLGSVMCLGVTAGAYILTLFAIKYRERVAGLILVSPLCKAPCWTEWLYNKVISNLLYFYGMCGLVKDCLLQRYFSKEVRGGAQVPESDIVQACRSLLNERQSKNVWCFLQSINGRYDITEELHRLQCRTLVFVGEDSPFYSDALHMTSKLDRRCSALVEVQACGSLVTEEQPHAMLIPMEYFFIGYGLYRPSQFTGSPRSPLSPSCISPELLSPESMGVKLKPIKTRVSLDI

SEQ ID NO: 6060 - protein, 347 aa, Echinochloa colona
MGDSSGSVSVDVERIFFGGKEHRVRTRHGHLSVSVYGDEDKPALVTYPDVALNHMSCFQGLFFCPEATSLLLHNFCVYHITPQGHELGAAPISSDVPVPSVDDLADQVADVLDFFSLGAVMCLGVTAGAYVLTLFATKYRERVLGLMLVSPLCKAPSWSEWLYNKVLLNLLYYYGTRGLVKESLLQRYFSMEVRGSGQDPESEIVQACRSLLDERQGANVWRFLQAINRRHDLTESLKKLQCRTLIFVGENSQFHDEAVHMTTKLDRRYCALVEVQACGSLVTEEQPHAMVIPMEYFLMGYGLYRPPQQETSPRSTLSPFCISPELLSPESMGVKLKPIKTRISLNV

SEQ ID NO: 6061 - protein, 347 aa, Setaria italica
MGDSSGSVSIDVERIFFGGKEHRVRTRHGPLSVSVYGDEDKPALVTYPDVALNHMSCFQGLFFCPEAASLLLHNFCVYHITPQGHELGAAPISSDVPVPSVDDLADQVADVLDFFSLGAVMCLGVTAGAYVLTLFATKYRERVLGLMLVSPLCKGPSWSEWLYNKVLLNLLYYYGTRGLVKESLLQRYFSMEVRGNGQDPESEIVQACRSLLDERQGSNVWRFLQAINRRHDLTESLMKLQCRTLIFVGENSQFHADAVHMTTKLDRRYCALVEVQACGSLVTEEQPHAMLIPMEYFLMGYGLYRPPQQETSPRSTLNPFCISPELLSPESMGVKLKPIKTRISLNV

SEQ ID NO: 6062 - protein, 347 aa, Brachypodium distachyon
MGDSSGSVSVDVERIYFGGKAHPVRTRYGSVSVSVYGDEDKPALITYPDVALNYMSCFQGLFFCPEAASLLLHNFCIYHITPQGHELGAAPISSDVPVLSVDDLADQVADVLDFFGLGSVMCLGVTAGAYVLTLFATKYRERVLGLMLVSPLCKAPSWTEWLYNKVLLNLLYYCGTRGLVNECLLQRYFSAEVRGDGQDPESEIVQACRSLLDERKGVNVFRFLKSVNERRDLTEALKKLQCRTLIFVGENSQFHDDAVHMTTKLDRRYCALVEVQACGSLVTEEQPHAMLIPMEYFLIGYGLYRPSQLDSSPRSTLNPFCISPELLSPESMGVKLKPIKTRISLNV

SEQ ID NO: 6063 - protein, 347 aa, Cocos nucifera
MGESSGSVSIDVERISLGGKEHFIKTRHGTVSVAVFGDQEKPALVTYPDVALNYESCFQGLLFCPEAASLLLHNFCIYHISPPGHELGAAPISSDVPIPSVNDLADQIADVLDIFRLGPVMCLGVTAGAYILTLFATKYKERVAGLILVSPLCKAPSWTEWLYNKVISNLLYFYGMCGLVKDCLLQRYFSKEVRGSAQVPESDIVQACRSLLDERQGENVWRFLQSINGRYDITGELHQLQCRTLIFVGEDSPYYSDALHMTSKLDRRYSALVEVQACGSVVTEEQPHAMLIPMEYFFIGYGLYRPSQFTGSPRSPLSPWCISPDLLSPESMGVKLKPIKTRMSLDI

SEQ ID NO: 6064 - protein, 347 aa, Festuca arundinacea
  Sequence also found in Organisms: Lolium multiflorum
MGDSSGSVSIDVERIYFGGKEHPVRTRYGSVSVSVYGDEDKPALITYPDVALNYMSCFQGLFFCPEAASLLLHNFCIYHITPQGHELGAAPIPSNEPELSVDKLADQVADVLDFFGLGSVMCLGVTAGAYVLTLFATKYRERVLGLMLVSPLCKAPSWSEWLYNKVLLNLLYYCGTSGLVNECLLQRYFSSEVRGSGQEPESEIVQACRSLLDQRQGVNVCRFLKAINERHDLTEALKKLQCRTLIFVGENSQFHADAVHMTTKLDRRYCALVEVQACGSLVTEEQPHAMLIPMEYFLMGYGLYRPSPLDSSPRSTLNPFCISPELLSPESMGVKLKPIKTRTSLNV

SEQ ID NO: 6065 - protein, 347 aa, Elaeis guineensis
MGESSGSVSIDVERISLGGKEHFIKTRHGRVSVAVFGDQEKPALVTYPDVALNHVSCFQGLFFCPEAASLLLHNFCIYHISPPGHELGAAPISSDVPIPSVNDLADQIADVLDIFRLGPVMCLGVTAGAYILTLFAIKYKERVAGLILVSPLCKAPSWMEWLYNKVISNLLYFYGMCGLVKDCLLQRYFSKEVRGSAQVPESDIVQACRSLLDERQSENVWRFLQSINGRYDITEELHRLQCRTLIFVGEDSPYYSDAVHMTSKLDRRYSALVEVQACGSVVTEEQPHAMLIPMEYFFIGYGLYRPSQFTGSPRSPLSPWCISPDLLSPESMGVKLKPIKTRVSMDI

SEQ ID NO: 6066 - protein, 347 aa, Panicum virgatum
MGDSSGSVSIDVERIFFGGKEHRVRTRHGPLSVSVYGDEDKPALITYPDVALNHMSCFQGLFFCPEAASLLLHNFCVYHITPQGHELGAAPISSDVPVPSVDDLADQVADVLDFFSLGAVMCLGVTAGAYVLTLFATKYRERVLGLMLVSPLCKAPSWSEWLYNKVLLNLLYYYGTRGLVKESLLQRYFSMEVRGNRQDPESDIVQACRSLLEERQGANVWRFLQAINRRHDLTESLMKLQCRTLIFVGENSQFHADAVHMTTKLDQRYCALVEVQACGSLVTEEQPHAMLIPMEYFLMGYGLYRPPQQDTSPRSTLNPFCISPELLSPESMGVKLKPIKTRISLNV

SEQ ID NO: 6067 - protein, 347 aa, Zea mays
MGDSSGSVSVDVERIFFGGKEHRVRTRHGSLSVSVYGDEDKPALVTYPDVALNHMSCFQGLFFCPEAASLLLHSFCVYHITPQGHELGAAPISADVPVPSVDDLADQVADVLDFFSLGSVMCLGVTAGAYVLTLFATKYRERVLGLMLVSPVCKAPSWSEWLYNKVLSNLLYYYGTRGLVKESLLQRYFSMDVRGNGQDPESEIVQACRSLLDERQGANVWRFLQAISRRHDLTESLKKLKCRTLIFVGENSQFHADAVHMTTKLDRRYCALVEVQACGSLVTEEQPHAMVIPMEYFLMGYGLYRPSQQESSPRSTLSPFCISPELLSPESMGVKLKPIKTRISLNV

SEQ ID NO: 6068 - protein, 347 aa, Pennisetum glaucum
MGDSSGSVSIDVERIFFGGKEHRVRTRHGLLSVSVYGDEDKPALVTYPDVALNHMSCFQGLFFCPEAASLLLHNFCVYHITPQGHELGAAPISSDVPVPSVDDLADQVADVLDFFSLGAVMCLGVTAGAYVLTLFATKYRERVLGLMLVSPLCKAPSWSEWLYNKVLLNLLYYYGTRGLVKESLLQRYFSMEVRGNGHDPESEIVQACRSLLDERQGSNVWRFLQAINRRHDLTESLMKLQCRTLIFVGENSQFHADAVHMTTKLDRRYCALVEVQACGSLVTEEQPHAMLIPMEYFLMGYGLYRPPQQETSPRSTLNPFCISPELLSPESMGVKLKPIKTRISLNV

SEQ ID NO: 6069 - protein, 347 aa, Sorghum bicolor
MGDSSGSVSVDVERLFFGGKEHRVRTRHGPLSVSVYGDEDKPALVTYPDVALNHMSCFQGLFFCPEAVSLLLHNFCVYHITPQGHELGAAPISADVPLPSVDDLADQVADVLDFFSLGSVMCLGVTAGAYVLTLFATKYRERVLGLMLVSPVCKAPSWSEWLYNKVLLNLLYYYGTRGLVKESLLQRYFSMDVRGNGQDPESEIVQACRSLLDERQGTNVWRFLQAINRRHDLTESLKKLQCRTLIFVGDNSQFHADAVHMTTKLDRRYCALVEVQACGSLVTEEQPHAMVIPMEYFLMGYGLYRPSQQESSPRSTLSPFCISPELLSPESMGVKLKPIKTRISLNV

SEQ ID NO: 6070 - protein, 347 aa, Musa acuminata
MGESSASVSLDVERISFGGKEHHVLTSHGPISVAVYGDLEKPGLITYPDVALNYMSCFQGLFFCPEAASLLLHNFCIYHISPPGHELGAAPISPNDPVLSVDQLADQVADVLDFFELGPVMCLGVTAGAYVLTLFATKYRERVLGLILVSPLCKAPSWTEWLYSKVMLNFLYFYGICGLIKESLLHRYFSKGVRGSSQVPESDIVQACRSLLDQRHGVNVWRFLQSINERYDLAEASKKLQCRTLIFVGENSPFRLEAINMVTKLDRRFSALVEVQACGSVVTEEQPYAMLIPIEYFLMGYGLYRPSQVSCSPRSPLSPSCISPELLSPESMGVKLKPIKTRISLHV

SEQ ID NO: 6071 - protein, 347 aa, Hordeum vulgare
MGDSSGSVSIDVERIYFGGKEHPVRTRYGPVSVSVYGDEDKPALITYPDVALNYMSCFQGLFFCPEAASLLLHNFCIYHITPQGHELGAAPIPSDVPELSVDNLADQVADVLDFFGLGSVMCMGVTAGAYVLTLFAAKYRERVLGLMLVSPLCKAPSWSEWLYNKVLLNLLYYCGTSGLVNECLLQRYFSTEVRGSGQEPESEIVQACRSLLDQRQSVNVCRFLKAINERHDITEALKKLRCRTLIFVGENSQFHADAVHMTTKLDRRYCALVEVQACGSLVTEEQPHAMLIPMEYFLMGYGLYRPSQLESSPRSTLNPFCISPELLSPESMGVKLKPIKTRTSLNV

SEQ ID NO: 6072 - protein, 347 aa, Cenchrus ciliaris
MGDSSGSVSIDVERIFFGGQEHRVRTRHGLLSVSVYGDEDKPALVTYPDVALNHMSCFQGLFFCPEAASLLLHNFCVYHITPQGHELGAAPISSDVPVPSVDDLADQVADVLDFFSLGAVMCLGVTAGAYVLTLFATKYRERVLGLMLVSPLCKASSWSEWLYNKVLLNLLYYYGTRGLVKESLLQRYFSTEVRGNGQDPESEIVQACRSLLDERQGANVWRFLQAINRRHDLTESLMKLQCRTLIFVGENSQFHAEAVHMTTKLDRRYCALVEVQACGSLVTEEQPHAMLIPMEYFLMGYGLYRPPQQETSPRSTLNPFCISPELLSPESMGVKLKPIKTRISLNV

SEQ ID NO: 6073 - protein, 345 aa, Secale cereale
MASFNAAGAGAANPNPNKSLEVNPAPGDSVSSLSFSPKANHLIATSWDNQVRCWEVQPGGQCQAKASISHDQPVLCSAWKDDGTTVFSGGCDKVVKMWPLLSGGQATAFSGHEAPVKELAWIPQMSLLVSGGWDKTLRYWDIRQPNPAHVQQLPERCYALSLSYPLMAVGTADRNVVIFNLQNPQAEFKRIVSPLKFQTRCIAAFPDQQGFLVGSIEGRVGVHHVDDSNQSKNFTFKCHREGTDIFSVNSLNFHPVHHTFATAGSDGGFNFWDKDSKQRLKAFSKCPSPITCSTFNQDGSIFAYAVCYDWSKGAEKHNPSTAKTNIFLHSVQESDVKGKPRTGKK

SEQ ID NO: 6074 - protein, 345 aa, Setaria italica
MASFSPAGATAANQNPNKSVEVTPAPEDSVSSLSFSPKANHLVATSWDKQVRCWEVLPGGGCQAKASISHDQPVLCSAWKDDGMTVFSGGCDKQIKMWPLLSGGQPTTLSGHEAPVKELAWVPQMNLLVSGSWDKTLRYWDIRQPQPVHVQQLPERCYALSLCYPLMVVGTADRNVIVFNLQNPQAEFKRIVSPLKLQTRCLAAFPDQQGFLVGSIEGRVGVHHVDDSQQSKNFTFKCHRDGNDIYSVNSLNFHPVHGTFATTGSDGGFNFWDKDSKQRLKAFSKCPAPITCSTFNQDGSIFAYAVCYDWSKGAEKHNPSTAKTNIFIHSVQESDVKGKPRTGKK

SEQ ID NO: 6075 - protein, 344 aa, Oryza sativa
MASFTAGGGGANNNPNKSLEVNPAPGDSVSSLSFSPKANHLVATSWDNQVRCWEIQPGGQCQAKASISHDQPVLCSAWKDDGTTVFSGGCDKQIKMWPLLSGGQPMVLSGHEAPVKELAWIPQMNLLVSGSWDKTLRYWDVRQPQPAHVQQLPERCYALSLSYPLMVVGTADRNVIVFNMQNPQAEFKRIVSPLKLQTRCLAAFPDQQGFLVGSIEGRVGVHHVDDGQQGKNFTFKCHRDGNDIYAVNALNFHPVHHTFATSGSDGGFNFWDKDSKQRLKAFNKCPSPITCSTFNQDGSIFAYAVCYDWSKGAEKHNPSTAKTNIFLHSVQESEVKGKPRVNKK

SEQ ID NO: 6076 - protein, 345 aa, Setaria italica
MASFSPAAATAANQNPNKSVEVTPAPEDSVSSLSFSPKANHLVATSWDKQVRCWEVLPGGGCQAKASISHDQPVLCSAWKDDGMTVFSGGCDKQIKMWPLLSGGQPTTLSGHEAPVKELAWVPQMNLLVSGSWDKTLRYWDIRQPQPVHVQQLPERCYALSLCYPLMVVGTADRNVIVFNLQNPQAEFKRIVSPLKLQTRCLAAFPDQQGFLVGSIEGRVGVHHVDDSQQSKNFTFKCHRDGNDIYSVNSLNFHPVHGTFATTGSDGGFNFWDKDSKQRLKAFSKCPAPITCSTFNQDGSIFAYAVCYDWSKGAEKHNPSTAKTNIFIHSVQESDVKGKPRTGKK

SEQ ID NO: 6077 - protein, 344 aa, Sorghum bicolor
MATFGTAGASAANQNPNKSVEVTPAPGDSVSSLSFSPKANHLVSTSWDNQVLCWEVMAGGACQAKASISHDQPVLCSAWKDDGMTVFSGGCDKQVKMWPLLSGGQPTVFSGHEAPIKELAWVPQMNLLVSGSWDKTLRYWDIRQPQPVHVQQLPDRCYALSLSYPLMVVGTADRNVVVFNLQNPQAEFKRITSPLKLQTRCLAAFPDQQGFLIGSIEGRVGVHHVDDSQQGKNFTFKCHRDGNDIYSVNSLNFHPVHGTFATTGSDGGFNFWDKDSKQRLKAFNKCPAPITCSTFNHDGSIFAYAVCYDWSKGAEKHNPSAAKTNIFLHSVQESDVKGKPRGKK

SEQ ID NO: 6078 - protein, 307 aa, Hordeum vulgare
MASFNAAGAAPANPNPNKSLEVNPAPGDSVSSLSFSPKANHLIATSWDNQVRCWEVQPGGQCQAKASISHDQPVLCSAWKDDGTTVFSGGCDKMVKMWPLLSGGQATTFSGHEASVKELAWIPQMSLLVSGSWDKTLRYWDIRQPNPAHVQQLPERCYALSLSYPLMAVGTADRNVVIFNLQNPQAEFKRIVSPLKFQTRCIAAFPDQQGFLVGSIEGRVGVHHVDDSNQSKNFTFKCHREGTDIYSVNSLNFHPVHHTFATAGSDGGFNFWDKDSKQRLKAFSKCPSPVTCSTFNQDGSIFAYAVG

SEQ ID NO: 6079 - protein, 345 aa, Zea mays
MASFNPAGASAANHNPNKSFEVTPAPGDSVSSLSFSPKANHLVATSWDNQVRCWEVMAGGACQAKASISHDQPVLCSAWKDDGLTVFSGGCDKQVKMWPLLSGAQPTVFSGHEAPIKELAWVPQMNLLVSGSWDKTLRYWDIRQPQPVHVQQLPERCYALSLCYPLMVVGTADRNVIVFNLQNPQAEFKRITSPLKLQTRCLAAFPDQQGFLIGSIEGRVGVHHVEESQQGKNFTFKCHRDGNDIYAISSLNFHPVHGTFATTGSDGSFNFWDKDSKQRLKAYNRCPSPITCSAFNHDGSIFAYAVCYDWSKGAEKHNPSTAKTNIFLHSAQDSDVKGKPRAGKK

SEQ ID NO: 6080 - protein, 343 aa, Echinochloa colona
MASLTGLTANANPNKSFEILPNPGDSVSSLSFSPKSNLLVATSWDNQVRCWEIVGGNSQPKASISHDQPVLCSAWKDDGTTVFSGGCDKQVKMWPLLSGGQPQTVAMHDAPVKEIAWIPQMNLLVSGSWDKTLRYWDTRQANPAHIQQLPERCYALTVNYPLMIVGTADRNLVVFNLQNPQAEFKRIQSPLKYQTRCLAAFPDQQGFLVGSIEGRVGVHHIDDSQQSKNFTFKCHREGNDIFSVNSLNFHPVHHTFATAGSDGAFNFWDKDSKQRLKAFSRCPLPIPCSTFNSDGSIFAYAVCYDWSRGAENHNPAAAKTSIYLHSPQESEVKGKPRIATGRK

SEQ ID NO: 6081 - protein, 343 aa, Setaria italica
MASLTGLAANPNPNKSFEILPNPGDSVSSLSFSPKSNLLVATSWDNQVRCWEIVGGNSQPKASISHDQPVLCSAWKDDGTTVFSGGCDKQVKMWPLLSGGQPQTVAMHDAPVKEIAWIPQMNLLVSGSWDKTLRYWDTRQANPVHIQQLPERCYALTVNYPLMIVGTADRNLVVFNLQNPQTEFKRIQSPLKYQTRCLAAFPDQQGFLVGSIEGRVGVHHIDDSQQSKNFTFKCHREGNDIFSVNSLNFHPVHHTFATAGSDGAFNFWDKDSKQRLKAFSRCPLPIPCSTFNSDGSIFAYAVCYDWSRGAENHNPAAAKTSIYLHSPQESEVKGKPRIATGRK

SEQ ID NO: 6082 - protein, 327 aa, Panicum virgatum
MASFSPAGAANHNPNKSVEVSSLSFSPKANQLVATSWDKQVRCWEVLPGGVCQAKASISHDQPVLCTAWKDDGMTVFSGGCDKHIKMWPLLSDGQPTTLSGHEAPIKELAWVPQMNLLVSGSWDKTLRYWDIRQPQPVHVQQLPERCYALSLCYPLMVVGTADRNVIVFNLQNRQAEFKRTVSPLKLQTRCLAAFPDQQGFLVGSIEGRVGVHHVDDSQQSKNFTFKCHHDGNDIFSVNSLNFHPVHNTFATTGSDGGFNFWDKDSKQRLKAFSKCPAPITCSTFNQDGSIFAYAVCCDWSKGAEKHNPSTAKTNIFIHSVQVCTFH

SEQ ID NO: 6083 - protein, 342 aa, Oryza sativa
MATLGLAPNMNPNKSFEVLPNPGDSVSSLSFSPKSNLLVATSWDNQVRCWEIVGGSSQPKASISHDQPVLCSAWKDDGTTVFSGGCDKQVKMWPLLSGGQAQTVAMHDAPVKEIAWIPQMNLLVSGSWDKTLRYWDTRQSNPVHVQQLPERCYALTVNYPLMIVGTADRNLVVFNLQNPQTEFKRIQSPLKYQTRCLAAFPDQQGFLVGSIEGRVGVHHIDDSQQSKNFTFKCHREGNDIFSVNSLNFHPVHHTFATAGSDGAFNFWDKDSKQRLKAFSRCPLPIPCSTFNSDGSIFAYAVCYDWSRGAENHNPATAKTSIYLHSPQESEVKGKPRIATSRK

SEQ ID NO: 6084 - protein, 343 aa, Pennisetum glaucum
MATLTGIAANPNPNKSFEILPNPGDSVSSLSFSPKSNLLVATSWDNQVRCWEIVGGNSQPKASISHDQPVLCSTWKDDGTTVFSGGCDKQVKMWPLLSGGQPQTVAMHDAPVKEVAWIPQMNLLVSGSWDKTLRYWDTRQANPVHIQQLPERCYALTVNYPLMIVGTADRNLVVFNLQNPQTEFKRIQSPLKYQTRCLAAFPDQQGFLVGSIEGRVGVHHIDDAQQSKNFTFKCHREGNDIFAVNSLNFHPVHHTFATAGSDGAFNFWDKDSKQRLKAFSRCPLPITCSTFNSDGSIFAYAVCYDWSRGAENHNPAAAKTSIYLHSPQESEVKGKPRIATGRK

SEQ ID NO: 6085 - protein, 343 aa, Sorghum bicolor
  Sequence also found in Organisms: Saccharum officinarum
MASLTGLAANPNPNKSFEILPNPGDSVSSLSFSPKSNLLVATSWDNQVRCWEIVGGNSQPKASISHDQPVLCSAWKDDGTTVFSGGCDKQVKMWPLLSGGQPQTVAMHDAPVKEVAWIPQMNLLVSGSWDKTLRYWDTRQANPVHIQQLPERCYALTVNYPLMIVGTADRHLVVFNLQNPQTEFKRIQSPLKYQTRCLAAFPDQQGFLVGSIEGRVGVHHIDDAQQSKNFTFKCHREGNDIFSVNSLNFHPVHHTFATAGSDGAFNFWDKDSKQRLKAFSRCPLPIPCSTFNSDGSIFAYAVCYDWSRGAENHNPAAAKTSIYLHSPQETEVKGKPRLTTGRK

SEQ ID NO: 6086 - protein, 342 aa, Cenchrus ciliaris
MALSSLAANSNPNKSFEILPNPGDSVSSLSFSPKSNLLVATSWDNQVRCWEIVGGNSQPKASISHDQPVLCSAWKDDGTTVFSGGCDKQVKMWPLLSGGQPQTVAMHDAPVKEIAWIPQMNLLVSGSWDKTLRYWDTRQANPVHIQQLPERCYALTVNYPLMIVGTADRNLVVFNLQNPQTEFKRIQSPLKYQTRCLAAFPDQQGFLVGSIEGRVGVHHIDDAQQSKNFTFKCHREGNDIFSVNSLNFHPVHHTFATAGSDGAFNFWDKDSKQRLKAFSRCPLPITCSTFNSDGSIFAYAVCYDWSRGAENHNPAAAKTSIYLHSPQESEVKGKPRIATGRK

SEQ ID NO: 6087 - protein, 343 aa, Zea mays
MASLTGLTANPNPNKSFEILPNPGDSVSSLSFSPKSNLLVATSWDNQVRCWEIVGGNSQPKASISHDQPVLCSAWKDDGTTVFSGGCDKQVKMWPLLSGGQPQTVAMHDAPVKEVAWIPQMNLLVSGSWDKTLRYWDTRQSNPVHIQQLPERCYALTVNYPLMIVGTADRHLVVFNLQNPQTEFKRIQSPLKYQTRCLAAFPDQQGFLVGSIEGRVGVHHIDDAQQSKNFTFKCHREGNDIFSVNSLNFHPVHHTFATAGSDGAFNFWDKDSKQRLKAFSRCPLPIPCSTFNSDGSIFAYAVCYDWSRGAENHNPAAAKTSIYLHSPQETEVKGKPRIATGRK

SEQ ID NO: 6088 - protein, 343 aa, Secale cereale
  Sequence also found in Organisms: Triticum aestivum
MATLTSLASNPNPNKSFEVLPNPGDSLSSLSFSPKSNLLVATSWDNQVRCWEIGNGNSQPKASISHDQPVLCSAWKDDGTTVFSGGCDKQVKMWPLLSGGQAQTVAMHDAPVKEVAWISQMNLLVSGSWDKTLRYWDTRQPNPAHVQQLPDRCYALAVNYPLMIVGTADRNIVIFNLQNPQTEFKRIQSPLKYQTRCVAAFPDQQGFLVGSIEGRVGVHHIDDSQQSKNFTFKCHREGNDIFSVNSLNFHPVHHTFATAGSDGAFNFWDKDSKQRLKAFSRCPQPIPCSSFNNDGSIFAYGVCYDWSRGAENHNPANAKTSIYLHSPQEAEVKGKPRIATGRK

SEQ ID NO: 6089 - protein, 343 aa, Triticum aestivum
MAALTSLASNPNPNKSFEVLPNPGDSLSSLSFSPKSNLLVATSWDNQVRCWEIGNGNSQPKASISHDQPVLCSAWKDDGTTVFSGGCDKQVKMWPLLSGGQAQTVAMHDAPVKEVAWISQMNLLVSGSWDKTLRYWDTRQPNPAHVQQLPDRCYALAVNYPLMIVGTADRNIVIFNLQNPQTEFKRIQSPLKYQTRCVAAFPDQQGFLVGSIEGRVGVHHIDDSQQSKNFTFKCHREGNDIFSVNSLNFHPVHHTFATAGSDGAFNFWDKDSKQRLKAFSRCPQPIPCSSFNNDGSIFAYGVCYDWSRGAENHNPANAKTSIYLHSPQEAEVKGKPRIATGRK

SEQ ID NO: 6090 - protein, 343 aa, Brachypodium distachyon
MANLTSLTSNPNPNKSFEVLPNPGDSLSSLSFSPKSNLLVATSWDNQVRCWEIVGSNSQPKASISHDQPVLCSAWKDDGTTVFSGGCDKQVKMWPLLSGGQAQTVAMHDGPVKEIAWIPQMSLLVSGSWDKTLRYWDTRQQNPAHVQQLPERCYALSVNYPLMIVGTADRHIVIFDLRNPQAEFKRIQSPLKYQTRCVAAFPDQQGFLVGSIEGRVGVHHIDDAQQSKNFTFKCHREGNDIFSVNSLNFHPVHHTFATAGSDGAFNFWDKDSKQRLKAFSRCPLPIPCSTFNMDGSIFAYGVCYDWSRGAENHNPTNAKTSIYLHSPQEAEVKGKPRIATGRK

SEQ ID NO: 6091 - protein, 343 aa, Triticum aestivum
MATLTSLASNPNPNKSFEVLPNPGDSLSSLSFSPKSNLLVATSWDNQVRCWEIGNGNSQPKASISHDQPVLCSAWKDDGTTVFSGGCDKQVKMWPLLSGGQAQTVAMHDAPVKEVSWISQMNLLVSGSWDKTLRYWDTRQPNPAHVQQLPDRCYALAVNYPLMIVGTADRNIVIFNLQNPQTEFKRIQSPLKYQTRCVAAFPDQQGFLVGSIEGRVGVHHIDDSQQSKNFTFKCHREGNDIFSVNSLNFHPVHHTFATAGSDGAFNFWDKDSKQRLKAFSRCPQPIPCSSFNNDGSIFAYGVCYDWSRGAENHNPANAKTSIYLHSPQEAEVKGKPRIATGRK

SEQ ID NO: 6092 - protein, 343 aa, Avena sativa
MANLTSLTSNPNPNKSFEVLPNPGDSLSSLSFSPKSNLLVATSWDNQVRCWEIVNGNSQPKASISHDQPVLCSAWKDDGTTVFSGGCDKQVKMWPLLSGGQAQTVAMHDAPVKEVAWIPQMNLLVSGSWDKTLRYWDTRQPNPAHVQQLPDRCYSLAVNYPLMIVGTADRHIVIFNLQNPQTEFKRIQSPLKYQTRCVAAFPDQQGFLVGSIEGRVGVHHIDDAQSSKNFTFKCHREGNDIFSVNSLNFHPVHHTFATAGSDGAFNFWDKDSKQRLKAFSRCPQPISCSTFNNDGSIFAYGVCYDWSRGAENHNPANAKTSIYLHSPQEAEVKGKPRIATGRK

SEQ ID NO: 6093 - protein, 343 aa, Hordeum vulgare
MATLTSLTSNANPNKSFEVLPNPGDSLSSLSFSPKSNLLVATSWDNQVRCWEIGNGNSQPKASISHDQPVLCSAWKDDGTTVFSGGCDKQVKMWPLLSGGQAQTVAMHDAPVKEVAWISQMNLLVSGSWDKTLRYWDTRQANPAHVQQLPDRCYALAVNYPLMIVGTADRNIVIFNLQNPQTEFKRIQSPLKYQTRCVAAFPDQQGFLVGSIEGRVGVHHIDDSQQSKNFTFKCHREGNDIFSVNSLNFHPVHHTFATAGSDGAFNFWDKDSKQRLKAFSRCPQPIPCSSFNNDGSIFAYGVCYDWSRGAENHNPANAKTSIYLHSPQEAEVKGKPRIATGRK

SEQ ID NO: 6094 - protein, 216 aa, Pennisetum glaucum
  Sequence also found in Organisms: Cenchrus ciliaris, Setaria italica
MAYRADDDYDYLFKVVLIGDSGVGKSNLLSRFTRNEFSLESKSTIGVEFATRSIHVDDKVVKAQIWDTAGQERYRAITSAYYRGAVGALVVYDVTRHVTFENVERWMRELKDHTDANIVIMLVGNKADLRHLRAVPTEDAKAFAEKENAFFMETSALEAMNVEDAFTEVLTQIYRVVSKKALDIGDDPAAPPKGQTINVGGKDDVSAVKKSACCSS

SEQ ID NO: 6095 - protein, 216 aa, Sorghum bicolor
MAYRADDDYDYLFKVVLIGDSGVGKSNLLSRFTRNEFSLESKSTIGVEFATRSIHVDDKVVKAQIWDTAGQERYRAITSAYYRGAVGALVVYDVTRHVTFENVERWMRELKDHTDANIVIMLVGNKADLRHLRAVPTEDAKAFAERENAFFMETSALEAMNVEDAFTEVLTQIYRVVSKKALDIGDDPAAPPKGQTINVGGKDDVSAVKKSACCSS

SEQ ID NO: 6096 - protein, 216 aa, Saccharum officinarum
MAYRADDDYDYLFKVVLIGDSGVGKSNLLSRFTRNEFSLESKSTIGVEFATRSIHVDDKVVKAQIWDTAGQERYRAITSAYYRGAVGALVVYDVTRHVTFENVERWMRELKDHTDANIVIMLVGNKADLRHLRAVPTEDAKAFAERENAFFMETSALEAMNVEDAFTEVLTQIYRVVSKKALDIGDDPAAPPKGHTINVGGKDDVSAVKKSACCSS

SEQ ID NO: 6097 - protein, 216 aa, Panicum virgatum
MAYRAEDDYDYLFKVVLIGDSGVGKSNLLSRFTRNEFSLESKSTIGVEFATRSIHVEDKVVKAQIWDTAGQERYRAITSAYYRGAVGALVVYDVTRHVTFENVERWMRELKDHTDANIVIMLVGNKADLRHLRAVSTEDAKAFAERENAFFMETSALEAMNVEDAFTEVLTQIYRVVSKKALDIGDDPAAPPKGQTINVGGKDDVSAVKKSACCSS

SEQ ID NO: 6098 - protein, 216 aa, Zea mays
MAYRADDDYDYLFKVVLIGDSGVGKSNLLSRFTRNEFSLESKSTIGVEFATRSIHVDDKVVKAQIWDTAGQERYRAITSAYYRGAVGALVVYDVTRHVTFENVERWMRELRDHTDANIVIMLVGNKADLRHLRAVPTEDAKAFAERENAFFMETSALEAMNVEGAFTEVLTQIYHVVSKKALDIGDDPAAPPRGQTISVGGKDDVSAVKKSACCSS

SEQ ID NO: 6099 - protein, 216 aa, Panicum virgatum
MAYRAEDDYDYLFKVVLIGDSGVGKSNLLSRFTRNEFSLESKSTIGVEFATRSIHVEDKVVKAQIWDTAGQERYRAITSAYYRGAVGALVVYDVTRHVTFENVERWMRELKDHTDANIVIMLVGNKADLRHLRAVTTEDAKAFAERENAFFMETSALEAMNVEDAFTEVLTQIYRVVSKKALDIGDDPAAPPKGQTINVGGKDDVSAVKKSACCSS

SEQ ID NO: 6100 - protein, 216 aa, Hordeum vulgare
  Sequence also found in Organisms: Secale cereale
MAYRAEDDYDYLFKVVLIGDSGVGKSNLLSRFTRNEFSLESKSTIGVEFATRSIRVDDKVVKAQIWDTAGQERYRAITSAYYRGAVGALVVYDVTRHVTFENVERWLKELRDHTDANIVIMLVGNKADLRHLRAVSVEDAKAFAERESTFFMETSALEAMNVENAFTEVLTQIYRVVSKKALDIGDDPAAPPRGQTINVGGKDDVSAVKKAGCCSS

SEQ ID NO: 6101 - protein, 216 aa, Brachypodium distachyon
MAYRAEDDYDYLFKVVLIGDSGVGKSNLLTRFTRNEFSLESKSTIGVEFATRSIHVDDKVVKAQIWDTAGQERYRAITSAYYRGAVGALVVYDVTRHVTFENVERWLRELKDHTDANIVIMLVGNKADLRHLRAVQSEDAKAFAERENTFFMETSALEAMNVEDAFTEVLSQIYRVVSKKALDIGDDPAAPPKGKTISVGSKDDVSAVKKSACCSS

SEQ ID NO: 6102 - protein, 216 aa, Zea mays
  Sequence also found in Organisms: Oryza sativa, Sorghum bicolor, Setaria italica
MAYRAEDDYDYLFKVVLIGDSGVGKSNLLSRFTRNEFSLESKSTIGVEFATRSIRVDDKVVKAQIWDTAGQERYRAITSAYYRGAVGALVVYDVTRHVTFENVERWLKELRDHTDANIVIMLVGNKADLRHLRAVSVEDAKGFAERESTFFMETSALESMNVESAFTEVLTQIYRVVSKKALDIGDDPAAPPRGQTINVGGKDDVSAVKKSGCCSS

SEQ ID NO: 6103 - protein, 216 aa, Zea mays
MAYRADDDYDYLFKVVLIGDSGVGKSNLLSRFTRNEFSLESKSTIGVEFATRSIHVEDKVVKAQIWDTAGQERYRAITSAYYRGAVGALVVYDVTRHVTFENVERWMRELRDHTDANIVMMLVGNKADLRHLRAVPTEDAKAFAERQNAFFMETSALEAMNVEDAFTEVLAQIYRVVSKKALDIGDDPAAPPRGHTINVGGKDDVSAVKKSACCSS

SEQ ID NO: 6104 - protein, 216 aa, Elaeis guineensis
MAYRADDDYDYLFKVVLIGDSGVGKSNLLSRFTRNEFSLESKSTIGVEFATRSIHVDDKVVKAQIWDTAGQERYRAITSAYYRGAVGALLVYDVTRHVTFENVERWLKELRDHTDSNIVIMLVGNKADLRHLRAVSTEDAKAFAERESTFFMETSALESTNVENAFTEVLTQIYHVVSKKALDIGDDPAALPKGQTINVGTKDDVSAVKKVGCCSA

SEQ ID NO: 6105 - protein, 216 aa, Panicum virgatum
MAYRAEDDYDYLFKVVLIGDSGVGKSNLLSRFTRNEFSLESKSTIGVEFATRSIRVDDKVVKAQIWDTAGQERYRAITSAYYRGAVGALVVYDVTRHVTFENVERWLKELRDHTDANIVIMLVGNKADLRHLRAVSVEDAKGFAERESTFFMETSALESMNVEGAFTEVLTQIYRVVSKKALDIGDDPAAPPRGQTINVGGKDDVSAVKKSGCCSS

SEQ ID NO: 6106 - protein, 216 aa, Triticum aestivum
MAYRAEDDYDYLFKVVLIGDSGVGKSNLLTRFTRNEFSLESKSTIGVEFATRSIHVDDKVVKAQIWDTAGQERYRAITSAYYRGAVGALVVYDVTRHVTFENVERWLRELKDHTDANIVIMLVGNKADLRHLRAVPSEDAKAFAERENTFFMETSALEAMNVEDAFTEVLSQIYRVVSKKALDIGDDPAAPPKGKTINVGSKDDVSAVKKSNCCSS

SEQ ID NO: 6107 - protein, 216 aa, Triticum aestivum
MAYRADDDYDYLFKVVLIGDSGVGKSNLLTRFTRNEFSLESKSTIGVEFATRSIRVDDKVVKAQIWDTAGQERYRAITSAYYRGAVGALVVYDVTRHVTFENVERWLKELKDHTDANIVIMLVGNKADLRHLRAVSVEDAKAFAEREYTFFMETSALESMNVEDAFTEVLTQIYRVVSKKALDIGDDPAAPPRGQTINVGSKDDVSAVKKAGCCSS

SEQ ID NO: 6108 - protein, 216 aa, Allium cepa
MAYRADDDYDYLFKVVLIGDSGVGKSNLLSRFTRNEFSLESKSTIGVEFATRSIHVDDKVVKAQIWDTAGQERYRAITSAYYRGAVGALLVYDVTRHVTFENVERWLKELRDHTDANIVIMLVGNKADLRHLRAVTTEDAKAFAERENTFFMETSALESLNVENAFTEVLSQIYRVVSRKALDVGDDPAALPKGQTINVGSKDDVSAVKKSGCCSS

SEQ ID NO: 6109 - protein, 216 aa, Brachypodium distachyon
MAYRAEDDYDYLFKVVLIGDSGVGKSNLLSRFTRNEFSLESKSTIGVEFATRSIRVDDKVVKAQIWDTAGQERYRAITSAYYRGAVGALVVYDVTRHVTFENVERWLKELRDHTDANIVIMLVGNKADLRHLRAVSVEDAKAFAERESTFFMETSALEAMNVESAFTEVLTQIYRVVSKKALDIGDDPAAPPRGQTINVGGKDDVSAVKKAGCCSS

SEQ ID NO: 6110 - protein, 216 aa, Lolium multiflorum
MAYRAEDDYDYLFKVVLIGDSGVGKSNLLSRFTRNEFSLESKSTIGVEFATRSIRVDDKVVKAQIWDTAGQERYRAITSAYYRGAVGALVVYDVTRHVTFENVERWLKELRDHTDANIVIMLVGNKADLRHLRAVSVEDAKAFAERESTYFMETSALEAMNVENAFTEVLTQIYRVVSKKALDIGDDPAAPPRGQTINVGGKDDVSAVKKAGCCSS

SEQ ID NO: 6111 - protein, 216 aa, Zea mays
MAYRAEDDYDYLFKVVLIGDSGVGKSNLLSRFTRNEFSLESKSTIGVEFATRSIRVDDKVVKAQIWDTAGQERYRAITSAYYRGAVGALVVYDVTRHVTFENVERWLKELRDHTDANIVIMLVGNKADLRHLRAVSVEDAKGFAEREMTFFMETSALESMNVESAFTEVLTQIYRVVSKKALDIGDDPAAPPRGQTINVGGKDDVSAVKKAGCCSS

SEQ ID NO: 6112 - protein, 216 aa, Nuphar advena
MAYRADDDYDYLFKVVLIGDSGVGKSNLLSRFTRNEFSLESKSTIGVEFATRSIHVDDKVVKAQIWDTAGQERYRAITSAYYRGAVGALIVYDVTRHVTFENVERWLKELRDHTDANIVIMLVGNKADLRHLRAVSTEDAKGFAERENTFFMETSALESLNVENAFTEVLTQIYRVVSRKALDIGDDPAALPKGQTINVGNKDDVSAVKKVGCCSA

SEQ ID NO: 6113 - protein, 217 aa, Ananas comosus
MAGYRAEDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDANIVIMLVGNKADLRHLRAVSTEDATAFAEKENTFFMETSALESMNVENAFTEVLTQIYRVVSRKALDIGDDPSAPPKGQTINVGSKDDVSAVKKVGCCSA

SEQ ID NO: 6114 - protein, 217 aa, Humulus lupulus
MGAYRTDDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDANIVIMLVGNKADLRHLRAVSTEDAKAFAEKENTFFMETSALESMNVENAFTEVLTQIYRVVSRKALDIGEDPAALPKGQTINVGGKDDVSAVKKASCCSA

SEQ ID NO: 6115 - protein, 216 aa, Thalictrum flavum
MAAYRADDDYDYLFKVVLIGDSGVGKSNLLSRFTRNEFSLESKSTIGVEFATRSIHVDDKVVKAQIWDTAGQERYRAITSAYYRGAVGALLVYDVTRHVTFENVERWLKELRDHTDANIVIMLVGNKADLRHLRAVSTEDAKAFAERENTFFMETSALESLNVENAFTEVLTQIYRVVSRKALDIGDDPAALPKGQTINVGKDDVSAVKKVGCCST

SEQ ID NO: 6116 - protein, 216 aa, Allium cepa
MAYRADDDYDYLFKVVLIGDSGVGKSNLLSRFTRNEFSLESKSTIGVEFATRSIHVDDKVVKAQIWDTAGQERYRAITSAYYRGAVGALLVYDVTRHVTFENVERWLKELRDHTDANIVIMLVGNKADLRHLRAVTTEDAKAFAERENTFFMETSALESLNVENAFTEVLSQIYRVVSRKALDVGDDPAALPKGQTINVGSKDDVSAVKKAGCCSS

SEQ ID NO: 6117 - protein, 216 aa, Aristolochia fimbriata
MAYRADDDYDYLFKVVLIGDSGVGKSNLLSRFTRNEFNLESKSTIGVEFATRSIHVDDKVVKAQIWDTAGQERYRAITSAYYRGAVGALLVYDVTRHVTFENVERWLKELRDHTDSNIVIMLVGNKADLRHLRAVSTEDAKAFAERENNFFMETSALESMNVENAFTEVLTQIYRVVSRKALDIGDDPAALPKGQTINVGSKDDVSAVKKVGCCSA

SEQ ID NO: 6118 - protein, 216 aa, Eschscholzia californica
MAYRADDDYDYLFKVVLIGDSGVGKSNLLSRFTRNEFSLESKSTIGVEFATRSIHVDDKVVKAQIWDTAGQERYRAITSAYYRGAVGALLVYDVTRHVTFENVERWLKELRDHTDTNIVIMLVGNKADLRHLRAVSTEDAKAFAERENTFFMETSALESMNVENAFTEVLTQIHRVVSRKALDVGDDPAALPKGQTISVGGKDDVSAVKKVGCCSA

SEQ ID NO: 6119 - protein, 216 aa, Cocos nucifera
MAYRADDDYDYLFKVVLIGDSGVGKSNLLSRFTKNEFSLESKSTIGVEFATRSIHVDDKVVKAQIWDTAGQERYRAITSAYYRGAVGALLVYDVSRHVTFENVERWLKELRDHTDTNIVIMLVGNKADLRHLRAVSTEDAKAFAERENTFFMETSALESMNVENAFTEVLTQIYRVVSRKALDIGEDPAALPKGQTINVGTKDDVSAVKKVGCCST

SEQ ID NO: 6120 - protein, 217 aa, Vitis vinifera
MASYRADDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDSNIVIMLVGNKADLRHLRAVSTEDAKAFAERENNFFMETSALESMNVENAFTEVLTQIYRVVSRKALDIGDDPAALPKGQTINVGTKDDVSAVKKVGCCSA

SEQ ID NO: 6121 - protein, 216 aa, Aquilegia formosa
MAAYRADDDYDYLFKVVLIGDSGVGKSNLLSRFTRNEFSLESKSTIGVEFATRSIHVDDKVVKAQIWDTAGQERYRAITSAYYRGAVGALLVYDVTRHVTFENVERWLKELRDHTDSNIVIMLVGNKADLRHLRAVSTEDAKAFAERENNFFMETSALESLNVENAFTEVLTQIYRVVSRKALDIGDDPAALPKGQTINVGKDDVSAVKKVGCCSS

SEQ ID NO: 6122 - protein, 217 aa, Centaurea maculosa
MGAYRADDDYDYLFKVVLIGDSGVGKSNLLSRFTRNEFSLESKSTIGVEFATRSIRVDEKVVKAQIWDTAGQERYRAITSAYYRGAVGALIVYDVTRHVTFENVERWLKELRDHTDANIVIMLVGNKSDLRHLRAVSTEDAKAFAEKENTYFMETSALESMNVENAFTEVLTQIYHVVSKKALDLGDDPAALPKGQTINVGGKDDVSALKKVGCCST

SEQ ID NO: 6123 - protein, 217 aa, Chelidonium majus
MAAYRADDDYDYLFKVVLIGDSGVGKSNLLSRFTRNEFSLESKSTIGVEFATRSIHVDDKVVKAQIWDTAGQERYRAITSAYYRGAVGALLVYDVTRHVTFENVERWLKELRDHTDSNIVIMLVGNKADLRHLRAVSTEDAKAFAERENTFFMETSALESLNVENAFTEVLTQIYRVVSRKALDIGDDPAALPKGQTINVGSKDDVSAVKKVGCCSA

SEQ ID NO: 6124 - protein, 216 aa, Avena sativa
MAYRAEDDYDYLFKVVLIGDSGVGKSNLLSRFTRNEFSLESKSTIGVEFATRSIRVDDKVVKAQIWDTAGQERYRAITSAYYRGAVGALVVYDVTRHVTFEDVERWLKELRDHTDANIVIMLVGNKADLRHLRAVSVEDAKAFAERESIFFMETSALEAMNVENAFNEVLTQIYRVVSKKALDIGDDPAAPPRGQTINVGGKDDVSAVKKAGCCSS

SEQ ID NO: 6125 - protein, 217 aa, Papaver somniferum
MAAYRADDDYDYLFKVVLIGDSGVGKSNLLSRFTRNEFSLESKSTIGVEFATRSIHVDDKVVKAQIWDTAGQERYRAITSAYYRGAVGALLVYDVTRHVTFENVERWLKELRDHTDSNIVIMLVGNKADLRHLRAVSTEDATAFAEKENTCFMETSALESMNVENAFTEVLTQIYRVVSRKALDIGDDPAALPKGQTINVGSKDDVSAVKKVGCCSA

SEQ ID NO: 6126 - protein, 217 aa, Prunus persica
MGAYRADDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDANIVIMLVGNKGDLRHLRAVSTEDAKAFAERENTFFMETSALESMNVDNAFTEVLTQIYRVVSRKALDIGDDPAALPKGQTINVGGKDDVSAVKKVGCCSA

SEQ ID NO: 6127 - protein, 217 aa, Tripterygium wilfordii
MGAYRADDDYDYLFKVVLIGDSGVGKSNLLSRFTRNEFSLESKSTIGVEFATRSIHVDDKVVKAQIWDTAGQERYRAITSAYYRGAVGALLVYDVTRHVTFENVERWLKELRDHTDSNIVIMLVGNKADLRHLRAVSTEDAKAFAERENTFFMETSALESLNVENAFTEVLTQIYRVVSRKALDIGDDPAALPKGQTINVGTKDDVSAVKKVGCCSA

SEQ ID NO: 6128 - protein, 96 aa, Tropaeolum majus
MLVGNKADLRHLRAVSTEEATAFAERENTFFMETSALESLNVENAFTEVLTQIYRVVSKKALDIGEDPAALPKGQTINVGGKDDVSAVKKVGCCSA

SEQ ID NO: 6129 - protein, 85 aa, Allium cepa
MAYRADDDYDYLFKVVLIGDSGVGKSNLLSRFTRNEFSLESKSTTGVEFATRSIHVDDKVVKAQIWDTAGQEGIVQSLVHTIEEP

SEQ ID NO: 6130 - protein, 218 aa, Amborella trichopoda
MAYRADEDYDYLFKVVLIGDSGVGKSNLLSRFTRNEFSLESKSTIGVEFATRSIHVDDKVVKAQIWDTAGQERYRAITSAYYRGAVGALLVYDVTRHVTFENVERWLKELRDHTDSNIVIMLVGNKADLRHLRAVSTEDAKAFAERENNFFMETSALESMNVENAFTEVLTQIYRVVSRKALDIGEDPAAAPPSKGQTINVGSKDDVSAVKKVGCCSA

SEQ ID NO: 6131 - protein, 96 aa, Catharanthus roseus
MLVGNKADLRHLRAVSTEDAKAFAERENTFFMETSALESMNVENAFTEVLTQIYRVVSRKALEVGDDPAALPKGQTINVGTKDDVSAVKKVGCCSA

SEQ ID NO: 6132 - protein, 276 aa, Cirsium arvense
MNTGPGLFSDIGKKAKDLLTRDYLTDQKFSVSTTSATGVAITSSATKKGGLSTGDVGAVYKYNNILFDVKVDTESKIATTLTFTELVPKTKTIASFKVPDFNSGKVEVQYFHCHATLQSAVAFSQSPTIDVSATVGTPMFVMGAEAGYETSSGKFTKYTAGISINKPESSASIILGDKGDSIRASYIHHLDQSKKTAAVGEIIRRFSLNDNTFTIGGSYAVDHLTMVKAKLNNQGKLGALLQHEIIPKSLVTLSSELDTKALDKTPKFGLALALKP

SEQ ID NO: 6133 - protein, 216 aa, Brachypodium distachyon
MAYRADDDYDYLFKVVLIGDSGVGKSNLLTRFTRNEFSLESKSTIGVEFATRSIRVDDKVVKAQIWDTAGQERYRAITSAYYRGAVGALVVYDVTRHVTFENVERWLKELKDHTDANIVIMLVGNKADLRHLRAVPVEDAKAFAEREYTYFTETSALEAMNVEDAFTEVLTQIYRVVSKKALDIGDDPAAPPRGQTINVGSKDDVSAVKKAGCCSS

SEQ ID NO: 6134 - protein, 217 aa, Daucus carota
MGAYRADDDYDYLFKVVLIGDSGVGKSNLLSRFTRNEFSLESKSTIGVEFATRSIHVDDKVVKAQIWDTAGQERYRAITSAYYRGAVGALLVYDVTRHVTFENVERWLKELRDHTDSNIVIMLVGNKADLRHLRAVSTEDAKAFAEKERTFFMETSALESMNVEDAFTEVLTQIHQVVSRKALEIGEDPTALPKGQTINVGGKDDVSAVKKSGCCSS

SEQ ID NO: 6135 - protein, 216 aa, Cocos nucifera
MAYRADDDYDYLFKVVLIGDSGVGKSNLLSRFTRNEFSLESKSTIGVEFATRSIHVEDKVVKAQIWDTAGQERYRAITSAYYRGAVGALLVYDVTRHVTFENVERWLKELRDHTDSNIVIMLVGNKADLRHLRAVSTEDAKAFAERESTFFMETSALESMNVENAFTEVLTQIYRVVSRKALEVGDDPAALPKGQTINVGTKDDVSAVKKVGCCSV

SEQ ID NO: 6136 - protein, 216 aa, Cocos nucifera
MSYRADDDYDYLFKVVLIGDSGVGKSNLLSRFTRNEFSLESKSTIGVEFATRSIHVDDKVVKAQIWDTAGQERYRAITSAYYRGAVGALVVYDVSRHVTFENVERWLKELRDHTDTNIVIMLVGNKADLRHLRAVSTEDAKAFAERENTFFMETSALESMNVEIAFTEVLTQIYRVVSRKALDIGDDPTTLPKGQTINVGTKDDVSAVKKAGCCST

SEQ ID NO: 6137 - protein, 217 aa, Theobroma cacao
MGAYRADDDYDYLFKVVLIGDSGVGKSNLLSRFTRNEFSLESKSTIGVEFATRSIHVDDKVVKAQIWDTAGQERYRAITSAYYRGAVGALLVYDVTRHVTFENVERWLKELRDHTDANIVIMLVGNKADLRHLRAVATEDAKSFAERENTFFMETSALESLNVENAFTEVLTQIYRVVSRKALDIGDDPAALPKGQTINVGSKDDVSAVKKVGCCSA

SEQ ID NO: 6138 - protein, 217 aa, Manihot esculenta
MGAYRADDDYDYLFKVVLIGDSGVGKSNLLSRFTRNEFSLESKSTIGVEFATRSIHVDDKVVKAQIWDTAGQERYRAITSAYYRGAVGALLVYDVTRHVTFENVQRWLKELRDHTDANIVIMLVGNKADLRHLRAVATEDAKGFAERENTFFMETSALESMNVENAFTEVLTQIYRVVSRKALDIGDDPAALPRGQTINVGGRDDVSAVKKAGCCSS

SEQ ID NO: 6139 - protein, 217 aa, Euonymus alatus
MGAYRADDDYDYLFKVVLIGDSGVGKSNLLSRFTRNEFSLESKSTIGVEFATRSIHVDDKVVKAQIWDTAGQERYRAITSAYYRGAVGALLVYDVTRHVTFENVERWLKELRDHTDSNIVIMLVGNKADLRHLRAVSTEDAKAFAERENTFFMETSALESSNVENAFTEVLTQIYRVVSRKALDVGEDPAALPKGQTINVGTKDDVSAVKKVGCCSS

SEQ ID NO: 6140 - protein, 217 aa, Papaver somniferum
MAAYRADDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDSNIVIMLVGNKADLRHLRAVSTEDATAFAEKENTCFMETSALESMNVENAFTEVLTQIYRVVSRKALDIGDDPAALPKGQTINVGSKDDVSAVKKVGCCSA

SEQ ID NO: 6141 - protein, 217 aa, Prunus mume
MGAYRADDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDANIVIMLVGNKGDLRHLRAVSTEDAKAFAERENTFFMETSALESMNVDNAFTEVLSQIYRVVSRKALDIGDDPAALPKGQTINVGGKDDVSAVKKVGCCSA

SEQ ID NO: 6142 - protein, 216 aa, Prunus persica
  Sequence also found in Organisms: Prunus mume
MAYRADDDYDYLFKVVLIGDSGVGKSNLLSRFTRNEFSLESKSTIGVEFATRSIHVDEKIVKAQIWDTAGQERYRAITSAYYRGAVGALLVYDVTRHVTFENVERWLKELRDHTDSNIVIMLVGNKADLRHLRAVSVEDAKAFAERENTFFMETSALESMNVENAFTEVLTQIYHVVSRKALEVGDDPAALPKGQTINVGNKDDVSAVKKAGCCSA

SEQ ID NO: 6143 - protein, 217 aa, Solanum lycopersicum
  Sequence also found in Organisms: Solanum phureja
MGAYRADDDYDYLFKVVLIGDSGVGKSNLLSRFSRNEFSLESKSTIGVEFATRSIHVEDKVVKAQIWDTAGQERYRAITSAYYRGAVGALLVYDVTRHVTFENVERWLKELRDHTDSNIVIMLVGNKADLRHLRAVSTEDAKAFAEKESTFFMETSALESMNVENAFTEVLTQIYRVVSKKALEAGDDPAALPKGQTINVGSKDDVSAVKKVGCCSS

SEQ ID NO: 6144 - protein, 216 aa, Thalictrum flavum
MAAYRADDDYDYLFKVVLIGDSGVGKSNLLSRFTRNEFSLDSKSTIGVEFATRSVHVDDKVVKAQIWDTAGQERYRAITSAYYRGAVGALLVYDVTRHVTFENVERWLKELRDHTDANIVIMLVGNKADLRHLRAVSTEDAKAFAERENTFFMETSALESLNVENAFTEVLTQIYRVVSRKALDIGDDPAALPKGQTINVGKDDVSAVKKVGCCST

SEQ ID NO: 6145 - protein, 217 aa, Tripterygium wilfordii
MGAYRADDDYDYLFKVVLIGDSGVGKSNLLSRFTRNEFSLESKSTIGVEFATRSIHVDDKVVKAQIWDTAGQERYRAITSAYYRGAVGALLVYDVTRHVTFENVERWLKELRDHTDANIVIMLVGNKADLRHLRAVSTDDAKGFAERENTFFMETSALESLNVENAFTEVLTQIYRVVSRKALDIGDDPAALPKGQTINVGTKDDVSAVKKVGCCSA

SEQ ID NO: 6146 - protein, 216 aa, Triticum aestivum
MAYRAEDDYDYLFKVVLIGDSGVGKSNLLSRFTRNEFSLESKSTIGVEFATRSLQVDGKVVKAQIWDTAGQERYRAITSAYYRGAVGALVVYDVTRHVTFENVERWLKELRDHTDANIVIMLVGNKADLRHLRAVSVDDAKAFAERESTFFMETSALEAMNVETAFTEVLTQIYRVVSKKALDIGDDPAAPPRGQTINVGGKDDVSAVKKAGCCSS

SEQ ID NO: 6147 - protein, 217 aa, Actinidia deliciosa
MGGYRADDDYDYLFKVVLIGDSGVGKSNLLSRFTKNEFSLESKSTIGVEFATRSIHVDDKVVKAQIWDTAGQERYRAITSAYYRGAVGALLVYDVTRHVTFENVERWLKELRGHTDSNIVIMLVGNKADLRHLRAVSTEDAKAFAESESTFFMETSALESMNVENAFTEVLTQIYHVVSRKALDIGDDPAALPKGQTINVGGKDDVSAVKNVGCCSA

SEQ ID NO: 6148 - protein, 217 aa, Arabidopsis thaliana
MAAYRADDEYDYLFKVVLIGDSGVGKSNLLSRFTRNEFSLESKSTIGVEFATRSIHVDDKIVKAQIWDTAGQERYRAITSAYYRGAVGALLVYDVTRHVTFENVERWLKELRDHTDANIVIMFVGNKADLRHLRAVSTEDAKAFAERENTFFMETSALESMNVENAFTEVLSQIYRVVSRKALDIGDDPAALPKGQTINVGSKDDVSAVKKVGCCSN

SEQ ID NO: 6149 - protein, 217 aa, Lupinus angustifolius
MGAYRADDDYDYLFKVVLIGDSGVGKSNLLSRFTKNEFSLESKSTIGVEFATRSIRVDDKVVKAQIWDTAGQERYRAITSAYYRGAVGALLVYDVTRHVTFENVERWLKELRDHTDANIVVMLVGNKADLRHLRAVSTEDATAFAERENTFFMETSALESMNVENAFTEVLTQIYRVVSKKALDIGDDPAALPKGQTINVGSRDDVSAVKKAGCCSA

SEQ ID NO: 6150 - protein, 217 aa, Tropaeolum majus
MGAYRADDDYDYLFKVVLIGDSGVGKSNLLSRFTKNEFSLESKSTIGVEFATRSIHVDDKVVKAQIWDTAGQERYRAITSAYYRGAVGALLVYDVTRHVTFENVERWLKELRDHTDANIVIMLVGNKADLRHLRAVSTEDSTAFAERENTFFMETSALESLNVENAFTEVLTQIYRVVSKKALDISEDPAALPKGQTINVGGKDDVSAMKKAGCCSS

SEQ ID NO: 6151 - protein, 217 aa, Glycine max
MGAYRADDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDANIVVMLVGNKADLRHLRAVSTEDARTFAERENTFFMETSALESLNVENAFTEVLTQIYHVVSKKALEIGDDPAALPKGQTINVGSRDDVSAVKKSGCCSA

SEQ ID NO: 6152 - protein, 217 aa, Fragaria vesca
MGAYRADDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDANIVIMLVGNKGDLRHLRAVSTEDAQAFAERENTFFMETSALESMNVDNAFTEVLSQIYRVVSRKALDIGDDPAALPKGQTINVGGKDDVSAVKKVGCCSN

SEQ ID NO: 6153 - protein, 217 aa, Tabernaemontana elegans
MGAYRADDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDSNIVIMLVGNKADLRHLRAVSTEDAKAFAERENAFFMETSALESMNVENAFTEVLTQIYRVVSRKALDVGDDPAALPKGQTINVGTKDDVSAVKKVGCCSA

SEQ ID NO: 6154 - protein, 217 aa, Valeriana officinalis
MGAYRADDDYDYLFKVVLIGDSGVGKSNLLSRFTKNEFSLESKSTIGVEFATRSIRVDDKVVKAQIWDTAGQERYRAITSAYYRGAVGALLVYDVTRHVTFENVERWLKELRDHTDSNIVIMLVGNKADLRHLRAVSVEDAKAFAERESTFFMETSALESMNVENSFTEVLTQIYHVVSKKALDIGDDPAALPKGQTINVGNKDDVSEVKKGGCCSS

SEQ ID NO: 6155 - protein, 133 aa, Euonymus alatus
MGAYRADDDYDYLFKVVLIGDSGVGKSNLLSRFTRNEFSLESKSTIGVEFATRSIHVDDKVVKAQIWDTAGQERYRAITSAYYRGAVGALLVYDVTRHVTFENVERWLKELRDHTDSNIVIMLVGNKADLRHL

SEQ ID NO: 6156 - protein, 216 aa, Malus domestica
MAYRADDDYDYLFKVVLIGDSGVGKSNLLSRFTRNEFSLESKSTIGVEFATRSIHVDEKIVKAQIWDTAGQERYRAITSAYYRGAVGALLVYDVTRHVTFENVERWLKELRDHTDSNIVIMLVGNKADLRHLRAVSVEDAKAFAERENTFFMETSALESMNVENAFTEVLTQIYHVVCRKALEVGDDPAALPKGQTINVGNKDDVSAVKKDSCCSA

SEQ ID NO: 6157 - protein, 214 aa, Solanum tuberosum
YRADDDYDYLFKVVLIGDSGVGKSNLLSRFSRNEFSLESKSTIGVEFATRSIHVEDKVVKAQIWDTAGQERYRAITSAYYRGAVGALLVYDVTRHVTFENVERWLKELRDHTDSNIVIMLVGNKADLRHLRAVSTEDAKAFAEKESTFFMETSALESMNVENAFTEVLTQIYRVVSKKALEAGDDPAALPKGQAINVGSKDDVSAVKKVGCCSS

SEQ ID NO: 6158 - protein, 218 aa, Eucalyptus grandis
MAGGYRADDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDSNIVIMLVGNKADLRHLRAVSTEDAKAFAERENTYFMETSALESMNVENSFTEVLTQIYHVVSRKALDVGEDPAAPPKGQTISVGSKDDVSAVKKVGCCSA

SEQ ID NO: 6159 - protein, 217 aa, Cyclamen graecum
MGAYRADDDYDYLFKVVLIGDSGVGKSNLLSRFTRNEFSLESKSTIGVEFATRSIHVDDKVVKAQIWDTAGQERYRAITSAYYRGAVGALLVYDVTRHVTFENVERWLKELRDHTDSNIVIMLVGNKADLRHLRAVSTEDAKSFAERENTFFMETSALESLNVENAFTEVLTQIHRVVSRKALEVGDDPAALPKGQTINVGGKDDVSALKKAGCCSS

SEQ ID NO: 6160 - protein, 212 aa, Avena sativa
AEDDYDYLFKVVLIGDSGVGKSNLLSRFTRNEFSLESKSTIGVEFATRSIRVDDKVVKAQIWDTAGQERYRAITSAYYRGAVGALVVYDVTRHVTFENVERWLKELRDHTDANIVIMLVGNKADLRHLRAVSVEDAKAFAERESIFFMETSALEAMNVENAFNEVLTQIYRVVSKKALDIGDDPAAPPRGQTINVGGKDDVSAVKKAGCCSS

SEQ ID NO: 6161 - protein, 216 aa, Ananas comosus
MAYRADDDYDYLFKVVLIGDSGVGKSNLLSRFTRNEFSLESKSTIGVEFATRSIHVDDKVVKAQIWDTAGQERYRAVTSAYYRGAVGALVVYDVTRHITFENVERWLKELRDHTDANIVIMLVGNKADLRHLRAVSTEDAKAFAEKENTFFMETSALEALNVEAAFTEVLTQIYRVASRKALDISGDPSAPPRGQTINVGSKDDVSAVKKVGCCSA

SEQ ID NO: 6162 - protein, 216 aa, Ricinus communis
MGAYRADDDYDYLFKVVLIGDSGVGKSNLLSRFTRNEFSLESKSTIGVEFATRSIHVDDKVVKAQIWDTAGQERYRAITSAYYRGAVGALLVYDVTRHVTFENVERWLKELRDHTDSNIVIMLVGNKADLRHLRAVTTEDAKAFAERESTFFMETSALESLNVENAFTEVLTQIYRVVSRKALDVGDDPAALPKGQTINVGKDDVSAVKKVGCCSA

SEQ ID NO: 6163 - protein, 217 aa, Coffea canephora
MGAYRADDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDSNIVIMLVGNKADLRHLRAVSTEDAKAFAERENTFFMETSALESMNVENAFTEVLTQIYRVVSRKALEVGEDPAALPKGQTINVGTKDDVSAVKKVGCCSA

SEQ ID NO: 6164 - protein, 217 aa, Amsonia hubrichtii
MGAYRADDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDSNIVIMLVGNKADLRHLRAVSTEDAKSFAERENTFFMETSALESMNVENAFTEVLTQIYRVVSRKALEVGDDPAALPKGQTINVGTKDDVSAVKKVGCCSA

SEQ ID NO: 6165 - protein, 217 aa, Malus domestica
MGAYRADDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDANIVIMLVGNKGDLRHLRAVSTDDAKAFAERENTFFMETSALESMNVDNAFTEVLTQIHRVVSRKALDIGDDPAALPKGQTINVGGKDDVSAVKQVGCCST

SEQ ID NO: 6166 - protein, 217 aa, Arabidopsis lyrata
MAAYRADDDYDYLFKVVLIGDSGVGKSNLLSRFTRNEFSLESKSTIGVEFATRSIHVDDKIVKAQIWDTAGQERYRAITSAYYRGAVGALLVYDVTRHVTFENLERWLKELRDHTDSNIVIMFVGNKADLRHLRAVSTEDAKAFAERENTFFMETSALESMNVENAFTEVLSQIYRVVSRKALDIGDDPAALPKGQTINVGSKDDVSAVKKVGCCSN

SEQ ID NO: 6167 - protein, 217 aa, Fagus grandifolia
MGAYRADDDYDYLFKVVLIGDSGVGKSNLLSRFTKNEFSLESKSTIGVEFATRSIRVDEKVVKAQIWDTAGQERYRAITSAYYRGAVGALLVYDVTRHVTFENVERWLKELRDHTDANIVIMLVGNKADLRHLRAVSTEDAKAFAERENTFFMETSALESMNVENAFTEVLTQIYHVVSRKALEIGDDPATLPKGETINVGNKDDVSAVKKVGCCSA

SEQ ID NO: 6168 - protein, 217 aa, Manihot esculenta
MGAYRADDDYDYLFKVVLIGDSGVGKSNLLSRFTRNEFSLESKSTIGVEFATRSIHVDDKVVKAQIWDTAGQERYRAITSAYYRGAVGALLVYDVTRHVTFENVERWLKELRDHTDTNIVIMLVGNKADLRHLRAVATDDAKGFAQRENTFFMETSALESLNVENAFTEVLTQIYRVVSKKALDIGDDPAALPRGQTINVGGRDDVSAVKKAGCCSS

SEQ ID NO: 6169 - protein, 217 aa, Cicer arietinum
MGAYRADDDYDYLFKVVLIGDSGVGKSNLLSRFTKNEFSLESKSTIGVEFATRSIRVDDKVVKAQIWDTAGQERYRAITSAYYRGAVGALLVYDVTRHVTFENVERWLKELRDHTDANIVVMLVGNKADLRHLRAVSTEDATAFAERENTFFMETSALESMNVENAFTEVLTQIYRVVSKKALEIGDDPAALPKGQTIDVGSRDDVSAVKKSGCCSA

SEQ ID NO: 6170 - protein, 217 aa, Cynara scolymus
MGAYRADDDYDYLFKVVLIGDSGVGKSNLLSRFTRNEFSLESKSTIGVEFATRSIRVDEKVVKAQIWDTAGQERYRAITSAYYRGAVGALIVYDVTRHVTFENVERWLKELRDHTDSNIIIMLVGNKSDLRHLRAVPTDDAKAFAEKENTYFMETSALESMNVENAFTEVLTQIYHVVSKKALDIGDDPAALPKGQTINVGGKDDVSALKKVGCCST

SEQ ID NO: 6171 - protein, 217 aa, Euonymus alatus
MGAYRADDDYDYLFKVVLIGDSGVGKSNLLSRFTRDEFSLESKSTIGVEFATRSIHVDDKVVKAQIWDTAGQERYRAITSAYYRGAVGALLVYDVTRHVTFENVERWLKELRDHTDSNIVIMLVGNKADLRHLRAVSTDDAKAFAERENTFFMETSALESLNVENAFTEVLTQIYRVVSRKALDVGDDPAALPKGQTINVGTKDDVSAVKKVGCCSA

SEQ ID NO: 6172 - protein, 217 aa, Euonymus alatus
MGAHRADDDYDYLFKVVLIGDSGVGKSNLLSRFTRNEFSLESKSTIGVEFATRSIHVDDKVVKAQIWDTAGQERYRAITSAYYRGAVGALLVYDVTRHVTFENVERWLKELRDHTDSNIVIMLVGNKADLRHLRAVSTEDAKAFAERENTFFMETSALESLNVENAFTEVLTQIYRVVSRKALDVGEDPAALPKGQTISVGTKDDVSAVKKVGCCSS

SEQ ID NO: 6173 - protein, 217 aa, Lupinus angustifolius
MGAYRADDDYDYLFKVVLIGDSGVGKSNLLSRFTKNEFSLESKSTIGVEFATRSIRVDDKVVKAQIWDTAGQERYRAITSAYYRGAVGALLVYDVTRHVTFENVERWLKELRDHTDANIVVMLVGNKADLRHLRAVSTEDATSFAERENTFFMETSALESMNVENAFTEVLTQIYRVVSKKALDIGDDPAALPKGQTINVGSRDDVSAVKKAGCCSA

SEQ ID NO: 6174 - protein, 217 aa, Carica papaya
MAAYRADDDYDYLFKVVLIGDSGVGKSNLLSRFTRNEFSLESKSTIGVEFATRSIRVDDKIVKAQIWDTAGQERYRAITSAYYRGAVGALLVYDVTRHVTFENVERWLKELRDHTDANIVIMLVGNKADLRHLRAVSTEDAQSFAERENTFFMETSALESMNVENAFTEVLTQIYRVVSRKTLDIGDDPAALPKGQTINVGTKDDVSAVKKVGCCSA

SEQ ID NO: 6175 - protein, 217 aa, Cajanus cajan
MGAYRADDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDANIVVMLVGNKADLRHLRAVSTEDATSFAERENTFFMETSALESLNVENAFTEVLTQIYHVVSKKALEIGDDPAALPKGQTINVGSRDDVSAVKKTGCCSA

SEQ ID NO: 6176 - protein, 217 aa, Primula obconica
MGAYRADDDYDYLFKVVLIGDSGVGKSNLLSRFTRNEFSLESKSTIGVEFATRSIHVDDKVVKAQIWDTAGQERYRAITSAYYRGAVGALLVYDVTRHVTFENVERWLKELRDHTDANIVIMLVGNKADLRHLRAVSTEDAKSFAERENTFFMETSALESLNVENAFTEVLTQIHRVVSRKALEVGDDPAALPKGQTISVGGKDDVSAMKKAGCCSS

SEQ ID NO: 6177 - protein, 217 aa, Carthamus tinctorius
MGAYRADDDYDYLFKVVLIGDSGVGKSNLLSRFTRNEFSLESKSTIGVEFATRSIRVDEKVVKAQIWDTAGQERYRAITSAYYRGAVGALIVYDVTRHVTFENVERWLKELRDHTDSNIVIMLVGNKSDLRHLRAVPTEDAKAFAEKENTYFMETSALESMNVENAFTEVLTQIYHVVSKKALDLGEDPAALPKGQTINVGGKDDVSALKKVGCCST

SEQ ID NO: 6178 - protein, 216 aa, Fragaria vesca
MAYRSDDDYDYLFKVVLIGDSGVGKSNLLSRFTRNEFSLESKSTIGVEFATRSIHVDDKIVKAQIWDTAGQERYRAITSAYYRGAVGALLVYDVTRHVTFENVERWLKELRDHTDSNIVIMLVGNKADLRHLRAVSVEDAKAFAERENTFFMETSALESMNVENAFSEVLTQIYQVVSRKALEVGDDPAAVPKGQTINVGGKDDVSAIKKAGCCSA

SEQ ID NO: 6179 - protein, 217 aa, Tripterygium wilfordii
MGAYRADDDYDYLFKVVLIGDSGVGKSNLLSRFTRNEFSLESKSTIGVEFATRSIHVDDEVVKAQIWDTAGQERYRAITSAYYRGAVGALLVYDVTRHVTFENVERWLKELRDHTDSNIVIMLVGNKADLRHLRAVSTEDAKAFAEQENTFFMETSALESLNVENAFTEVLTQIYRVVSRKALDVGEDPAALPKGQTIKVGTKDDVSAVKKVGCCSS

SEQ ID NO: 6180 - protein, 217 aa, Vinca minor
MGAYRADDDYDYLFKVVLIGDSGVGKSNLLSRFTRNEFSLESKSTIGVEFATRTIRVDDKVVKAQIWDTAGQERYRAITSAYYRGAVGALLVYDVTRHVTFENVERWLKELRDHTDSNIVIMLVGNKADLRHLRAVSTEDAKAFAEREHTFFTETSALESMNVENAFTEVLTQIYRVVSRKALDAGDDPAALPKGQTINVGTKDDVSAVKKAGCCSS

SEQ ID NO: 6181 - protein, 114 aa, Euonymus alatus
MGAYRADDDYDYLFKVVLIGDSGVGKSNLLSRFTRNEFSLESKSTIGVEFATRSIHVDDKVVKAQIWDTAGQERYRAITSAYYRGAVGAFLVYDVTRHVIRERGEMVKGASGSH

SEQ ID NO: 6182 - protein, 217 aa, Castanea mollissima
MGAYRADDDYDYLFKVVLIGDSGVGKSNLLSRFTKNEFSLESKSTIGVEFATRSIRVDEKVVKAQIWDTAGQERYRAITSAYYRGAVGALLVYDVTRHVTFENVERWLKELRDHTDANIVIMLVGNKADLRHLRAVSTEDAKAFAERENTFFMETSALESLNVENAFTEVLTQIYHVVSRKALEVGDDPAAVPKGETINVGTKDDVSAVKKVGCCST

SEQ ID NO: 6183 - protein, 217 aa, Vaccinium corymbosum
MASYRADDDYDYLFKVVLIGDSGVGKSNLLSRFTRNEFSLESKSTIGVEFATRSIRVEDKVVKAQIWDTAGQERYRAITSAYYRGAVGALLVYDVTRHVTFENVERWLKELRDHTDANIVIMLVGNKADLRHLRAVSTEDAKAFAERESTFFMETSALESLNVENAFTEALTQIYRVVSRKALDIGNDPAALPKGQTINVGNKDDVSAVKNVGCCSA

SEQ ID NO: 6184 - protein, 217 aa, Citrus clementina
  Sequence also found in Organisms: Citrus sinensis
MGAYRADDDYDYLFKVVLIGDSGVGKSNLLSRFTRNEFSLESKSTIGVEFATRSIRCDDKIVKAQIWDTAGQERYRAITSAYYRGAVGALLVYDVTRHVTFENVERWLKELRDHTDSNIVIMLVGNKADLRHLRAVSTEDATAFAERENTFFMETSALESMNVENAFTEVLTQIYRVVSRKALEIGDDPAALPKGQTINVGTKDDVSAVKKVGCCSN

SEQ ID NO: 6185 - protein, 215 aa, Euphorbia peplus
MAAYRAEDDYDYLFKLVLIGDSGVGKSNLLSRFTRNEFSLESKSTIGVEFATRSIHVDDKIVKAQIWDTAGQERYRAITSAYYRGAVGALLVYDVTRHVTFENVERWLKELRDHTDANIVIMLVGNKSDLRHLRAVSTEDAKAFAEKENTYFMETSALESMNVENAFTEVLTQIYHVVCRKALDIGDDPAAVPKGQNINVKDDVSAVKKVGCCSV

SEQ ID NO: 6186 - protein, 217 aa, Panax ginseng
MGAYRADDDYDYLFKVVLIGDSGVGKSNLLSRFTRNEFSLESKSTIGVEFATRSIRVDDKVVKAQIWDTAGQERYRAITSAYYRGAVGALLVYDVTRNVTFENVERWLKELRDHTDSNIVIMLVGNKSDLRHLRAVSTENAKTFAERESTFFMETSALESMNVENAFTEVLTQIYHVVSRKALDIGDDPAALPKGQTINVGNKDDVSAVKKVGCCSA

SEQ ID NO: 6187 - protein, 217 aa, Vitis vinifera
MAAYRADDDYDYLFKVVLIGDSGVGKSNLLSRFTRNEFSLESKSTIGVEFATRSIRVDDKIVKAQIWDTAGQERYRAITSAYYRGAVGALLVYDVTRHVTFENVERWLKELRDHTDSHIVIMLVGNKGDLRHLRAVSIDDAKAFAERENTFFMETSALESMNVENAFTEVLTQIYQVVSRKALDIGDDPAALPKGQTINVGTKDDVSAVKKAGCCSS

SEQ ID NO: 6188 - protein, 217 aa, Humulus lupulus
MGAYRTDDDYDYLFKVVLIGDSGVGKSNLLSRFTRNEFSLESKSTIGVEFATRSIQVDDKVVKAQIWDTAGQERYRAITSAYYRGAVGALLVYDVTRHVTFENVERWLKELRDHTDANIVVMLVGNKADLRHLRAISTEDATAFAERENTFFMETSALESLNVENSFTEVLTQIYRVVSKKALDIGDDPAALPKGQTISVGKDDVSAVKKVGCCSSV

SEQ ID NO: 6189 - protein, 217 aa, Lotus japonicus
MGAYRADDDYDYLFKVVLIGDSGVGKSNLLSRFTKNEFSLESKSTIGVEFATRSIRVDDKVVKAQIWDTAGQERYRAITSAYYRGAVGALLVYDVTRHVTFENVERWLKELRDHTDTNIVVMLVGNKADLRHLRAVSTEDSTAFAERENTFFMETSALESLNVENAFTEVLTQIYRVVSKKALEIGDDPAALPKGQTINVGSRDDVSAVKKSGCCSS

SEQ ID NO: 6190 - protein, 217 aa, Nicotiana benthamiana
MGAYRADDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDSSIVIMLVGNKADLRHLRAVSTEDAKAFAEKESTFFMETSALESMNVDNAFTEVLTQIHRVVSRKALEVGDDPAALPKGQTINVGGKDDVSEVKKAGCCSS

SEQ ID NO: 6191 - protein, 217 aa, Quercus alba
MGAYRADDDYDYLFKVVLIGDSGVGKSNLLSRFTKNEFSLESKSTIGVEFATRSIRVDEKVVKAQIWDTAGQERYRAITSAYYRGAVGALLVYDVTRHVTFENVERWLKELRDHTDANIVIMLVGNKADLRHLRAVATEDAKAFAERENTFFMETSALESMNVENAFTEVLTQIYHVVSRKALEVGDDPAAVPKGETINVGTKDDVSAVKKVGCCST

SEQ ID NO: 6192 - protein, 217 aa, Quercus alba
MGAYRADDDYDYLFKVVLIGDSGVGKSNLLSRFTRNEFSLESKSTIGVEFATRSIHVDDKVVKAQIWDTAGQERYRAITSAYYRGAVGALLVYDVTRHVTFENVERWLKELRDHTDSNIVIMLVGNKADLRHLRAVSTEDATAFAERENTFFMETSALESLNVENAFTEVLSQIYRVVSRKALDVGDDPGALPKGQTINVGSKDDVSAVKKVGCCSA

SEQ ID NO: 6193 - protein, 217 aa, Capsicum annuum
MGAYRAEDDYDYLFKVVLIGDSGVGKSNLLSRFSRNEFSLESKSTIGVEFATRSIHVEDKVVKAQIWDTAGQERYRAITSAYYRGAVGALLVYDVTRHVTFENVERWLKELRDHTDSNIVIMLVGNKADLRHLRAVSTEDAKAFAEKESTFFMETSALESMNVENAFTEVLTQIYRVVSKKALEAGDDPAALPQGQTINVGNKDDVSAVKKVGCCSA

SEQ ID NO: 6194 - protein, 217 aa, Citrullus lanatus
MAAYRTDDDYDYLFKVVLIGDSGVGKSNLLSRFTRNEFSLESKSTIGVEFATRSIRVDDKIVKAQIWDTAGQERYRAITSAYYRGAVGALLVYDVTRHVTFENVERWLKELRDHTDSNIVIMLVGNKADLRHLRAVSTEDAKAFAEKENTFFMETSALESLNVENAFTEVLTQIYRVVCRKALEIGEDPAALPKGQTINVGNKDDVSAVKKVGCCSS

SEQ ID NO: 6195 - protein, 216 aa, Elaeis guineensis
MAYRADDDYDYLFKVVLIGDSGVGKSNLLSRFARNEFSLESKSTIGVEFATRSIHVEDKVIKAQIWDTAGQERYRAITSAYYRGAVGALLVYDVTRHITFENVERWLKELRDHTDSNIVIMLVGNKADLRHLRAVSTEDAKGFAERENTFFMETSALESMNVENAFTEVLTQIYRVVSRKALEVGDDPAALPKGQTINVGTKDDVSAVKKVGCCSV

SEQ ID NO: 6196 - protein, 218 aa, Eucalyptus grandis
MAGGYRADDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDSNIVIMLVGNKADLRHLRAVSTEDATAFAEKENTFFMETSALESMNVENAFTEVLTQIHRVVSRKALEAGNDPGALPKGQTINVGSKDDVSEVKKVGCCSS

SEQ ID NO: 6197 - protein, 217 aa, Ricinus communis
MGAYRADDDYDYLFKVVLIGDSGVGKSNLLSRFTRNEFSLESKSTIGVEFATRSIHVDDKVVKAQIWDTAGQERYRAITSAYYRGAVGALLVYDVTRHVTFENVERWLKELRDHTDANIVIMLVGNKADLRHLRAITIEDATAFAQRQNTFFMETSALESMNVENAFTEVLTQIYRVVSRKALDIGDDPAALPRGQTINVGSRDDVSAVKKAGCCSS

SEQ ID NO: 6198 - protein, 217 aa, Trifolium pratense
MGAYRADDDYDYLFKVVLIGDSGVGKSNLLSRFTKNEFSLESKSTIGVEFATRSIRVDDKVVKAQIWDTAGQERYRAITSAYYRGAVGALLVYDVTRHVTFENVERWLKELRDHTDANIVVMLVGNKADLRHLRAVSTEDSTAFAERENTFFMETSALESLNVESAFTEVLTQIYRVVSKKALEIGDDPAALPKGQTINVGSRDDVSAVKKSGCCSA

SEQ ID NO: 6199 - protein, 217 aa, Glycine max
MGAYRADDDYDYLFKVVLIGDSGVGKSNLLSRFTKNEFSLESKSTIGVEFATRSIHVDDKIVKAQIWDTAGQERYRAITSAYYRGAVGALLVYDVTRHVTFENVERWLKELRDHTDANIVIMLVGNKADLRHLRAVSTDDAKAFAERENTFFMETSALESLNVDNAFTEVLTQIYRVVSRKTLEIGDDPAALPKGQTINVGSRDDVSAVKKSGCCSA

SEQ ID NO: 6200 - protein, 217 aa, Malus domestica
MGAYRADDDYDYLFKVVLIGDSGVGKSNLLARFTKNEFSLESKSTIGVEFATRSIRVDDKVVKAQIWDTAGQERYRAITSAYYRGAVGALLVYDVTRHVTFENVERWLKELRDHTDANIVIMLVGNKGDLRHLRAVSTDDAKAFAERENTFFMETSALESMNVENAFTEVLTQIHRVVSRKDLDIGDDPAALPKGQTINVGGKDDVSAVKQDGCCST

SEQ ID NO: 6201 - protein, 217 aa, Phaseolus vulgaris
MGAYRADDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDANIVVMLVGNKADLRHLRAVSTEDATSFAERESTFFMETSALESLNVENAFTEVLTQIYHVVSKKALEIGDDPAALPKGQTINVGSRDDVSAMKKAGCCSA

SEQ ID NO: 6202 - protein, 214 aa, Beta vulgaris
MGYRADDDYDYLFKVVLIGDSGVGKSNLLSRFTRNEFSLESKSTIGVEFATRSIHVDDKVVKAQIWDTAGQERYRAITSAYYRGAVGALLVYDVTRHVTFENVERWLKELRDHTDSNIVIMLVGNKADLRHLRAVSTEDAQTFAEKEKTYFMETSALESLNVENAFTEVLTQIYRVVSRKALEAGDDPAAVPKGQTINVKDDVSAVKKVGCCST

SEQ ID NO: 6203 - protein, 217 aa, Theobroma cacao
MAAYRADDDYDYLFKVVLIGDSGVGKSNLLSRFTRNEFSLESKSTIGVEFATRSIRVDDKIVKAQIWDTAGQERYRAITSAYYRGAVGALLVYDVTRHVTFENVERWLKELRDHTDSNIVIMLVGNKADLRHLRAVSTEDAKAFAERENTFFMETSALESMNVENAFTEVLSQIYRVVSRKALEVGDDPAALPKGQTINVGSKDDVSAIKKVGCCSA

SEQ ID NO: 6204 - protein, 217 aa, Citrus clementina
MGAYRADDDYDYLFKVVLIGDSGVGKSNLLSRFTKNEFSLESKSTIGVEFATRSIRVDDKVVKAQIWDTAGQERYRAITSAYYRGAVGALLVYDVTRHVTFENVERWLKELRDHTDSNIVIMLVGNKADLRHLRAVSTEDAQSFAEKENTFFMETSALESLNVENAFTEVLTQIYRVVSRKALDVGDDPAALPKGQTINIGTKDDVSAVKKTGCCSA

SEQ ID NO: 6205 - protein, 217 aa, Citrus clementina
MAAYRADEDYDYLYKVVLIGDSGVGKSNLLSRFTRNEFSLESKSTIGVEFATRSIRVEDKIVKAQIWDTAGQERYRAITSAYYRGAVGALLVYDVTRHVTFENVERWLKELRGHTDSNIVIMLVGNKADLRHLRAVSTEDAKAFAERENTFFMETSALESMNVENAFTEVLTQIYHVVSRKALDIGGDPAALPKGQTINVGGKDDVSAVKKVGCCNA

SEQ ID NO: 6206 - protein, 216 aa, Fagopyrum esculentum
MGFRADDDYDYLFKVVLIGDSGVGKSNLLSRFTRNEFSLESKSTIGVEFATRSIHVDDKVVKAQIWDTAGQERYRAITSAYYRGAVGALLVYDVTRHVTFENVERWLKELRDHTDSSIVIMLVGNKADLRHLRAVSTEDATAFAEKEQTVFMETSALESLNVENAFTEVLTQIYRVVSKKALEGGDDPGSVPKGQTINVGSKDDVSAVKKAGCCSS

SEQ ID NO: 6207 - protein, 216 aa, Panax ginseng
MAAYRADDDYDYLFKVVLIGDSGVGKSNLLSRFTKNEFSLESKSTIGVEFATRSIRVDDKIVKAQIWDTAGQERYRAITSAYYRGAVGALVVYDVTRHVTFENVERWLKELRDHTDANIVIMLVGNKADLRHLRAVATDDAKAFAERESTFFMETSALESLNVENAFTEVLSQIYHVVSRKALEIGDDPAALPKGQTINVGKDDVSAVKKVGCCSV

SEQ ID NO: 6208 - protein, 217 aa, Carpinus betulus
MGAYRSDDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDANIVIMLVGNKADLRHLRAVSTEDATSFAEREGTFFMETSALESLNVENAFTEVLTQIYHVVSRKALDVGDDPAALPKGKTINVGAKDDVSAVKKVGCCSA

SEQ ID NO: 6209 - protein, 217 aa, Lotus japonicus
MGAYRADDDYDYLFKVVLIGDSGVGKSNLLSRFTKNEFSLESKSTIGVEFATRSIHVDDKIVKAQIWDTAGQERYRAITSAYYRGAVGALLVYDVTRHVTFENVERWLKELRDHTDANIVIMLVGNKADLRHLRAVSTDDAKGFAERENTFFMETSALESLNVDNAFTEVLTQIYRVVSKKTLEIGDDPAALPKGQTINVGSKDDVSAVKKVGCCSA

SEQ ID NO: 6210 - protein, 217 aa, Medicago truncatula
MGAYRADDDYDYLFKVVLIGDSGVGKSNLLSRFTKNEFSLESKSTIGVEFATRSIRVDDKVVKAQIWDTAGQERYRAITSAYYRGAVGALLVYDVTRHVTFENVERWLKELRDHTDANIVVMLVGNKADLRHLRAVSTEDSTAFAERENTFFMETSALESMNVENAFTEVLTQIYRVVSKKALEIGDDPTALPKGQTIDVGSRDDVSAVKKSGCCSA

SEQ ID NO: 6211 - protein, 217 aa, Nicotiana benthamiana
MGAYRADDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDSSIVIMLVGNKADLRHLRAVSTEDAKAFAEKESTFFMETSALESMNVDNAFTEVLTQIHRVVSRKALEVGDDPATLPKGQTINVGGKDDVSEVKKAGCCSS

SEQ ID NO: 6212 - protein, 217 aa, Nicotiana benthamiana
MGAYRADDDYDYLFKVVLIGDSGVGKSNLLSRFSRNEFSLESKSTIGVEFATRSIRVEDKVVKAQIWDTAGQERYRAITSAYYRGAVGALLVYDVTRHVTFENVERWLKELRDHTDSNIVIMLVGNKADLRHLRAVSTEDAKAFAEKESTFFMETSALESMNVENAFTEVLTQIYRVVSRKALEAGDDPVALPKGQTINVGNKDDVSAVKKVGCCSA

SEQ ID NO: 6213 - protein, 217 aa, Cajanus cajan
MGAYRADDDYDYLFKVVLIGDSGVGKSNLLSRFTKNEFSLESKSTIGVEFATRSIHVDDKIVKAQIWDTAGQERYRAITSAYYRGAVGALLVYDVTRHVTFENVERWLKELRDHTDANIVIMFVGNKADLRHLRAVSTDDAKAFAERENTFFMETSALESLNVDNAFTEVLTQIYRVVSRKTLEIGDDPAALPKGQTINVGGKDDVSAVKKAGCCSA

SEQ ID NO: 6214 - protein, 216 aa, Plantago ovata
MGAYRADDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDSNIVIMLVGNKADLRHLRAVSTEDAKAFAEREKTFFMETSALESMNVENAFTEVLTQIHGVVSRKALEVGDDPAALPKGQTISVGKDDVSAVKKVGCCSA

SEQ ID NO: 6215 - protein, 216 aa, Populus trichocarpa
MGAYRADDDYDYLFKVVLIGDSGVGKSNLLSRFTKNEFSLESKSTIGVEFATRSIHVDDKVVKAQIWDTAGQERYRAITSAYYRGAVGALLVYDVTRHVTFENVERWLKELRDHTESNIVIMLVGNKADLRHLRAVTTEDATAFAEREKTFFMETSALESLNVENAFTEVLTQIYHVVSRKALDVGDDPAALPKGQTINVGKDDVSAVKKVGCCSA

SEQ ID NO: 6216 - protein, 217 aa, Glycine max
MAAYKADDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDANIVVMLVGNKADLRHLRAVSTEDATTFAERENTFFMETSALESLNVENAFTEVLTQIYHVVSKKALEVGDDPAALPKGQTINIGSRDDVSAVKKSGCCSA

SEQ ID NO: 6217 - protein, 217 aa, Nicotiana tabacum
MGAYRADDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDSSIVIMLVGNKADLRHLRAVSTEDAKGFAEKESTFFMETSALESMNVDNAFTEVLTQIHRVVSRKALEVGDDPAALPKGQTINVGGKDDVSEVKKAGCCSS

SEQ ID NO: 6218 - protein, 216 aa, Zostera marina
MAYRTDDDYDYLFKVVLIGDSGVGKSNLLSRFTRNEFSLESKSTIGVEFATRSIRVEDKVVKAQIWDTAGQERYRAITSAYYRGAVGALLVYDVTRHVTFENVERWLKELRDHTDANIVIMLVGNKADLRHLRAVSTEDAQAFAEKETTFFMETSALESMNVENAFTEVLTQIHSVVRKKALEIGDDPVALPKGQNINVGSKDDVSEVKKVGCCST

SEQ ID NO: 6219 - protein, 218 aa, Olea europaea
MAGGYRAEDDYDYLFKVVLIGDSGVGKSNLLSRFTRNEFSLESKSTIGVEFATRSISVEDKIVKAQIWDTAGQERYRAITSAYYRGAVGALLVYDVTRHVTFENVERWLKELRDHTDQNIVIMLVGNKADLRHLRAVSTEDGKAFAERENTFFMETSALESMNVGNAFTEVLTQIYHVVSRKALDIGDDPAALPKGQTIDVGTKEDVSAVKKVGCCSV

SEQ ID NO: 6220 - protein, 218 aa, Tabernaemontana elegans
MAGGYRADDDYDYLFKVVLIGDSGVGKSNLLSRFTRNEFSLESKSTIGVEFATRSIRVDDKIVKAQIWDTAGQERYRAITSAYYRGAVGALLVYDVTRHVTFENVERWLKELRDHTDQNIVIMLVGNKADLRHLRAVSTEDAKAFAERESLYFMETSALESMNVENAFTEVLSQIYHVVSKKALEVGDDPAAVPKGQTIDVGNKDDVSAVKKVGCCSV

SEQ ID NO: 6221 - protein, 217 aa, Trifolium pratense
MGAYRADDDYDYLFKVVLIGDSGVGKSNLLSRFTKNEFSLESKSTIGVEFATRSIRVDDKVVKAQIRDTAGQERYRAITSAYYRGAVGALLVYDVTRHVTFENVERWLKELRDHTDANIVVMLVGNKADLRHLRAVSTEDSTAFAERENTFFMETSALESLNVESAFTEVLTQIYRVVSKKALEIGDDPAALPKGQTINVGARDDVSAVKKSGCCSA

SEQ ID NO: 6222 - protein, 216 aa, Allium cepa
MAYRADDDYDYLFKVVLIGDSGVGKSNLLSRFTRNEFSLESKSTIGVEFATRSIHVDDKVIKAQIWDTAGQERYRAITSAYYRGAVGALLVYDVTRHVTFENVERWLKELRDHTDSTIVIMLVGNKADLRHLKAVTTEDAKAFAERESTFFMETSALESMNVENAFTEVLTQIYRVVSRKALEVGNDAAALPKGQTINVGSKDDVSAVKKGGCCST

SEQ ID NO: 6223 - protein, 217 aa, Petroselinum crispum
MGAYRADDDYDYLFKVVLIGDSGVGKSNLLSRFTRNEFSLESKSTIGVEFATRSIQVDDKVVKAQIWDTAGQERYRAITSAYYRGAVGALLVYDVTRHVTFENLERWLKELRDHTDANIVIMLVGNKSDLRHLRAVSTEDAKAFAEKEGTYFMETSALESMNVDDAFTEVLTQVHHVVSKKALEIGDDQAALPKGKTINVGNKDDVSAVKKAGCCSS

SEQ ID NO: 6224 - protein, 217 aa, Glycine max
MGAYRADDDYDYLFKVVLIGDSGVGKSNLLSRFTKNEFSLESKSTIGVEFATRSIHVDDKIVKAQIWDTAGQERYRAITSAYYRGAVGALLVYDVTRHVTFENVERWLKELRDHTDANIVIMLVGNKADLRHLRAVATNDAKAFAERENTFFMETSALESLNVDNAFTEVLTQIYRVVSRKTLEIGDDPAALPKGQTINVGSRDDVSAVKKSGCCSA

SEQ ID NO: 6225 - protein, 216 aa, Manihot esculenta
MGAYRADDDYDYLFKVVLIGDSGVGKSNLLSRFTKNEFSLESKSTIGVEFATRSIHVDDKVVKAQIWDTAGQERYRAITSAYYRGAVGALLVYDVTRHVTFENVERWLKELRDHTDSNIVIMLVGNKADLRHLRAVTTDDAKAFAEKENTFFMETSALESLNVDNAFTEVLTQIYRVVSRKALDIGDDPTSLPKGQTINVGKDDVSAMKKDGCCSA

SEQ ID NO: 6226 - protein, 216 aa, Manihot esculenta
MGAYRADDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDSNIVIMLVGNKADLRHLRAVTMEDAKAFAERENTFFMETSALESLNVENAFTEVLTQIYRVVSRKALEVGDDPAALPKGQTINVGKDDVSAMKKVGCCSA

SEQ ID NO: 6227 - protein, 215 aa, Ricinus communis
MAAYRAEDDYDYLFKVVLIGDSGVGKSNLLSRFTRNEFSLESKSTIGVEFATRSIRVDDKIVKAQIWDTAGQERYRAITSAYYRGAVGALLVYDVTRHVTFENVERWLKELRGHTDANIVIMLVGNKADLRHLRAVSTEDAKAFAERENTFFMETSALESMNVENAFTEVLTQIYRVVSRKALEVGDDPGALPKGQTINVKDDVSAVKKVGCCSA

SEQ ID NO: 6228 - protein, 217 aa, Cucumis sativus
  Sequence also found in Organisms: Cucumis melo
MAAYRTDDDYDYLFKVVLIGDSGVGKSNLLSRFTRNEFSLESKSTIGVEFATRSIRVDDKIVKAQIWDTAGQERYRAITSAYYRGAVGALLVYDVTRHVTFENVERWLKELRDHTDSNIVIMLVGNKADLRHLRAVSTEDAQAFAEKENTFFMETSALESLNVENAFTEVLTQIYRVVCRKALEIGEDPAALPKGQTINVGNKDDVSAMKKVGCCSS

SEQ ID NO: 6229 - protein, 216 aa, Fagopyrum esculentum
MGFRADDDYDYLFKVVLIGDSGVGKSNLLSRFTRNEFSLESKSTIGVEFATRSIHVDDKVVKAQIWDTAGQERYRAITSAYYRGAVGALLVYDVTRHVTFENVERWLKELRDHTDSSIVIMLVGNKADLRHLRAVSTEDATAFAEKEQTVLMETSALESLNVENAFTEVLTQIYRVVSKKALEAGDDPGSVPKGQTINVGSKDDVSAVKKAGCCSS

SEQ ID NO: 6230 - protein, 157 aa, Panax ginseng
MAAYRADDDYDYLFKVVLIGDSGVGKSNLLSRFTKNEFSLESKSTIGVEFATRSIRVDDKIVKAQIWDTAGQERYRAITSAYYRGAVGALVVYDVTRHVTFENVERWLKELRDHTDANIVIMLVGNKADLRHLRAVSTEDAKSLLREKHFLYGDIGP

SEQ ID NO: 6231 - protein, 217 aa, Gossypium raimondii
MAAYRADDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRGHTDSNIVIMLVGNKADLRHLRAVSTDDAKAFAERENTFFMETSALESMNVENAFTEVLTQIHHVVSRKALEVGDDPAALPKGRTINVGSKDDVSAVKNAGCCSA

SEQ ID NO: 6232 - protein, 217 aa, Olea europaea
MGAYRADDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDSNIVIMLVGNKADLRHLRAVSTEDAKAFAERENTYFMETSALESMNVENAFTEVLSQIYHVVSRKALEVGDDPAALPKGQTINIGSKDDVSEMKKVGCCSV

SEQ ID NO: 6233 - protein, 217 aa, Citrus sinensis
MAAYRADEDYDYLYKVVLIGDSGVGKSNLLSRFTRNEFSLESKSTIGVEFATRSIRVEDKIVKAQIWDTAGQERYRAITSAYYRGAVGALLVYDVTRHVTFENVERWLKELRGHTDSNIVIMLVGNKADLRHLCAVSTEDAKAFAERENTFFMETSALESMNVENAFTEVLTQIYHVVSRKALDIGGDPAALPKGQTINVGGKDDVSAVKKVGCCNA

SEQ ID NO: 6234 - protein, 217 aa, Arachis hypogaea
MGAYRADDDYDYLFKVVLIGDSGVGKSNLLSRFTKNEFSLESKSTIGVEFATRSIHVDDKIVKAQIWDTAGQERYRAITSAYYRGAVGALLVYDVTRHVTFENVERWLKELRDHTDANIVIMLVGNKADLRHLRAVNTDDAKAFAERESTFFMETSALESLNVDNAFTEVLTQIYRVVSRKTLEIGDDPTALPKGQTINVGGKDDVSAVKKAGCCSS

SEQ ID NO: 6235 - protein, 216 aa, Lippia dulcis
MAGYRADDDYDYLFKLVLIGDSGVGKSNLLSRFARNEFSLESKSTIGVEFATRSIRVDDKIVKAQIWDTAGQERYRAITSAYYRGAVGALLVYDVTRHVTFENVERWLKELRDHTDQNIVIMLVGNKADLRHLRAVSTEDGQSFAEREKTYFMETSALESMNVENAFTEVLTQIYHVVSRKALDIGDDPAALPKGQTINVGKDDVSAVKKVGCCSV

SEQ ID NO: 6236 - protein, 216 aa, Populus trichocarpa
MGAYRADDDYDYLFKLVLIGDSGVGKSNLLSRFTRNEFSLESKSTIGVEFATRSIHVDDKVVKAQIWDTAGQERYRAITSAYYRGAVGALLVYDVTRHVTFENVERWLKELRDHTDSNIVIMLVGNKADLRHLRAVTTEDATAFAERENTFFMETSALESLNVENAFTEVLTQIHRVVSRKALDVGDDPAALPKGQTITVGKDDVSAVKKVGCCSA

SEQ ID NO: 6237 - protein, 214 aa, Silene vulgaris
MGYRADDDYDYLFKVVLIGDSGVGKSNLLSRFTRNEFSLESKSTIGVEFATRSIRVDDKVVKAQIWDTAGQERYRAITSAYYRGAVGALLVYDSTRHVTFENVERWLKELRDHTDSNIVIMLVGNKADLRHLRAVSTEDAQAFAEREQTFFMETSALESMNVENAFTEVLTQIYKVVSRKALEAGDDPAALPKGQTINVKDDVSAVKNVGCCSA

SEQ ID NO: 6238 - protein, 217 aa, Triphysaria pusilla
MGAYRADDDYDYLFKVVLIGDSGVGKSNLLSRFTRNEFSLESKSTIGVEFATRSIRVNEKVVKAQIWDTAGQERYRAITSAYYRGAVGALLVYDVTRHVTFENVERWLKELRDHTDSNIVIMLVGNKADLRHLRAVSTEDATAFAEREKTFFMETSALESMNVENAFTEVLSQIYNVVSRKALEGGDDPAALPKGQTINVGSKDDVSAVKKGGCCSS

SEQ ID NO: 6239 - protein, 217 aa, Tripterygium wilfordii
MAAYRADDDYDYLFKVVLIGDSGVGKSNLLSRFTKNEFSLESKSTIGVEFATRSIRVDDNVVKAQIWDTAGQERYRAITSAYYRGAIGALLVYDVTRHVTFENVERWLKELRDHTDSNIVIMLVGNKADLRHLRAVSTEDAKAFAERESTFFMETSALESLNVENAFTEVLTQIYHVASRKALDIGDDPAALPKGQTINVGTKDDVSAVRKVGCCSV

SEQ ID NO: 6240 - protein, 219 aa, Castanea mollissima
MKWGRYRADDDYDYLFKVVLIGDSGVGKSNLLSRFTKNEFSLESKSTIGVEFATRSIRVDEKVVKAQIWDTAGQERYRAITSAYYRGAVGALLVYDVTRHVTFENVERWLKELRDHTDANIVIMLVGNKADLRHLRAVSTEDAKAFAERENTFFMETSALESLNVENAFTEVLTQIYHVVSRKALEVGDDPAAVPKGETINVGTKDDVSAVKKVGCCST

SEQ ID NO: 6241 - protein, 216 aa, Trifolium pratense
MGAYRADDDYDYLFKVVLIGDSGVGKSNLLSRFTKNEFSLESKSTIGVEFATRSIHVDDKIVKAQIWDTAGQERYRAITSAYYRGAVGALLVYDVTRHVTFENVERWLKELRDHTDANIVIMLVGNKADLRHLRAVSTDDAKAFAERENTFFMETSALESLNVDNSFTEVLTQIYRVVSRKTLEIGDDPAALPKGQTINVGRDDVSAVKKVGCCSA

SEQ ID NO: 6242 - protein, 217 aa, Trifolium pratense
MGAYRADDDYDYLFKVVLIGDSGVGKSNLLSRFTKNEFSLESKSTIGVEFATRSIRVDDKVVKAQIWDTAGQERYRAITSAYYRGAVGALLVYDVTRHVTFENVERWLKELRDHTDANIVVMLVGNKADLRHLRAVSTEDSTAFAERENTFFMETSALESLNVESAFTEVLTQIYRVVSKKALEIGDDPTALPKGQTINVGARDDVSAVKKSGCCAA

SEQ ID NO: 6243 - protein, 217 aa, Vicia sativa
MGAYRADDDYDYLFKVVLIGDSGVGKSNLLSRFTKNEFSLESKSTIGVEFATRSIHVDDKIVKAQIWDTAGQERYRAITSAYYRGAVGALLVYDVTRHVTFENVERWLKELRDHTDANIVIMLVGNKADLRHLRAVSTEDAKAFAERENTFFMETSALESLNVDNSFTEVLTQIYRVVSRKTLEIGDDPAALPKGHTINVGSRDDVSAVKKVGCCSA

SEQ ID NO: 6244 - protein, 217 aa, Solanum tuberosum
  Sequence also found in Organisms: Solanum phureja
MGAYRSDDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDSSIVIMLVGNKADLRHLRAVSTEDAQAFAEKESTFFMETSALESMNVESAFTEVLTQIHRVVSRKALEVGDDPAALPKGQTINVGGKDDVSEVKKAGCCSA

SEQ ID NO: 6245 - protein, 217 aa, Ambrosia trifida
MGGYRADDDYDYLFKVVLIGDSGVGKSNLLSRFTRNEFSLESKSTIGVEFATRSIHVDDKVVKAQIWDTAGQERYRAITSAYYRGAVGALLVYDVTRHVTFENVERWLKELRDHTDSNIVIMLVGNKADLRHLRAVQTEDATSFAEKEHTYFMETSALESLNVENAFTEVLTQIYHIVSRKALDGGDDQATLPKGQTIHVGGKDDVSAVKKAGCCSS

SEQ ID NO: 6246 - protein, 216 aa, Antirrhinum majus
MGAYRADDDYDYLFKVVLIGDSGVGKSNLLSRFTRNEFSLESKSTIGVEFATRSIRVEEKVVKAQIWDTAGQERYRAITSAYYRGAVGALLVYDVTRHVTFENVERWLKELRDHTDSNIVIMLVGNKADLRHLRAVSTEDAKAFAERENTFFMETSALESMNVENAFTEVLAQIHRVVSRKALEAGDDPAAVPKGQTINVGKDDVSEVKKVGCCSA

SEQ ID NO: 6247 - protein, 217 aa, Cicer arietinum
MGAYRADDDYDYLFKVVLIGDSGVGKSNLLSRFTKNEFSLESKSTIGVEFATRSIRVDDKVVKAQIWDTAGQERYRAITSAYYRGAVGALLVYDVTRRVTFENVERWLKELRDHTDANIVVMLVGNKADLRHLRAVSTEDATAFAERENTFFMETSALESLNVESAFTEVLTQIYRVVSKKALEIGDDPAALPKGQTISVGSRDDVSAVKKAGCCSA

SEQ ID NO: 6248 - protein, 217 aa, Gossypium hirsutum
MAAYRADDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRGHTDSNIVIMLVGNKADLRHLRAVSTDDAKAFAERENTFFMETSALESMNVETAFTEVLTQIHHVVSRKALEVGDDPAALPKGRTINVGSKDDVSAVKNAGCCSA

SEQ ID NO: 6249 - protein, 215 aa, Panax ginseng
MAAYRADEDYDYLFKVVLIGDSGVGKSNLLSRFTKNEFSLESKSTIGVEFATRSIRVDDKIVKAQIWDTAGQERYRAITSAYYRGAVGALLVYDVTRHVTFENVERWLKELRDHTDANIVIMLVGNKADLRHLRAVSTEDAKSFAERENTFFMETSALESLNVENSFTEVLSQIYHVVSRKALEIGDDPAALPKGQTINVKDDVSAVKKVGCCSV

SEQ ID NO: 6250 - protein, 217 aa, Panax ginseng
MGAFRADEDYDYLFKVVLIGDSGVGKSNLLSRFSRNEFSLESKSTIGVEFATRSIHVDEKVIKAQIWDTAGQERYRAITSAYYRGAVGALLVYDVTRHVTFENVERWLKELRDHTDANIVIMLVGNKADLRHLRAVPTDDAKAFAERENNFFMETSALESLNVENAFTEVLTQIYHVVSRKALDIGDDPTVLPKGQTINVGGRDDVSAVKKSGCCST

SEQ ID NO: 6251 - protein, 217 aa, Medicago truncatula
MGAYRADDDYDYLFKVVLIGDSGVGKSNLLSRFTKNEFSLESKSTIGVEFATRSIHVDDKIVKAQIWDTAGQERYRAITSAYYRGAVGALLVYDVTRHVTFENVERWLKELRDHTDANIVIMLVGNKADLRHLRAVSTDDAKAFAERENTFFMETSALESLNVDNSFTEVLTQIYRVVSRKTLEIGDDPAALPKGQTINVGSRDDVSAVKKVGCCSA

SEQ ID NO: 6252 - protein, 217 aa, Medicago truncatula
MGAYRADDDYDYLFKVVLIGDSGVGKSNLLSRFTKNEFSLESKSTIGVEFATRSIHVDDKVVKAQIWDTAGQERYRAITSAYYRGAVGALLVYDVTRHVTFENVERWLKELRDHTDANIVVMLVGNKADLRHLRAVSTEDATSFSERENTYFMETSALESLNVESAFTEVLTQIYRVVSKKALEIGDDPAALPKGQTINVGSRDDVSAVKKAGCCSA

SEQ ID NO: 6253 - protein, 217 aa, Quercus alba
MAAYRAEDDYDYLFKVVLIGDSGVGKSNLLSRFTKNEFSLESKSTIGVEFATRSIRVDDNIVKAQIWDTAGQERYRAITSAYYRGAVGALLVYDVTRHITFENVERWLKELRDHTDSNIVIMLVGNKADLRHLRAVSTEDATAFAERENTFFMETSALESMNVENAFTEVLTQIYRVVSRKALDIGDDPAALPIGQTINVGTKDDVSAVKKVGCCSA

SEQ ID NO: 6254 - protein, 217 aa, Olea europaea
MGAYRADDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLRELRDHTDSNIVIMLVGNKADLRHLRAVQTEDAKAFAEKEHAFFMETSALESMNVENAFTEVLTQIHQVVSRKALEASDDPAALPKGQTINVSSKDDVSAVKTGGCCSA

SEQ ID NO: 6255 - protein, 216 aa, Allium cepa
YGGSSDDDYDYLFKVVLIGDSGVGKSNLLSRFTRNEFSLESKSTIGVEFATRSIHVDDKVVKAQIWDTAGQERYRAITSAYYRGAVGALLVYDVTRHITFENIERWLKELRDHTDANIVIMLVGNKADLRHLRAVTTEDAKAFAERENTFFMETSALESLNVENAFTEVLSQIYRVVSRKALDIGDDPAALPKGQTINVGSKDDVSAVKKAGCCSN

SEQ ID NO: 6256 - protein, 217 aa, Cajanus cajan
MGAYRADEDYDYLFKVVLIGDSGVGKSNLLSRFTKNEFSLESKSTIGVEFATRSIRVDDKVVKAQIWDTAGQERYRAITSAYYRGAVGALLVYDVTRHVTFENIERWLKELRDHTDANIVVMLVGNKADLRHLRAVSTEDATTFAEREKTYFMETSALESMNVENAFTEVLTQIYHVVSKKALEIGDDPAALPKGQTINVSSRDDVSAVKKSGCCSN

SEQ ID NO: 6257 - protein, 215 aa, Populus trichocarpa
MSAYRADEDYDYLFKLVLIGDSGVGKSNLLSRFTRNEFNLESKSTIGVEFATRSIRVDDKIVKAQIWDTAGQERYRAITSAYYRGAVGALLVYDVTRHVTFENVERWLKELRDHTDANIVIMFVGNKADLRHLRAVSTEDAKAFAERENTYFMETSALESLNVENAFTEVLTQIYHVVSRKALDIGDDPAALPKGETINVKDDVSAVKKVGCCSV

SEQ ID NO: 6258 - protein, 217 aa, Helianthus annuus
MGAYRADDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDSNIVIMLVGNKADLRHLRAVQSEDATSFAEKEHTYFMETSALESLNVENAFTEVLTQIYHIVSRKALDAGDDQATLPKGQTINVGGKDDVSAVKKAGCCSS

SEQ ID NO: 6259 - protein, 103 aa, Cynodon dactylon
MAYRADDDYDYLFKVVLIGDSGVGKSNLLSRFTRNEFSLESKSTIGVEFATRSIHVDDKVVKAQIWDTAGQERYRAITSAYYRGAVGALVVYDVTRHVTFENF

SEQ ID NO: 6260 - protein, 172 aa, Camellia sinensis
MAAYRADDDYDYLFKVVLIGDSGVGKSNLLSRFTRNESSLESKSTIGVEFATRSIRVDDKIVKAQIWDTAGQERYRAITSAYYRGAVGALLVYDVTRHVTFENVERWLKELRDHTDSNIVIMLVGNKADLRHLRAVSTEDAKAFAERENTFFMETSALESMNVENAFTEALT

SEQ ID NO: 6261 - protein, 212 aa, Panax ginseng
ADDDYDYLFKVVLIGDSGVGESNLLSRFTRNEFSLESKSTIGVEFATRSIHVDDKVVKAQIWDTAGQERYRAITSAYYQGAVGALLVYDVTRHVTFENVERWLKELRDHTDSNIVIMLVGNKADLRHLRAVSTEDAKAFAEKESTFFMETSALESMNVEDAFTEVLTQIYRVVSRKALDIGDDPASLPKGQTINVGSKDNVSAVKNVGCCSA

SEQ ID NO: 6262 - protein, 214 aa, Chenopodium quinoa
MGYRADDDYDYLFKVVLIGDSGVGKSNLLSRFTRNEFSLESKSTIGVEFATRSIRVDDKVVKAQIWDTAGQERYRAITSAYYRGAVGALLVYDSTRHVTFENVERWLKELRDHTDSNIVIMLVGNKADLRHLRAVSTEDAQTFAEKEKTFFMETSALESLNVENAFTEVLTQIYRVVCRKALEAGDDPAAVPKGQTINVKDDVSAVKKVGCCST

SEQ ID NO: 6263 - protein, 218 aa, Triphysaria pusilla
MAGGYRADDDYDYLFKLVLIGDSGVGKSNLLSRFARNEFSLESKSTIGVEFATRSIRVDDKIVKAQIWDTAGQERYRAITSAYYRGAVGALLVYDVTRHVTFENVERWLKELRDHTDQNIVIMLVGNKADLRHLRAVSTEDGQAFAEKEKTYFMETSALESMNVENSFTEVLTQIYHVVCRKALDIGDDPSALPKGQTISVGGKDDVSAVKKVGCCSV

SEQ ID NO: 6264 - protein, 217 aa, Vinca minor
MAGGYRADDDYDYLFKVVLIGDSGVGKSNLLSRFTRNEFSLESKSTIGVEFATRSIRVDDKIVKAQIWDTAGQERYRAITSAYYRGAVGALLVYDVTRHVTFENVERWLKELRDHTDQNIVIMLVGNKADLRHLRAVSTEDAKAFSEKDSLYFMETSALESMNVENAFTEVLTQIHVVVSRKALEVGDDPAALPKGQTINVGKDDVSAVKKVGCCSA

SEQ ID NO: 6265 - protein, 217 aa, Vinca minor
MAGGYRADDDYDYLFKVVIIGDSGVGKSNLLSRFTRNEFSLESKSTIGVEFATRSIRVDDKIVKAQIWDTAGQERYRAITSAYYRGAVGALLVYDVTRHVTFENVERWLKELRDHTDQNIVIMLVGNKADLRHLRAVSTEDAKAFSEKESLYFMETSALESMNVENAFTEVLTQIHHVVSRKALEVGDDPAALPKGQTVNVGKDDVSAVKKVGCCSV

SEQ ID NO: 6266 - protein, 214 aa, Amaranthus tuberculatus
MGYRADDDYDYLFKLVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDSNIVIMLVGNKADLRHLRAVSTEDAQTFAEKEKTYFMETSALESLNVEDAFTEVLTQIYRFVSKKALEAGDDPAAVPKGQTINVKDDVSAVKKVGCCST

SEQ ID NO: 6267 - protein, 216 aa, Musa acuminata
MAYRADDDYDYLFKVVLIGDSGVGKSNLLSRFTRDEFSLESKSTIGVEFATRSIRVEDKVIKAQIWDTAGQERYRAITSAYYRGAVGALVVYDITRHVTFENIERWLKELRDHTDSNIVIMLVGNKADLRHLRAVNTEDAKDFSEKENAFFMETSALESMNVENAFTEVLTQIYRVVSRKSLEAGDDPADLPKGQTINVGTKDDVSAVKKAGCCSS

SEQ ID NO: 6268 - protein, 217 aa, Cichorium intybus
MAAYRADDDYDYLFKVVLIGDSGVGKSNLLSRFTRNEFSLESKSTIGVEFATRSIRVDDKIIKAQIWDTAGQERYRAITSAYYRGAVGALVVYDTTRHVTFENVERWLKELRDHSDSNIVIMLVGNKADLRHLRAVSTEDAKTFAEKENTYFMETSALEATNVEDSFTEVLTQIYHVVSRKALDIGNDPGALPKGQTINVGSKDDVSAVKKVGCCSS

SEQ ID NO: 6269 - protein, 217 aa, Trifolium pratense
MGAYRADDDYDYLFKVVLIGDSGVGKSNLLSRFTKNEFSLESKSTIGVEFATRSIKVDDKVVKAQIWDTAGQERYRAITSAYYRGAVGALLVYDVTRHVTFENVARWLKELRDHTDAHIVVMLVGNKADLRHLRAVSTEDATSFAENENTFFMETSALESLNVESAFTEVLTQIYRVVSKKALEIGDDPAALPKGQTIDVGSRDDVSAVKKSGCCSA

SEQ ID NO: 6270 - protein, 217 aa, Trifolium pratense
MGAYRADDDYDYLFKVVLIGDSGVGKSNLLSRFTKNEFSLESKSTIGVEFATRSIKVDDKVVKAQIWDTAGQERYRAITSAYYRGAVGALLVYDVTRHVTFENVARWLKELRDHTDAHIVVMLVGNKADLRHLRAVSTEDATSFAEGENTFFMETSALESLNVESAFTEVLTQIYRVVSKKALEIGDDPAALPKGQTIDVGSRDDVSAVKKSGCCSA

SEQ ID NO: 6271 - protein, 215 aa, Petroselinum crispum
MGAYRADDDYDYLFKIVLIGDSGVGKSNLLSRFTRNEFSLESKSTIGVEFATRSIHVDDKVVKAQIWDTAGQERYRAITSAYYRGAVGALLVYDVTRNVTFENVERWLKELRDHTDSNIVIMLVGNKADLRHLRAVATEDATAFAEKESTFFMETSALESMNVEDAFTEVLAQIHQVVSRKALESGNDPAAVPKGQTINVKDDVSAVKKSGCCSS

SEQ ID NO: 6272 - protein, 217 aa, Populus trichocarpa
MGAYRADDDYDYLFKVVLIGDSGVGKSNLLSRFTRNEFSLESKSTIGVEFATRSIRVDDKIVKAQIWDTAGQERYRAITSAYYRGAVGALLVYDVTRHVTFENVERWLKELRDHTDANNVIMLVGNKADLRHLRAVATEDAKGFAERESTFFMETSALESMNVENAFTEVLTQIYRVVSRKALDVGDDSTYLPKGQTINVGSRDDVSAVKKAGCCSS

SEQ ID NO: 6273 - protein, 217 aa, Abies balsamea
MAYRADDDYDYLFKVVLIGDSGVGKSNLLSRFTRNEFSLESKSTIGVEFATRSITVDDKVIKAQIWDTAGQERYRAITSAYYRGAVGALLVYDVTRHVTFENVERWLKELRDHTDANIVIMLVGNKADLRHLRAVSTEDGKAFAERENTYFMETSALESTNVENAFTEVLSQIYRIVSKKALDVGEDPAAVPSKGQTIHVGNKDDVTAMKKVGCCSV

SEQ ID NO: 6274 - protein, 217 aa, Arabidopsis lyrata
MAAYRADDDYDFLYKVVLIGDSGVGKSNLLSRFTRNEFSLESKSTIGVEFATRSIHVDEKIVKAQIWDTAGQERYRAITSAYYRGAVGALLVYDVTRHVTFENVERWLKELRDHTEANIVIMLVGNKADLRHLRAVSTEDAKAFAERENTFFMETSALEALNVENAFTEVLSQIYRVASKKALDIGDDPATLPKGQSINVGSKDDVSEVKKVGCCSS

SEQ ID NO: 6275 - protein, 217 aa, Artemisia annua
MGAYRADDDYDYLFKVVLIGDSGVGKSNLLSRFTRNEFSLESKSTIGVEFATRSIKVDDKVVKAQIWDTAGQERYRAITSAYYRGAVGALLVYDVTRHVTFENVERWLKELRDHTDSNIVIMLVGNKSDLRHLRAVTTEDAKAFAEKENTYFMETSALESSNVENAFTEVLTQIHQVVSRKALDVGEDPGALPKGQTINVGNKDDVSALKKAGCCST

SEQ ID NO: 6276 - protein, 217 aa, Phaseolus vulgaris
MGAYRADDDYDYLFKVVLIGDSGVGKSNLLSRFTKNEFSLESKSTIGVEFATRSIHVDDKIVKAQIWDTAGQERYRAITSAYYRGAVGALLVYDVTRHVTFENVERWLKELRDHTDANIVIMLVGNKADLRHLRAVATDDAKAFAERENTFYMETSALESLNVDNAFTEVLTQIYRVVSRKTLEIGDDPAALPKGQTINVGSRDDVSAVKKAGCCSA

SEQ ID NO: 6277 - protein, 217 aa, Gossypium hirsutum
MGAYRADDDYDYLFKVVLIGDSGVGKSNLLSRFTKNEFSLESKSTIGVEFATRSIRVDDKVVKAQIWDTAGQERYRAITSAYYRGAVGALLVYDVTRHVTFENVERWLKELRGHTDANIVIMLVGNKADLRHLRAVSTDDAKAFAERENTFFMETSALESLNVGSAFTEVLAQIYRVVSKKALDVGDDPSALPKGQTINVGSKDDVSAVKGAGCCSA

SEQ ID NO: 6278 - protein, 217 aa, Gossypium hirsutum
MAAYRADDDYDFLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRGHTDSNIVIMLVGNKADLRHLRAVSTDDAKAFAERENTFFMETSALESMNVENAFTEVVTQIHHVVSRKALEVGDDPAALPKGRTINVGSKDDVSAVKNAGCCSA

SEQ ID NO: 6279 - protein, 217 aa, Gossypium hirsutum
  Sequence also found in Organisms: Gossypium raimondii
MGAYRADDDYDYLFKVVLIGDSGVGKSNLLSRFTKNEFSLESKSTIGVEFATRSIRVDDKVVKAQIWDTAGQERYRAITSAYYRGAVGALLVYDVTRHVTFENVERWLKELRGHTDANIVIMLVGNKADLRHLRAVSIDDAKAFAERENTFFMETSALESLNVESAFTEVLAQIYRVVSKKALDVGDDPSALPKGQTINVGSKDDVSAVKGAGCCSA

SEQ ID NO: 6280 - protein, 217 aa, Euonymus alatus
MAAYRADDDYDYLFKVVIIGDSGVGKSNLLSRFTKNEFSLESKSTIGVEFATRSIRVDDNVVKAQIWDTAGQERYRAITSAYYRGAVGALLVYDVTRHVTFENAERWLKELRDHTDSNIVIMLVGNKADLRHLRAVSTEDAKAFAERESTFFMETSALESLNVENAFTEALTQIYHVVSRKALDIGDDPAALPKGQNINVGTKDDVSAIKKVGCCSA

SEQ ID NO: 6281 - protein, 215 aa, Panax ginseng
MAAYRADEDYDYLFKVVLIGDSGVGKSNLLSRFTKNEFSLESKSTIGVEFATRSIRVDDKIVKAQIWDTAGQERYRAITSAYYRGAVGALLVYDVTRHVTFENVERWLKELRDHTDANIVIMLVGNKADLRHLRSVSTEDAKSFAERENTFFMETSALESLNVENSFTEVLSQIYHVVSRKALEIGDDPAALPKGQTINVKDDVSAVKKVGCCSV

SEQ ID NO: 6282 - protein, 217 aa, Panax ginseng
MGAYRADEDYDYLFKVVLIGDSGVGKSNLLSRFTRNEFSLESKSTIGVEFATRSIHVDDKVVKAQIWDTAGQERYRAITSAYYRGAVGALLVYDVTRHVTFENVERWLKELRDHTDSNIVIMLVGNKADLRHLRAVPTDDAKAFAQRENNFFMETSALESLNVENAFTEVLTQIYRVVSRKALDIGDDPTVLPKGQTINVGGRDDVSAVTKGGCCST

SEQ ID NO: 6283 - protein, 215 aa, Panax ginseng
MASYRADEDYDYLFKVVLIGDSGVGKSNLLSRFTKNEFSLESKSTIGVEFATRSIRVDDKIVKAQIWDTAGQERYRAITSAYYRGAVGALLVYDVTRHVTFENVERWLKELRDHTDANIVIMLVGNKADLRHLRSVSTEDAKSCAERENTFFMETSALESLNVENSFTEVLSQIYHVVSRKALEIGDDPAALPKGQTINVKDDVSAVKKVGCCSV

SEQ ID NO: 6284 - protein, 217 aa, Tropaeolum majus
MAAYRTDDDYDYLFKVVLIGDSGVGKSNLLSRFTKNEFSLESKSTIGVEFATRSIRVDDKVVKAQIWDTAGQERYRAITSAYYRGAVGALLVYDVTRHVTFENVERWLKELRDHTDSNIAIMLVGNKADLRHLRAVSTEDAKAFAEREKTFFMETSALESLNVEDAFTEVLTQIYGVVSRKALDVGDDPAALPRGQTINVGSKDDVSAVKKGGCCSA

SEQ ID NO: 6285 - protein, 217 aa, Olea europaea
MGAYRADDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLRELRDHTDSNIVIMLVGNKADLRHLRAVQTEDAKAFAERENAFFMETSALESMNVENAFTEVLAQIHQVVSRKALEASDDPAALPKGQTINVSSKDDVSAVKTGGCCSA

SEQ ID NO: 6286 - protein, 217 aa, Arachis hypogaea
MGAYRADDDYDYLFKVVLIGDSGVGKSNLLSRFTRNEFSLESKSTIGVEFATRSIKVDDKVVKAQIWDTAGQERYRAITSAYYRGAVGALLVYDVTRHVTFENVARWLKELRDHTDANIVVMLVGNKADLRHLRAVSVEDATAFAERESTFFMETSALESMNVENAFTEVLTQIHSVVSKKALEVGNDPAALPKGQTINVGSRDDVSAVKKGGCCSN

SEQ ID NO: 6287 - protein, 217 aa, Pisum sativum
MGAYRADDDYDYLFKVVLIGDSGVGKSNLLSRFTKNEFSLESKSTIGVEFATRSIRVDDKVVKAQIWDTAGQERYRAITSAYYRGAVGALLVYDVTRHVTFENVERWLKELRDHTDANIVVMLVGNKADLRHLRAVSTEDSTSFAEREHTFFMETSALESLNVESAFTEVLTQIYRVVSKKALEIGDDPAALPKGQTINVGSRDDVSAVKKGGCCSA

SEQ ID NO: 6288 - protein, 217 aa, Glycine max
MGAYRADEDYDYLFKVVLIGDSGVGKSNLLSRFTKNEFSLESKSTIGVEFATRSIRVDEKVLKAQIWDTAGQERYRAITSAYYRGAVGALLVYDVTRHVTFENMERWLKELRDHTDANIVVMLVGNKADLRHLRAVSTEEATAFAEREKTFFMETSALESMNVENAFTEVLTQIYHVVSKKALEIGDDPAALPKGQTINVGSRDDVSAVKKDGCCSA

SEQ ID NO: 6289 - protein, 217 aa, Solanum lycopersicum
MGAYRSDDDYDYLFKVVLIGDSGVGKSNLLSRFTRSEFSLESKSTIGVEFATRSIRVDDKVVKAQIWDTAGQERYRAITSAYYRGAVGALLVYDVTRHVTFENVERWLKELRDHTDSSIVIMLVGNKADLRHLRAVSTEDAQAFAEKESTFFMETSALESMNVESAFTEVLTQIHRVVSRKALEVGDDPAAVPKGQTINVGGKDDVSEVKKAGCCSA

SEQ ID NO: 6290 - protein, 216 aa, Triphysaria pusilla
GAYRADDDYDYLFKVVLIGDSGVGKSNLLSRFTRNEFSLESKSTIGVEFATRSIRVNEKVVKAQIWDTAGQERYRAITSAYYRGAVGALLVYDVTRHVTFENVERWLKELRDHTDSNIVIMLIGNKADLRHLRAVSTEDATAFAEREKTFFMETSALESLNVENAFTEVLSQIYNVVSRKALEGADDPAALPKGQTINVGSKDDVSAVKKGGCCSS

SEQ ID NO: 6291 - protein, 224 aa, Eschscholzia californica
FIYNLIKVGAYRGDDDYDYLFKVVLIGDSGVGKSNLLSRFTRNEFSLESKSTIGVEFATRSIHVDDKVVKAQIWDTAGQERYRAITSAYYRGAVGALLVYDVTRHVTFENVERWLKELRDHTDANIVIMLVGNKADLRHLRAVSVEDAKAFAERENNFFMETSALESMNVENAFTEVLSQIYRVVSRKALDIGDDPAALPKGQTINVGSRDDVSAVKKAGCCSS

SEQ ID NO: 6292 - protein, 219 aa, Ipomoea nil
MAGGYSRADDDYDYLCKVVLIGDSGVGKSNLLSRFTRNEFNLESKSTIGVEFATRSIRVDDKVVKAQIWDTAGQERYRAITSAYYRGAVGALLVYDVTRHVTFENVARWLKELRDHTDQNIVIMLVGNKADLRHLRAVSTEDATAFAERESTFFMETSALESLNVENAFTEVLTQIYHVISRKALEVGDDPAALPKGQTISVGGKDDVSAVKKVNCCSV

SEQ ID NO: 6293 - protein, 95 aa, Cajanus cajan
MGAYRADEDYDYLFKVVLIGDSGVGKSNLLSRFTKNEFSLESKSTIGVEFATRSIRVDDKVVKAQIWDTAGQERSTFPSNHQCILSRSCWCFISL

SEQ ID NO: 6294 - protein, 217 aa, Chrysanthemum coronarium
MGAYRADDDYDYLFKVVLIGDSGVGKSNLLSRFTRNEFSLESKSTIGVEFATRSIKVDDKVVKAQIWDTAGQERYRAITSAYYRGAVGALLVYDVTRHVTFENVERWLKELRDHTDSNIVIMLVGNKSDLRHLRAVTTEDAKTFAEKENTYFMETSALESLNVENAFTEVLTQIHQVVSRKALDVGEDPGALPKGQTINVGNKDDVSALKKAGCCST

SEQ ID NO: 6295 - protein, 217 aa, Cichorium intybus
MGGYRADDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDSNIVIMLVGNKADLRHLRAVQSEDATSFAEKEHTYFMETSALESLNVEDAFTEVLTQIYHIVSRKALEAGDDAAALPKGQTINVGGKDDVSAVKKGGCCSS

SEQ ID NO: 6296 - protein, 217 aa, Cichorium intybus
MAAYRADDDYDYLFKVVLIGDSGVGKSNLLSRFTRNEFSLESKSTIGVEFATRSIRVDDKIIKAQIWDTAGQERYRAITSAYYRGAVGALVVYDTTRHVTFENVERWLKELRDHSDSNIVIMLVGNKADLRHLRAISTEDAKTFAEKENTYFMETSALEATNVEDSFTEVLTQIYHVVSRKALDIGNDPGALPKGQTINVGSKDDVSAVKKVGCCSS

SEQ ID NO: 6297 - protein, 217 aa, Cicer arietinum
MGAYRADDDYDYLFKVVLIGDSGVGKSNLLSRFTKNEFSLESKSTIGVEFATRSIHVDDKIIKAQIWDTAGQERYRAITSAYYRGAVGALLVYDVTRHVTFENMERWLKELRDHTDANIVIMLVGNKADLRHLRAVSTDDAKAFAERENTFFMETSALESLNVDNSFTEVLTQIYRVVSRKTLEIGDDPAALPKGQTINVGSRDDVSAVKKVGCCSA

SEQ ID NO: 6298 - protein, 217 aa, Vigna unguiculata
MGAYRADDDYDYLFKVVLIGDSGVGKSNLLTRFTRNEFSLESKSTIGVEFATRSIRVDDKVVKAQIWDTAGQERYRAITSAYYRGAVGALLVYDVTRHVTFENVERWLKELRDHTDANIVVMLVGNKADLRHLRAVSTEDATSFAQRERTFFMETSALESLNVESAFTEVLTQIYHVVSKKALEIGDDPAALPKGQTISVGSRDDVSAVKQGGCCSA

SEQ ID NO: 6299 - protein, 217 aa, Euonymus alatus
MAAYRADDDYDYLFKVVIIGDSGVGKSNLLSRFTKNEFSLESKSTIGVEFATRSIRVDDNVVKAQIWDTAGQERYRAITGAYYRGAVGALLVYDVTRHVTFENAERWLKELRDHTDSNIVIMLVGNKADLRHLRAVSTEDAKAFAERESTFFMETSALESLNVENAFTEALTQIYHVVSRKALDIGDDPAALPKGQNINVGTKDDVSAIKKVGCCSA

SEQ ID NO: 6300 - protein, 217 aa, Lactuca sativa
MAAYRADDDYDYLFKVVLIGDSGVGKSNLLSRFTRNEFSLESKSTIGVEFATRSIRVDEKIIKAQIWDTAGQERYRAITSAYYRGAVGALIVYDTTRHVTFENVERWLKELRDHSDSNIVIMLVGNKADLRHLRAVSTEDAKTFAEKENTYFMETSALEAMNVEDSFTEVLTQIYHVVSRKALDIGNDPGALPKGQTINVGSKDDVSAVKKVGCCSS

SEQ ID NO: 6301 - protein, 217 aa, Lupinus angustifolius
MGPYRADDDYDYLFKVVLIGDSGVGKSNLLSRFTKNEFSLESKSTIGVEFATRSIQVDDKIVKAQIWDTAGQERYRAITSAYYRGAVGALLVYDVTRHVTFENVERWLKELRDHTDTNIVIMLVGNKADLRHLRAVATDDARAFAERENTFFMETSALESLNVDNAFTEVLTQIYHVVCRKTLEIGDDPAALPKGQTINVGGRDDVSAVKKAGCCSA

SEQ ID NO: 6302 - protein, 217 aa, Pinus pinaster
  Sequence also found in Organisms: Pinus taeda
MAYRADDDYDYLFKVVLIGDSGVGKSNLLSRFTRNEFSLESKSTIGVEFATRSITVDDKVIKAQIWDTAGQERYRAITSAYYRGAVGALLVYDVTRHVTFENVERWLKELRDHTDANIVIMLVGNKADLRHLRAVSIEDGKAFAERENTYFMETSALESTNVENAFTEVLSQIYRIVSKKALDVGEDPAAVPSKGQTIHVGNKDDVTAMKKVGCCSL

SEQ ID NO: 6303 - protein, 217 aa, Olea europaea
MGAYRADDDYDYLFKVVLIGDSGVGKSNLLSRFTRNEFSLESKSTIGVEFATRSIRVEDKVVKAQIWDTAGQERYRAITSAYYRGAVGALLVYDVTRHVTFENVERWLKELRDHTDSNIVVMLVGNKADLRHLRAVSTEDATAFAERESTYFMETSALESMNVENSFTEVLTQIYRFVSRKALEVGDDPAALPKGQTINVGSKDDVSAVKKVGCCSV

SEQ ID NO: 6304 - protein, 217 aa, Picea glauca
MAYRADDDYDYLFKVVLIGDSGVGKSNLLSRFTRNEFSLESKSTIGVEFATRSITVDDKVIKAQIWDTAGQERYRAITSAYYRGAVGALLVYDVTRHVTFENVERWLKELRDHTDANIVIMLVGNKADLRHLRAVSIEDGKAFAERENTYFMETSALESTNVENAFTEVLSQIYRIVSKKALDVGEDPAAVPSKGQTIHVGNKDDVTAMKKVGCCSV

SEQ ID NO: 6305 - protein, 217 aa, Eutrema parvulum
MAAYRADDDYDFLYKVVLIGDSGVGKSNLLSRFTRNEFSLESKSTIGVEFATRSIQVDEKIVKAQIWDTAGQERYRAITSAYYRGAVGALLVYDVTRHVTFENVERWLKELRDHTDANIVIMLVGNKADLRHLRAVSTEDAKAFAERENTFFMETSALEALNVENAFTEVLSQIYRVARKKALDIGDDPATLPKGQSINVGSKDDVSEVKKVGCCSS

SEQ ID NO: 6306 - protein, 217 aa, Trigonella foenum-graecum
MGAYRAEDDYDYLFKVVLIGDSGVGKSNLLSRFTKNEFSLESKSTIGVEFATRSIRVDDKVVKAQIWDTAGQERYRAITSAYYRGAVGALLVYDVTRHVTFENVERWLKELRDHTDANIVVMLVGNKADLRHLRAVSTEDATSFSERENTYFMETSALESLNVESAFTEVLTQIYRVVSKKALEIGDDPAALPKGQTINVGSRDDVSAVKKAGCCSA

SEQ ID NO: 6307 - protein, 218 aa, Triphysaria pusilla
MAGGYRADDDYDYLFKLVLIGDSGVGKSNLLSRFARNEFSLESKSTIGVEFATRSIRVDDKIVKAQIWDTAGQERYRAITSAYYRGAVGALLVYDVTRHITFENVERWLKELRDHTDQNIVIMLVGNKADLRHLRAVSTEDGQAFAEKEKTYFMETSALESMNVENSFTEVLTQIYHVVCRKALDIGDDPSALPKGQTINVGGKDDVSSVKKVGCCSI

SEQ ID NO: 6308 - protein, 98 aa, Cucurbita pepo
MAAYRTDDDYDYLFKVVLIGDSGVGKSNLLSRFTRNEFSLESKSTIGVEFATRSIRVDDKIVKAQIWDTAGQEDTVQSQVHTIEEQLVHCLFMMSHDT

SEQ ID NO: 6309 - protein, 216 aa, Musa acuminata
MAYRADDDYDYLFKVVLIGDSGVGKSNLLSRFTRDEFSLESKSTIGVEFATRSIRVEDKVIKAQIWDTAGQERYRAITSAYYRGAVGALVVYDITRHVTFENIERWLKELRDHTDSNIVIMLVGNKADLRHLRAINTEDAKEFSEKENAFFMETSALESMNVENAFTEVLTQIYRVVSRKSLEAGDDPADLPKGQTINVGTKDDVSAVKKAGCCSS

SEQ ID NO: 6310 - protein, 216 aa, Lippia dulcis
MAGGYRADDDYDYLFKLVLIGDSGVGKSNLLSRFTRNEFNLESKSTIGVEFATRSIRVDDKIIKAQIWDTAGQERYRAITSAYYRGAVGALLVYDVTRHITFENVERWLKELRDHTDQNIVIMLVGNKADLRHLRAVSTEDATAFAEKENTYFMETSALESLNVENAFTEALTQIYHVVSRKALDIGDDPSALPKGQTINIGDDVSAVKKVGCCSV

SEQ ID NO: 6311 - protein, 217 aa, Chrysanthemum coronarium
MGAYRADDDYDYLFKVVLIGDSGVGKSNLLSRFTRNEFSLESKSTIGVEFATRSIKVDDKVVKAQIWDTAGQERYRAITSAYYRGAVGALLVYDVTRHVTFENVERWLKELRDHTDSNIVIMLVGNKSDLRHLRAVTTEDAKTFAEKESTYFMETSALESLNVENAFTEVLTQIHQVVSRKALDVGEDPGALPKGQTINVGNKDDVSALKKAGCCST

SEQ ID NO: 6312 - protein, 216 aa, Ananas comosus
MGYRADDDYDYLFKVVLIGDSGVGKSNLLSRFTRNEFSLESKSTIGVEFATRTVRVDDKVIKAQIWDTAGQERYRAITSAYYRGAVGALLVYDVTRHVTFENVERWLKELRDHTDSSMVIMLVGNKADLRHLRAVSTEDAQGFAERENTFFMETSALESLNVEGAFTEVLTQIYRVTSKRALDVGDDPAALPKGQTINVGSKDDVSAVKKVGCCSA

SEQ ID NO: 6313 - protein, 215 aa, Amorphophallus konjac
MAYRSEDDYDYLFKVVLIGDSGVGKSNLLSRFTRNEFSLESKSTIGVEFATRSIHVDDKVIKAQIWDTAGQERYRAITSAYYRGAVGALLVYDVTRHVTFENVERWLKELRDHTDSNIVIMLVGNKADLRHLRAVSTEDAQAFAEKESAFFMETSALESTNVENAFTEVLTQIYRVVCRKALETAGDDPAEVPKGQTINMKDDVSAVKKVGCCSV

SEQ ID NO: 6314 - protein, 217 aa, Arabidopsis thaliana
MAAYRADDDYDFLYKVVLIGDSGVGKSNLLSRFTRNEFSLESKSTIGVEFATRSIHVDEKIVKAQIWDTAGQERYRAITSAYYRGAVGALLVYDVTRHVTFENVERWLKELRDHTEANIVIMLVGNKADLRHLRAVSTEDAKAFAERENTFFMETSALEALNVENAFTEVLSQIYRVASKKALDIGDDHTTLPKGQSINVGSKDDVSEVKKVGCCSS

SEQ ID NO: 6315 - protein, 214 aa, Cirsium arvense
MGAYRADDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDSNIVIMLVGNKADLRHLRAVQTDDATSFAEKEHTYFMETSALESLNVENAFTEVLTQIYHIVSRKALESGDDQAALPKGQTINVDDVSAVKKGGCCSS

SEQ ID NO: 6316 - protein, 209 aa, Cleome spinosa
MAAYRADDDYDYLFKVVLIGDSGVGKSNLLSRFTHNEFSLESKSTIGVEFATRSIRVDDKIVKAQIWDTAGQERYRAITSAYYRGAVGALLVYDVTRHVTFENVERWLKELRDHTDANIVIMLVGNKADLRHLRAVSTEDAKAFAERENTFFMETSALESMNAENSFTEVLSQIYRVVSRKALDIGEDPAALPKGQTINVGSKDDVSAV

SEQ ID NO: 6317 - protein, 216 aa, Gossypium hirsutum
  Sequence also found in Organisms: Gossypium raimondii
MAAYRADDDYDYLFKLVLIGDSGVGKSNLLSRFTKNEFNLESKSTIGVEFATRSIRVDDKVVKAQIWDTAGQERYRAITSAYYRGAVGALLVYDVTRHITFENVERWLKELRDHTDSNIVIMLVGNKADLRHLRAVSTEEAKAFAEREKTYFMETSALESLNVENAFTEVLTQIYHVVSRKALEVGDDPAALPKGQTINVGKDDVSALKKIGCCSA

SEQ ID NO: 6318 - protein, 217 aa, Cryptomeria japonica
MAYRADDDYDYLFKVVLIGDSGVGKSNLLSRFTRNEFSLESKSTIGVEFATRSITVDDKVIKAQIWDTAGQERYRAITSAYYRGAVGALLVYDVTRHVTFENVERWLKELRDHTDANIVIMLVGNKADLRHLRAVSAEDAKAFAEREFTYFMETSALESTNVENAFTEVLSQIYRIVSKKALDVGEDQAAVPSKGQTINVNNKEDVSALKKVGCCSA

SEQ ID NO: 6319 - protein, 217 aa, Taraxacum officinale
MGAYRTDDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDANIVIMLVGNKADLRHLRAVQSEDATSFAEKEHTYFMETSALESLNVEDAFTEVLTQIYHIVSRKALEAGDDAATLPKGQTISVGGKDDVSAVKKGGCCSS

SEQ ID NO: 6320 - protein, 216 aa, Distylium racemosum
MAYRADDDYDYLFKVVLIGDSGVGKSNLLSRFTRNEFSLESKSTIGVEFATRSITVDDKVIKAQIWDTAGQERYRAITSAYYRGAVGALLVYDVTRHVTFENVERWLKELRDHTDANIVIMLVGNKADLRHLRAVSTEDGKAFAERESTYFMETSALESTNVEAAFTEVLSQIYRIVSKKALDVGEDPAAVPSKGQTINVNKEDVSALKKVGCCSG

SEQ ID NO: 6321 - protein, 217 aa, Flaveria ramosissima
MGAYRADDDYDYLFKVVLIGDSGVGKSNLLSRFTRNEFSLESKSTIGVEFATRSIRVDDKVIKAQIWDTAGQERYRAITSAYYRGAVGALLVYDVTRNVTFENVQRWLKELRDHTDSNIVIMLVGNKADLRHLRAVQTEDATSFAEKEHTYFMETSALESLNVESAFTEVLTQIYHIVSRKALDGGDDQAALPKGQTINVGGKDDVSAVKNAGCCSS

SEQ ID NO: 6322 - protein, 217 aa, Gossypium raimondii
MGAYRADDDYDYLFKVVLIGDSGVGKSNLLSRFTKNEFSAESKSTIGVEFATRSFHVDDKVVKAQIWDTAGQERYRAITSAYYRGAVGALLVYDVTRRVTFENVQRWLKELRDHTDPNIVIMLVGNKADLRHLRAVAAEDAKAFAERENTFFMETSALESLNVENAFTEVLAQIYRVVSRKALDIGDDPAALPKGRTINVGSKDDVSAVKGAGCCSA

SEQ ID NO: 6323 - protein, 217 aa, Lupinus angustifolius
MGAYRADDDYDYLFKVVLIGDSGVGKTNLLSRFTKNEFSLETKSTIGVEFATRSIHVDDKIVKAQIWDTAGQERYRAITSAYYRGAVGALVVYDVTRHITFENVERWLKELRDHTDANIVIMLVGNKADLRHLRAVSTDDAKVFAEREKTFFMETSALESLNVDNSFTEVLTQIYNVVSRKTLEIGDDPAALPKGQTINVGGPDDVSAVKKVGCCSA

SEQ ID NO: 6324 - protein, 216 aa, Phalaenopsis aphrodite
MGYRAEDDYDYLFKVVLIGDSGVGKSNLLSRFTRNDFSLESKSTIGVEFATRSIHVEDKIVKAQIWDTAGQERYRAITSAYYRGAVGALLVYDITRHITFENVERWLKELRDHTEANIVIMLVGNKADLRHLRAVPTDEAKAFAENQNTFFMETSALESLNVENAFTEVLTQIYHVVSRKTLDVGDDPAALPKGQTINVGNKDDVSAVKKVGCCSA

SEQ ID NO: 6325 - protein, 217 aa, Pseudotsuga menziesii
MAYRADDDYDYLFKVVLIGDSGVGKSNLLSRFTRNEFSLESKSTIGVEFATRSITVDDKVIKAQIWDTAGQERYRAITSAYYRGAVGALLVYDVTRHVTFENVERWLKELRDHTDANIVIMLVGNKADLRHLRAVSIEDGKAFAERENTYYMETSALESTNVENAFTEVLSQIYRIVSKKALDVGEDPAAVPSKGQTIHVGNKDDVTAMKKVGCCSV

SEQ ID NO: 6326 - protein, 217 aa, Sequoia sempervirens
MAYRADDDYDYLFKVVLIGDSGVGKSNLLSRFTRNEFSLESKSTIGVEFATRSITVDDKVIKAQIWDTAGQERYRAITSAYYRGAVGALLVYDVTRHVTFENVERWLKELRDHTDANIVIMLVGNKADLRHLRAVSAEDAKAFAERESTYFMETSALESTNVENAFTEVLSQIYRIVSKKALDVGEDQAAVPSKGQTINVNNKEDVSALKKVGCCSA

SEQ ID NO: 6327 - protein, 217 aa, Silene vulgaris
MAAYRADDDYDYLFKVVLIGDSGVGKSNLLSRFTRNEFSLESKSTIGVEFATRSIRVDDKIVKAQIWDTAGQERYRAITSAYYRGAVGALVVYDVTRHVTFENVQRWLKELRDHTDANIVIMLVGNKADLRHLRAVAVEDTKGFAERESTYFMETSALESLNVESAFTEVLSQIYHVMSRKALDIGDDPAALPKGQTINIGSKDDVSAVRKSGCCSN

SEQ ID NO: 6328 - protein, 217 aa, Utricularia gibba
MGAYRADDDYDYLFKVVLIGDSGVGKSNLLSRFTRNEFSLESKSTIGVEFATRSIRVDEKVVKAQIWDTAGQERYRAITSAYYRGAVGALLVYDVTRHVTFENVERWLKELRDHTDSNIVIMLVGNKADLRHLRAVSTEDATAFAEREKTFFMETSALESMNVENAFTEVLTQIHQIVSKKALEASDDPTSLPKGQTINVGSKDDVSALKKAGCCST

SEQ ID NO: 6329 - protein, 214 aa, Avena sativa
MAYRAEDDYDYLFKVVLIGDSGVGKSNLLTRFTRNEFSLESKSTIGVEFATRSIHVDDKVVKAQIWDTAGQERYRAITSAYYRGAVGALVVYDVTRHVTFENVERWLRELKGPHGRQHRDHARGEQGGPAHLRAGHRRRTPRRRREGEHIFMETSALEAMNVEDAFTEVLSQIYRVVSKKALDIGDDPAAPPKGKTINVKDDVSALKKSSCCSS

SEQ ID NO: 6330 - protein, 163 aa, Panax ginseng
MAAYRADDDYDYLFKVVLIGDSGVGKSNLLSRFTKNEFSLESKSTIGVEFATRSIRVDDKIVKAQIWDTAGQERYRAITSAYYRGAVGALVVYDVTRHVTFENVERWLKELRDHTDANIVIMLVGNKADLRHLRAVATDDAKAFAERESTFLWRHSSPRVVEC

SEQ ID NO: 6331 - protein, 77 aa, Allium cepa
MQKHLLREKALLYETSALESMNVENAFTEVLTQIYRVVSRKALEVGNDAAALPKGQTINVGSKDDVSAVKKGGCCST

SEQ ID NO: 6332 - protein, 93 aa, Sarracenia psittacina
MAAYRADDDYDYLFKVVLIGDSGVGKSNLLSRFTRNEFSLESKSTIGVEFATRSIRVDDKIVKAQRLEDCWPREIPCNHECILPWSCWCIARL

SEQ ID NO: 6333 - protein, 97 aa, Taxus baccata
MLVGNKADLRHLRAVSTEDSKAFAERESTYFMETSALESTNVENAFTEVLSQIYRIVSKKALDIGEDPAAVPSKGQTINVNNKEDVSALKKVGCCSV

SEQ ID NO: 6334 - protein, 217 aa, Petroselinum crispum
MGAYRAEEDYDYLFKVVLIGDSGVGKSNLLSRFTRNEFSLESKSTIGVEFATRSIHVDDKVVKAQIWDTAGQERYRAITSAYYRGAVGALLVYDVTRNVTFENVERWMKELRDHTDSNIVIMLVGNKADLRHLRAVKTDDAKAFAERESNFFMETSALESLNVEDAFTEVLTQIYRVVSRKALDMAEDPTVLPKGQTINVGGKDDVSAIKKAGCCSS

SEQ ID NO: 6335 - protein, 217 aa, Cephalotaxus harringtonia
MAYRADDDYDYLFKVVLIGDSGVGKSNLLSRFTRNEFSLESKSTIGVEFATRSITVDDKVIKAQIWDTAGQERYRAITSAYYRGAVGALLVYDVTRHVTFENVERWLKELRDHTDANIVIMLVGNKADLRHLRAVSTEDGKGFAEREFTYFMETSALESTNVENAFTEVLSQIYRIVSKKALDVGEDSAAVPSKGQTINVNNKEDVSALKKAGCCSA

SEQ ID NO: 6336 - protein, 217 aa, Cirsium arvense
MAAYRADDDYDYLFKVVLIGDSGVGKSNLLSRFTRNEFSLESKSTIGVEFATRSIRVDDKIIKAQIWDTAGQERYRAITSAYYRGAVGALLVYDTTRHITFENVERWLKELRDHSDSNIVIMLVGNKSDLRHLRAVSTEDAKTFAEKENTYFMETSALEALNVENAFTEVLTQIYHVVSRKALDIGNDPASLPQGQTINVGSKDDVSAVKKVGCCST

SEQ ID NO: 6337 - protein, 217 aa, Conyza canadensis
MAAYRGDDDYDYLFKVVLIGDSGVGKSNLLSRFTRNEFSLESKSTIGVEFATRSIRVDDKVIKAQIWDTAGQERYRAITSAYYRGAVGALLVYDTTRHVTFENVARWLKELRDHSDSNIVIMLVGNKADLRHLRAVSTEDAKAYAEKENTYFMETSALESLNVENAFTEVLTQIYHVVSRKALDIGNDAGELPKGQTINVGSKDDVSAMKKVGCCST

SEQ ID NO: 6338 - protein, 216 aa, Gossypium hirsutum
MAAYRADDDYDYLFKLVLIGDSGVGKSNLLSRFTKNEFNLESKSTIGVEFATRSIRVDDKVVKAQIWDTAGQERYRAITSAYYRGAVGALLVYDVTRHITFENVERWLKELRDHTDSNIVIMLVGNKADLRHLRAVSTEEAKAFAEREKTYFMETSALESLNVENAFTEVLTRIYHVVSRKALEVGDDPAALPKGQTINVGKDDVSALKKIGCCSA

SEQ ID NO: 6339 - protein, 217 aa, Flaveria ramosissima
MGAYRADDDYDYLFKVVLIGDSGVGKSNLLSRFTRNEFSLESKSTIGVEFATRSIRVDEKVIKAQIWDTAGQERYRAITSAYYRGAVGALLVYDVTRNVTFENVQRWLKELRDHTDSNIVIMLVGNKADLRHLRAVQTEDATSFAEKEHTYFMETSALESLNVESAFTEVLTQIYHIVSRKALDGGDDQAALPKGQTINVGGKDDVSAVKNAGCCSS

SEQ ID NO: 6340 - protein, 218 aa, Mimulus guttatus
MAGGYRADDDYDYLFKLVLIGDSGVGKSNLLSRFARNEFSLESKSTIGVEFATRSIRVDDKVVKAQIWDTAGQERYRAITSAYYRGAVGALLVYDVTRHVTFENVERWLKELRDHTDQNIVIMLVGNKADLRHLRAVSTEDGQAFAEREKTYFMETSALESLNVENAFTEVLTQIHQVVSRKALDIGDDPASLPKGQTINVGAKDDVSAVKRGGCCTV

SEQ ID NO: 6341 - protein, 217 aa, Mimulus guttatus
MGAYRADEDYDYLFKVVLIGDSGVGKSNLLSRFTKNEFSQQSKSTIGVEFATRSIQVDDKVVKAQIWDTAGQERYRAITSAYYRGAVGALLVYDVTRNVTFENVERWLKELRGHTDANIVIMLVGNKADLRHLRAVPTEKAKAFAEKENTFFMETSALEALNVENSFTEVLTQIYHVVSKKALDIGDDPSALPKGQTIHIGNKDDVSAVKNKGCCSG

SEQ ID NO: 6342 - protein, 217 aa, Nicotiana benthamiana
  Sequence also found in Organisms: Nicotiana tabacum
MAGGYRAEDDYDYLFKLVLIGDSGVGKSNLLSRFSRNEFNLESKSTIGVEFATRSIRVDDKIVKAQIWDTAGQERYRAITSAYYRGAVGALVVYDITRHVTFENVERWLKELRDHTDQNIVIMLVGNKADLRHLRAVSTEDAKAFAERESTFFMETSALESLNVENAFTEVLTEIYKVVCRKALEVGDDPAALPKGQTINVGKDDVSAVKKVGCCSV

SEQ ID NO: 6343 - protein, 217 aa, Olea europaea
MGAYRADDDYDCLFKLVLIGDSGVGKSNLLSRFSRNEFSLESKSTIGVEFATRSIRVDEKVVKAQIWDTAGQERYRAITSAYYRGAVGALLVYDVTRHVTFENVERWLKELRDHTDSNIVIMLVGNKADLRHLRAVSTEDAKAFAERENTYFMETSALESTNVENAFTEVLSQIYHVVSRKALEVSDDPAALPKGQTINVGSKDDVSEIKKVGCCSV

SEQ ID NO: 6344 - protein, 217 aa, Sciadopitys verticillata
MAYRADDDYDYLFKVVLIGDSGVGKSNLLSRFTRNEFSLESKSTIGVEFATRSITVDDKVIKAQIWDTAGQERYRAITSAYYRGAVGALLVYDVTRHVTFENVERWLKELRDHTDANIVIMLVGNKADLRHLRAVSTEDGKAFAERESTYFMETSALEATNVEHAFTEVLSQIYRIVSKKALDVGEDPAAVPSKGQTINVNNKEDVSALKKVGCCSA

SEQ ID NO: 6345 - protein, 217 aa, Glycine max
MGAYRADEDYDYLFKVVLIGDSGVGKSNLLSRFTKNEFSLESKSTIGVEFATRSIRVDDKVLKAQIWDTAGQERYRAITSAYYRGAVGALLVYDVTRHVTFENVERWLKELRDHTDANIVVMLVGNKADLRHLRAVSTEETTNFAEREKTFFMETSALESLNVESAFTEVLTQIYHVVSKKALEIGDDPAALPKGQTINVGSRDDASAVKKDGCCSA

SEQ ID NO: 6346 - protein, 217 aa, Eutrema halophilum
MAAYRADDDYDFLYKVVLIGDSGVGKSNLLSRFTRNEFSLESKSTIGVEFATRSIRVDEKIVKAQIWDTAGQERYRAITSAYYRGAVGALLVYDATRHITFENVERWLKELRDHTDANIVVMLVGNKADLRHLRAVSTEDAKAFAERENTFFMETSALEALNVENAFTEVLSQIYRVASKKALDIGDDPATLPKGQSINVGSKDDVSEVKKVGCCSS

SEQ ID NO: 6347 - protein, 216 aa, Musa acuminata
MAYRSDDDYDYLFKVVLIGDSGVGKSNLLSRFTRNEFSLESKSTIGVEFATRSIRVEDKVVKAQIWDTAGQERYRAITSAYYRGAVGALLVYDVTRHTTFENVERWMKELRDHTDSSIVIMLVGNKADLRHLRAVTVEDAKAFAERENSFFMETSALESTNVDNAFTEVLTQIYRVTSRKALDAGDDPATLPKGQTINIGTHDDVSAVKKAGCCSA

SEQ ID NO: 6348 - protein, 216 aa, Chrysanthemum coronarium
MAYKADDDYDYLFKVVLIGDSGVGKSNLLSRFTRNEFSLESKSTIGVEFATRSIQVDDKTIKAQIWDTAGQERYRAITSAYYRGAVGALLVYDTTRHVTFENVERWLKELRDHSDSNIVIMLVGNKADLRHLRAVTTEDAKTYAEKEKTYFIETSALEALNVENAFTEVLTQIYHVVSKKALDIGNDPSALPKGQTINIGSKDDVSAVKKAGCCST

SEQ ID NO: 6349 - protein, 216 aa, Chrysanthemum coronarium
MAYKADDDYDYLFKVVLIGDSGVGKSNLLSRFTRNEFSLESKSTIGVEFATRSIKVDDKTIKAQIWDTAGQERYRAITSAYYRGAVGALLVYDTTRHVTFENVERWLKELRDHSDSNIVIMLVGNKADLRHLRAVTTEDAKTYAEKEKTYFIETSALEALNVENAFTEVLTQIYHVVSKKALDIGNDPSALPKGQTINIGSKDDVSAVKKAGCCST

SEQ ID NO: 6350 - protein, 208 aa, Fagopyrum esculentum
MSNFRADDDYDYLFKVVLIGDSGVGKSNLLSRFTRNEFSLESKSTIGVEFATRSVRVDEKIVKAQIWDTAGQERYRAITSAYYRGAVGALLVYDVTRHVTFENVERWLKELRDHTETNIVIMLVGNKADLRHLRAVSTEDGKTFAEKENTFFMETSALESINVENAFTEVLTQIYNVVSRKALEIGETLQPCPKDKLSTSAAKMTFQL

SEQ ID NO: 6351 - protein, 95 aa, Tropaeolum majus
MLVGNKADLRHLRAVSTEDSQAFAERENTFFMETSALESLNVENAFTEVLAQIYRVVSRKALDIGDDPTALPKGKTINVGSKDDSAGKNDGCCSA

SEQ ID NO: 6352 - protein, 218 aa, Amsonia hubrichtii
MAGVYRADDDYDYLFKVVLIGDSGVGKSNLLSRFTRNEFSLESKSTIGVEFATRSIRVDEKIVKAQIWDTAGQERYRAITSAYYRGAVGALLVYDVTRHVTFENVERWLKELRDHTDQNIVIMLVGNKADLRHLRAVSTEDATAFAERQSLYFMETSALESLNVENAFTEVLTQIHNVVSRKALEVGDDPAALPKGQTINVGNKEDVSAVKKVGCCSA

SEQ ID NO: 6353 - protein, 216 aa, Catharanthus roseus
MAGGYRADDDYDYLFKVVLIGDSGVGKSNLLSRFTRNEFNLESKSTIGVEFATRSIRVDDKIVKAQIWDTAGQERYRAITSAYYRGAVGALLVYDVTRHVTFENVERWLKELRDHTDQNIVIMLVGNKGDLRHLRAVSTEDAKAYAERENLYFMETSALESMNVENAFTEVLTQIHHVVSRKALEVGDDPSALPKGKTIDVKDDVSAVKKVGCCSV

SEQ ID NO: 6354 - protein, 217 aa, Nicotiana benthamiana
MAGGYRAEDDYDYLFKLVLIGDSGVGKSNLLSRFSRNEFNLESKSTIGVEFATRSIRVDDKIVKAQIWDTAGQERYRAITSAYYRGAVGALVVYDITRHVTFENVERWLKELRDHTDQNIVIMLVGNKADLRHLRAVSTEDAKAFAERESTFFMETSALESLNVENAFTEVLTEIYKVVCRKALEVGDDPAALPKGQTINVGKDDVSDVKKVGCCSV

SEQ ID NO: 6355 - protein, 214 aa, Centaurea maculosa
  Sequence also found in Organisms: Cirsium arvense
MGAYRAEDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDSNIVIMLVGNKADLRHLRAVQTEDATSFAEKEHTYFMETSALESLNVESAFTEVLTQIYQIVSRKALESGDDAAAVPKGQTINVDDVSAVKKGGCCSS

SEQ ID NO: 6356 - protein, 217 aa, Podocarpus macrophillus
MAYRADDDYDYLFKVVLIGDSGVGKSNLLSRFTRNEFSLESKSTIGVEFATRSITVDDKVIKAQIWDTAGQERYRAITSAYYRGAVGALLVYDVTRHVTFENVERWLKELRDHTDANIVIMLVGNKADLRHLRAVSTEDGKAFAERESLYFMETSALESTNVEAAFTEVLSQIYRIVSKKALDVGEDPASVPSKGQTINVNSKEDVSALKKVGCCSG

SEQ ID NO: 6357 - protein, 96 aa, Fagus grandifolia
MIVGNKADLRHLRAVSTEDATAFAEREHTYFMETSALESLNVENAFTEVLAQIYRVVSRKALDIGDDPAALPKGQNINVGSKDDVSAVKKVGCCSV

SEQ ID NO: 6358 - protein, 216 aa, Artemisia annua
MAYKADDDYDYLFKVVLIGDSGVGKSNLLSRFTRNEFSLESKSTIGVEFATRSIKVDDKTIKAQIWDTAGQERYRAITSAYYRGAVGALLVYDTTRHVTFENVERWLKELRDHSDSNIVIMLVGNKADLRHLRAVTTEDAKTYAEKEKTYFIETSALEALNVENAFTEVLTQIYHVVSKKALDIGNDTGALPKGQTINIGSKDDVSAVKKAGCCST

SEQ ID NO: 6359 - protein, 218 aa, Gnetum gnemon
MAGYRADEDYDYLFKVVLIGDSGVGKSNLLSRFTRNEFSLESKSTIGVEFATRSINVDDKVIKAQIWDTAGQERYRAITSAYYRGAVGALLVYDVTRQVTFENVERWLKELRGHTDANIVIMLVGNKADLRHLRAVSVEDGKAFAEKENLFFMETSALESTNVENAFTEVLSQIYRIVSKKALDVGEDAAAVPGKGQTISVGNKDDVTAMKKVGCCSV

SEQ ID NO: 6360 - protein, 218 aa, Orobanche aegyptiaca
MAGGYRADDDYDYLFKLVLIGDSGVGKSNLLSRFARDEFSLESKSTIGVEFATRSIHVDDKIVKAQIWDTAGQERYRAITSAYYRGAVGALLVYDVTRHVTFENVERWLKELRDHTDQNIVIMLVGNKADLRHLRAVSTEDGEAFAQKEKTYFMETSALESMNVKDAFTEVLTQIYHIVCRKALDIGDDPSTLPKGQTINVGNKDEVSAVKKVGCCSV

SEQ ID NO: 6361 - protein, 217 aa, Solanum lycopersicum
  Sequence also found in Organisms: Solanum tuberosum
MAGGYRAEDDYDYLFKLVLIGDSGVGKSNLLSRFSRNEFNLESKSTIGVEFATRSIKVDDKIVKAQIWDTAGQERYRAITSAYYRGAVGALVVYDITRHVTFENVERWLKELRDHTDQNIVIMLVGNKADLRHLRAVSTEDAKAFAERESTFYMETSALESLNVENAFTEVLTEIYRVVCRKALEVGDDPTALPKGQTINVGKDDVSAVKKVGCCSV

SEQ ID NO: 6362 - protein, 217 aa, Daucus carota
MGAYRADEEYDYLFKLVLIGDSGVGKSNLLSRFTRNEFSLESKSTIGVEFATRTIHVDDKVVKAQIWDTAGQERYRAITSAYYRGAVGALLVYDVTRNVTFENVERWLKELRDHTDANIVIMLVGNKADLRHLRAVQTDDAKSFAEQEHTFFMETSALESLNVENAFTEVLSQIYRVVSRKALDMAEDPTVLPKGQTINVGGKDDVSAIKKTGCCSS

SEQ ID NO: 6363 - protein, 217 aa, Cichorium intybus
MGGFHADDDYDYLFKVVLIGDSGVGKTNLLSRFSKNEFSLESKSTIGVEFATRSINVDDKVIKAQIWDTAGQERYRAITSAYYRGAVGALIVYDITRHVTFENVERWLKELRDHTDQNIVIMLVGNKADLRHLRAVQMDDAKAFAERENNFFMETSALESLNVENAFTEVLTQIYHVVSKKALDIGNDPMVVPKGQTINVGGKDDVSAVKKAGCCSN

SEQ ID NO: 6364 - protein, 217 aa, Petroselinum crispum
MGTFRADEDYDYLFKVVLIGDSGVGKSNLLSRFTRNEFSLESKSTIGVEFATRSITVDDKVIKAQIWDTAGQERYRAITSAYYRGAVGALLVYDVTRNVTFQNVERWLKELRDHTDANIVIMLVGNKADLRHLRAVSTEDAQAFAERESNFFMETSALESLNVESAFTEVLTQIYRVVSRKALEIGEDPTVLPKGRTINVGGKDDVSAVKKSGCCSA

SEQ ID NO: 6365 - protein, 207 aa, Vicia sativa
DYLFKVVLIGDSGVGKSNLLSRFTKNEFSLESKSTIGVEFATRSIRVDDKVVKAQIWDTAGQERYRAITSAYYRGAVGALLVYDVTRHVTFENVERWLKELRDHTDANIVVMLVGNKADLRHLRAVSTEDSTAFAERENTFFMETSALESLNVESAFTEVLTQIYRVVSKKALEIGDDPAALPKGQTINVGSRDDVSAVKKGGCCSA

SEQ ID NO: 6366 - protein, 216 aa, Musa acuminata
MAYRSDDDYDYLFKVVLIGDSGVGKSNLLSRFTRNEFSLESKSTIGVEFATRSIRVEDKVVKAQIWDTAGQERYRAITSAYYRGAVGALLVYDVTRHTTFENVERWMKELRDHTDSSIVIMLVGNKADLRHLRAVTVEDSKAFAERENSFFMETSALESTNVDNAFTEVLTQIYRVTSRKALDAGDDPTTLPKGQTINIGTHDDVSAVKKAGCCSA

SEQ ID NO: 6367 - protein, 217 aa, Cucumis sativus
MGAYRADDDYDYLFKVVLIGDSGVGKSNLLSRFTRNEFSLETKSTIGVEFATRSIRVDDKIVKAQIWDTAGQERYRAITSAYYRGAVGALIVYDVTRHVTFENVERWLKELRSHTDHNIVIMLVGNKADLRHLRAVSTEDAQAFAERERTYFMETSALESFNVENSFTEVLTQTYRVVSRKILDIGDDPTVLPKGQTIDIGSKDDVSAVKKAGCCSS

SEQ ID NO: 6368 - protein, 217 aa, Eucalyptus grandis
MGTYRSDDDYDYLFKVVLIGDSGVGKSNLLSRFSRNEFSMESKSTIGVEFGTRCIRVDDKVVKAQIWDTAGQERYRAITSAYYRGAVGALLVYDITRHVTFENVERWLKELRDHTEANIVIMLVGNKADLRHLRAVSLDDAKAFAEQEHTFFMETSALEALNVENAFTEVLTQIYRVVSRKALDVGDDPAALPKGQTINVGNRDDVSAVKKAGCCSS

SEQ ID NO: 6369 - protein, 217 aa, Flaveria ramosissima
MAAYRADDDYDCLFKVVLIGDSGVGKSNLLSRFTRNEFSLESKSTIGVEFATRSIRVDDKLIKAQIWDTAGQERYRAITSAYYRGAVGALLVYDTTRHVTFENVGRWLKELRDHSDSNIVIMLVGNKSDLRHLRAVTTEDAKAFAEKESTYFMETSALESMNVDSAFTEVLTQIYHVVSRKALDMGGDPAALPKGQTINVGSKDDVSAMKKVGCCST

SEQ ID NO: 6370 - protein, 217 aa, Mimulus guttatus
MGAYRGDEDYDYLFKVVLIGDSGVGKSNLLSRFTKNEFSQQSKSTIGVEFATRSIQVDDKVVKAQIWDTAGQERYRAITSAYYRGAVGALLVYDVTRHVTFENVERWLKELRAHTDNNIVIMLVGNKADLRHLRAIPTQDAKEFAEKENTFFMETSALEAMNVENAFTEVLTQIYHVVSRKALEIGDDPATLPKGQTINIGSRDDVSAVKKTGCCSG

SEQ ID NO: 6371 - protein, 217 aa, Helianthus annuus
MGAYRADDDYDYLFKLVLIGDSGVGKSNLLSRFTRNEFSLESKSTIGVEFATRSIKVDEKVVKAQIWDTAGQERYRAITSAYYRGAVGALLVYDVTRHVTFENVERWLKELRDHTDSNIVMMLVGNKSDLRHLRAVTSEDAKTFAEKENMYFMETSALESSNVENAFTEVLTQIHQVVSRKALDAGDDQAALPKGQTINVGSKDDVSALKKVGCCST

SEQ ID NO: 6372 - protein, 217 aa, Citrullus lanatus
MGAYRADDDYDYLFKVVLIGDSGVGKSNLLSRFTRNEFSLETKSTIGVEFATRSIRVDDKIVKAQIWDTAGQERYRAITSAYYRGAVGALIVYDVTRHVTFENVERWLKELRGHTDHNIVIMLVGNKADLRHLRAVSTEDAQAFAERERTYFMETSALESFNVENSFTEVLTQTYRVVSRKILDIGDDPTVLPKGQTIDIGSKDDVSAVKKAGCCSS

SEQ ID NO: 6373 - protein, 216 aa, Zostera marina
MTYRTADDYDYLFKVVLIGDSGVGKSNLLSRFTRNEFSLESKSTIGVEFATKSIQVEEKVVKAQIWDTAGQERYRAITSAYYRGAVGALLVYDVTRHDTFENVERWLNELRDHTDVNIVIMLVGNKADLRHLRAVTEEDAKDFAEKENTFFMETSALDSTNVEDAFTEVLTQIYRVVSKKALEVVDDPTALPKGQNINVGGKDDVSEVKKAGCCSS

SEQ ID NO: 6374 - protein, 177 aa, Taraxacum officinale
MATYRADDDYDYLFKVVLIGDSGVGKSNLLSRFTRNEFSLESKSTIGVEFATRSIRVDDKIIKAQIWDTAGQERYRAITSAYYRGAVGALIVYDTTRHVTFENVERWLKELRDHSDSNIVIMLVGNKADLRHLRAVSTEDAKHLQKKRRRILWRRQLLRPRMWRILSPKFLRRFIMW

SEQ ID NO: 6375 - protein, 236 aa, Flaveria ramosissima
MAAYRADDDYDYLFKLVLIGDSGVGKSNLLSRFAKNEFNLESKSTIGVEFATRSIRVDDKIVKAQIWDTAGQERYRAITSAYYRGAVGALLVYDTSRHITFENVERWLKELRDHTDSNIVIMLVGNKADLRHLRAVPTEEAKTFAEKENTYFMETSALEALNVETAFTEVLTQIYHVVSRKALDAGDDPSALPKGQTINVGSKDDVSAVKKSVAALRKNCFVGFETSFEPASSLIW

SEQ ID NO: 6376 - protein, 217 aa, Daucus carota
MAAYRADDDYDYLFKLVLIGDSGVGKSNLLSRFTKNEFSLESKSTIGVEFATRTIKVDDKIVKAQIWDTAGQERYRAITSAYYRGAVGALLVYDVTRNITFENVERWLKELRDHTDANIVIMLVGNKADLRHLRAVPTETGKSFAEKEETFFMETSALESLNVESAFTEVLSQIYHVVSRKALEVGDDPVALPKGQTINVGSKDDVSAVKKIGCCSA

SEQ ID NO: 6377 - protein, 217 aa, Ambrosia trifida
MGAYRADDDYDYLFKLVLIGDSGVGKSNLLSRFTRNEFSLESKSTIGVEFATRSIRVDEKVVKAQIWDTAGQERYRAITSAYYRGAVGALLVYDVTRHVTFENVERWLKELRDHTDSSIVMMLVGNKSDLRHLRAVTSEDAKTFAEKENMYFMETSALESSNVENAFTEVLTQIHQVVSRKALDAGDDQAALPKGQTINVGNKDDVSALKKVGCCST

SEQ ID NO: 6378 - protein, 218 aa, Brassica rapa
MAAYRADDDYDFLYKVVLIGDSGVGKSNLLSRFTRNEFSLESKSTIGVEFATRSIRVDEKVVKAQIWDTAGQERYRAITSAYYRGAVGAFLVYDVTRRVTFENVERWLKELRDHTDANIVCMLVGNKADLRHLRAVSTEDATAFAERENTFFMETSALEALNVEDAFTQVLSQIYRVASKKALDVGGDDHAALPKGQSINVGGKDDVSEVKKVGCCSS

SEQ ID NO: 6379 - protein, 217 aa, Musa acuminata
MAYRADDEYDYLFKVVLIGDSGVGKSNLLSRFTRDEFSLESKSTIGVEFATRSIRVEDKVIKAQIWDTAGQERYRAITSAYYRGAVGALVVYDITRHVTFENIERWLKELRDHTDTNIAIMLVGNKADLRHLRAVSIEDAKDFSERENTFFMETSALESTNVEDAFTEVLTQIYRVVSRKALEAGDDDSAALPKGQTVNVGSKDDVSAVKNNGCCSS

SEQ ID NO: 6380 - protein, 217 aa, Solanum melongena
MAGGYRAEDDYDYLFKLVLIGDSGVGKSNLLSRFSRNEFNLESKSTIGVEFATRSIKVDDKIVKAQIWDTAGQERYRAITSAYYRGAVGALVVYDITRHVTFENVERWLKELRDHTDQNIVIMLVGNKADLRHLRAASTEDAKAFAERESTFFMETSALESLNVENAFTEVLSEIYKVVCRKALEVGDDPAALPKGQTINIGKDDVSAVKKVGCCSV

SEQ ID NO: 6381 - protein, 217 aa, Eucalyptus grandis
MGTYRSDDDYDYLFKVVLIGDSGVGKSNLLSRFSRNEFSMESKSTIGVEFGTRCIRVDNKVIKAQIWDTAGQERYRAITSAYYRGAVGALLVYDITRHVTFENVERWLKELRDHTEANIVIMLVGNKADLRHLRAVSLNDAKAFAEQEHTFFMETSALEAFNVENAFTEVLTQIYRVVSRKALDIGDDPAALPKGQTINVGNRDDVSAVKKAGCCSS

SEQ ID NO: 6382 - protein, 217 aa, Solanum phureja
MAGGYRAEDDYDYLFKLVLIGDSGVGKSNLLSRFSRNEFNLESKSTIGVEFATRSIKVDDKIVKAQIWDTAGQERYRAITSAYYRGAVGALVVYDITRHVTFENVERWLKELRDHTDQNIVIMLVGNKADLRHLRAVSTEDAKAFAERESTFYMETSALESLNVENAFTEVLTEIYRVVCRKALEVGDDPTTLPKGQTINVGKDDVSAVKKVGCCSV

SEQ ID NO: 6383 - protein, 520 aa, Brassica oleracea
MLWSKFLRVETETGFFALVNCDSFFIDEEKKVAMGYHSTFNIVGEVGYLKKLELVERAGGDIGYCRSNVCSYVPTLVQIKQPAAGGGERKRQSDLEKQRYDQNMSRLAAIENRSSCFSFLLFFMASLASHPSKKLKNFFLITLLTTAAVTSEQQCRNFKSIIIFGDSITDTGNLLHLSDLNNLPQSAFPPYGETFFHVPTGRFSNGRLIIDFIAEFLRLPYVPPYFGSPNESFQKGVNFAVAGATALERSFLESRGIHYAYTNVSLGVQLKSFKKSLPNICGSPSDCREMIGDALIIVGEIGGNDYNYGLLVGKSIEEIKELVPLVISTISSVITELVHMGGRTIMVPTDLPIGCWTSFLTQYQTSNQEEYNPLTGCLNWLNEFVEHHNKELQEELNRLQKLYPHVTILYADYYNALLHIFQEPARFGFVNRPLSACCGTGGPYNFNNGSQCGTKGVDCCTDPSKYVHWDGFHLTESAYRWVAMGLLEGPYTLPAFDWSCPGFDIKNRTSSGRQYSFTTR

SEQ ID NO: 6384 - protein, 208 aa, Ambrosia trifida
MGAYRSDDDYDYLFKLVLIGDSGVGKSNLLSRFTRNEFSLESKSTIGVEFATRSIRVDEKVVKAQIWDTAGQERYRAITSAYYRGAVGALLVYDVTRHVTFENVERWLKELRDHTDSSIVMMLVGNKSDLRHLRAVTSEDAKTFAEKENMYFMETSALESSNVENAFTEVLTQIHQVVSRKLLTLEMIRRLCQRDRRLMLATRMMSQH

SEQ ID NO: 6385 - protein, 96 aa, Flaveria ramosissima
MLVGNKSDLRHLRAVTSEDAKTFAEKENMYFMETSALESSNVENAFTEVLTQIHQVVSRKALDVGDDSAALPKGQTINVGNKDDVSALKKVGCCST

SEQ ID NO: 6386 - protein, 216 aa, Musa acuminata
MAYKAEDDYDYLFKVVLIGDSGVGKSNLLSRFTRNEFSLESKSTIGVEFATRTIRVDEKVVKAQIWDTAGQERYRAITSAYYRGAVGALVVYDITRHVTFESVERWLKELREHTDSSTIIMLVGNKADLRHLRAVSTEDAKDFAERENSFFMETSALESMNVENAFSEVLTQIHHVVCKKALEAGNDPAALPKGQTINIGSKDDVSAVKKAGCCSA

SEQ ID NO: 6387 - protein, 216 aa, Musa acuminata
MAYRADEEYDYLFKVVLIGDSGVGKSNLLSRFARNEFSIESKSTIGVEFATRTVHVDDKVVKAQIWDTAGQERYRAITSAYYRGAVGALVVYDVTRHATFENVERWLKELRSHTDPSIVVMLVGNKADLRHLRAVSLEDAEVFAEKEKTFFMETSALESLNVENAFTEVLSQIYRVTSKKALDVGDDAAVLPKGQTINMGGKDDVSAVKKRGCCST

SEQ ID NO: 6388 - protein, 214 aa, Daucus carota
GAYRADDDYDYLFKIVLIGDSGVGKSNLLSRFTRNEFSLESKSTIGVEFATRSITVEDKVIKAQIWDTAGQERYRAITSAYYRGAVGALLVYDVTRNVTFENVERWLKELRNHTDSSIVIMLVGNKADLRHLRAVSTEDAMAFAENEGTFFMETSALESMNVEDAFTEVLTQIHQVVSKKALEVGNDPAAVPKGQTINVNDDVSAVKKAGCCAA

SEQ ID NO: 6389 - protein, 216 aa, Phalaenopsis aphrodite
MAYRSDDEYDYLFKVVLIGDSGVGKSNLLSRFTRNEFNLESKSTIGVEFATRSIRVEEKVVKAQIWDTAGQERYRAITSAYYRGAVGALLVYDITRHITFENVERWLKELRDHTNPNIVIMLVGNKADLRHLRAVSTEDAKAFAERESTFFMETSALESMNVEIAFTEVLSQIYRVVSRKALDVGDDPSAPPRGQTINVGNRDDVSDLKKVGCCSA

SEQ ID NO: 6390 - protein, 215 aa, Silene vulgaris
MAYRTDDDYDYLFKVVIIGDSGVGKSNLLSRFTRNEFSLESKSTIGVEFATRSIHVDDKIVKAQIWDTAGQERYRAITSAYYRGAVGALLVYDVTRHITFENIERWLKELRDHTDNSIVIMLVGNKADLRHLRAVQTEDAKGFAEKENLFFTETSALESLNVENAFKEVLTQIYHVVSRKALDMGGDSSALPKGETINIGKDDVSEVKKVGCCSA

SEQ ID NO: 6391 - protein, 218 aa, Brassica napus
  Sequence also found in Organisms: Brassica oleracea
MAAYRADDDYDFLYKVVLIGDSGVGKSNLLSRFTRNEFSLESKSTIGVEFATRSIRVDEKVVKAQIWDTAGQERYRAITSAYYRGAVGAFLVYDVTRRVTFENVERWLKELRDHTDANIVCMLVGNKADLRHLRAVSTEDATAFAERESTFFMETSALEALNVEDAFTQVLSQIYRVASKKALDVGGDDHAALPKGQSINVGGKDDVSEVKKVGCCSS

SEQ ID NO: 6392 - protein, 218 aa, Brassica rapa
MGAYRAEDDYDYLFKVVLTGDSGVGKSNLLSRFTRNDFSHDSRATIGVEFATRSIKCDDKIVKAQIWDTAGQERYRAITSAYYRGAVGALLVYDVTRHVTFENVERWLKELRDHTDANIVIMLVGNKADLRHLRAISTEDAKAFAERENTFFMETSALEALNVENAFTEVLTQIYRVVSKKALEAGDDPTTALPKGQTINVGGRDDISAVKKPGCCSA

SEQ ID NO: 6393 - protein, 217 aa, Musa acuminata
MAYRADDEYDYLFKVVLIGDSGVGKSNLLSRFTRDEFSLESKSTIGVEFATRSIRVEDKVIKAQIWDTAGQERYRAITSAYYRGAVGALVVYDITRHVTFENIERWLKELRDHTDTNIAIMLVGNKADLRHLRAVSIDDAKDFSERENTFFMETSALESTNVEDAFTEVLTQIYRVVSRKALEAGDDDSAALPKGQTVNVGSKDDVSAVKNNGCCSS

SEQ ID NO: 6394 - protein, 210 aa, Daucus carota
MAAYRGDDDYDYLFKVVIIGDSGVGKSNLLSRFTKNEFSLDSKSTIGVEFATRSIRVDDKVVKAQIWDTAGQERYRAITSAYYRGAVGALLVYDVTRHVTFENVERWLKELRDHTDANIVIMLVGNKADLRHLRAVSTEDAKAFAEREKTYFMETSALESMNVENSFTEVLSQIHHIVSRKALEMGDDPAALPKGQTIAVGSKDDVSAVK

SEQ ID NO: 6395 - protein, 217 aa, Ambrosia trifida
MGAYRSDDDYDYLFKLVLIGDSGVGKSNLLSRFTRNEFSLESKSTIGVEFATRSIRVDEKVVKAQIWDTAGQERYRAITSAYYRGAVGALLVYDVTRHVTFENVERWLKELRDHTDSSIVMMLVGNKSDLRHLRAVTSEDAKTFAEKENMYFMETSALESSNVENAFTEVLTQIHQVVSRKALDAGDDQAALPKGQTINVGNKDDVSALKKVGCCST

SEQ ID NO: 6396 - protein, 217 aa, Artemisia annua
MAAYRADDDYDYLFKLVLIGDSGVGKSNLLSRFAKNEFNLESKSTIGVEFATRSIRVDDKIVKAQIWDTAGQERYRAITSAYYRGAVGALLVYDTSRHVTFENVERWLKELRDHTDQNIVIMLVGNKADLRHLRAVPTEEAKAYAEKENTYFMETSALEALNVETAFTEVLTQIYHVVSRKALDAGNDPSALPKGQTINVGSKDDVSAVKKTTCCSA

SEQ ID NO: 6397 - protein, 217 aa, Artemisia annua
MAAYRADDDYDYLFKLVLIGDSGVGKSNLLSRFAKNEFNLESKSTIGVEFATRSIRVDDKIVKAQIWDTAGQERYRAITSAYYRGAVGALLVYDTSRHVTFENVERWLKELRDHTDQNIVIMLVGNKADLRHLRAVPTEEAKAYAEKENTYFMETSALEALNVETAFTEVLTQIYHVVSRKALDAGNDPSALPKGQTINVGSKDDVSAVKKATCCSA

SEQ ID NO: 6398 - protein, 216 aa, Musa acuminata
MAYKAEDDYDYLFKVVLIGDSGVGKSNLLSRFTRNEFSLESKSTIGVEFATRTIRVDEKVVKAQIWDTAGQERYRAITSAYYRGAVGALVVYDITRHVTFESVERWLKELREHTDSSTIIMLVGNKADLRHLRAVSTEDAKDFAERENSFFMETSALESMNVENAFSEVLTQIHHVVCKKALEAGNDPASLPKGQTINIGSKDDVSAVKKAGCCSA

SEQ ID NO: 6399 - protein, 217 aa, Phaseolus vulgaris
MGAYRADEDYDYLFKVVLIGDSGVGKSNLLSRFTKNEFCLESKSTIGVEFATRSIRVDDKIVKAQIWDTAGQERYRAITSAYYRGAVGALLVYDVTRHVTFENVERWFKELRDHTDANIVVMVVGNKADLRHLRAVSTEDATTFAERKKTFFMETSALESMNVENAFTELLTQIYHVVSTKALEIGDDPAALPKGQTLNVGSRDGVSDVKQNGCCSA

SEQ ID NO: 6400 - protein, 216 aa, Vitis vinifera
MGAYRAEDDYDYLFKVVLIGDSGVGKSNLLSRFTKNEFSLESKSTIGVEFATRSIRVDEKVVKAQIWDTAGQERYRAITSAYYRGAVGALLVYDVTRHVTFENVDRWLKELRDHTDSSIVIMLVGNKADLGHLRAVSTEDAKAYAEKESTFFIETSALESTNVENAFTEVLTQIYHVVSRKALETGDEAATVPKGQTINVGKDDVSAIKIGGCCSA

SEQ ID NO: 6401 - protein, 215 aa, Silene vulgaris
MAYRADDDYDYLFKIVLIGDSGVGKSNLLSRFTRNEFSLESKSTIGVEFATRSIHVDDKIIKAQIWDTAGQERYRAITSAYYRGAVGALLVYDVTRHVTFENIERWLKELRDHTESSIVIMLVGNKADLRHLRAISTEDAKSFAERENLFFMETSALESLNVENSFTEVLTQVHHVFSRRALDIGGDPTALPKGQTIHVGKDDVSEVKKVGCCSA

SEQ ID NO: 6402 - protein, 217 aa, Helianthus annuus
MAAYRSDDDYDYLFKVVLIGDSGVGKSNLLSRFTRNEFTLESKSTIGVEFATRSIRLHDKIIKAQIWDTAGQERYRAITSAYYRGAVGALLVYDTTRHVTFENVERWLKELRDHSDSNIVIMLVGNKSDLRHLRAVTTEDAKTFAEKENTYFMETSALESLNVDNAFTEVLTQIYHVVSRKALDIGEDSAALPKGQTINVGSKDDVSAMKKVGCCST

SEQ ID NO: 6403 - protein, 217 aa, Tragopogon dubius
MAAYRADDDYDYLFKLVLIGDSGVGKSNLLSRFAKNEFNLESKSTIGVEFATRSIRVDDKIVKAQIWDTAGQERYRAITSAYYRGAVGALLVYDTSRHVTFENVERWLKELRDHTDSNIVIMLVGNKSDLRHLRAVPTEEAKAFAEKENTYFMETSALEALNVETAFTEVLTQIHHVVSRKALDAGDDPSALPKGQTISVGGKDDVSAVKKVGCCSA

SEQ ID NO: 6404 - protein, 231 aa, Amaranthus tuberculatus
AAYRAEDDYDYLFKVVLIGDSGVGKSNLLSRFTRNEFNLESKSTIGVEFATRSIHVDDKIVKAQIWDTAGQERYRAITSAYYRGAVGALLVYDVTRHVTFENIERWLKELRDHTESSIVIMLVANKADLRHLRAVSTEDAKAFAERENLFFMETSALESLNVENAFSEVLTQVYHVVCRKALDVGGDPTALPRGQTIDIGKDDVSEVKKSVVVLPDKDHLVTHDIFVKCSH

SEQ ID NO: 6405 - protein, 107 aa, Ambrosia trifida
MAAYRADDDYDYLFKLVLIGDSGVGKSNLLSRFAKMSLILNQSQRSASNLPPEVFVLMIKLLRLRFGILLAKKGTAQLQVHTTEELLELYLCMTRHATSPLRTLSDG

SEQ ID NO: 6406 - protein, 98 aa, Flaveria ramosissima
MAAYRADDDYDYLFKLVLIGDSGVGKSNLLSRFAKNEFNLESKSTIGVEFATRSIRVDDKIVKAQIWDTAGQERYRAITSAYYRGAVGALVVYDTHAT

SEQ ID NO: 6407 - protein, 217 aa, Chrysanthemum coronarium
MAAYRADDDYDYLFKLVLIGDSGVGKSNLLSRFAKNEFNLESKSTIGVEFATRSIRVDDKIVKAQIWDTAGQERYRAITSAYYRGAVGALLVYDTSRHVTFENVERWLKELRDHTDSNIVIMLVGNKADLRHLRAVPTEEAKGYAEKENTYFMETSALEALNVETAFTEVLTQIYHVVSRKALDAGNDPSALPKGQTINVGSKDDVSAVKKATCCSA

SEQ ID NO: 6408 - protein, 217 aa, Chrysanthemum coronarium
MAAYRADDDYDYLFKLVLIGDSGVGKSNLLSRFAKNEFNLESKSTIGVEFATRSIRVDDKIVKAQIWDTAGQERYRAITSAYYRGAVGALLVYDTSRHVTFENVERWLKELRDHTDQNIVIMLVGNKADLRHLRAVPTEEAKGYAEKENTYFMETSALEALNVETAFTEVLTQIYHVVSRKALDAGNDPSALPKGQTINVGSKDDVSAVKKATCCSA

SEQ ID NO: 6409 - protein, 217 aa, Cichorium intybus
MASYRADDDYDYLFKLVLIGDSGVGKSNLLSRFAKNEFNLESKSTIGVEFATRSIRVDDKIVKAQIWDTAGQERYRAITSAYYRGAVGALLVYDTSRHVTFENVERWLKELRDHTDSNIVIMLVGNKSDLRHLRAVPTEEARAFAEKENTYFMETSALEALNVETAFTEVLTQIHQVVSRKALDAGDDPSALPKGQTISVGGKDDVSAVKKVGCCSA

SEQ ID NO: 6410 - protein, 209 aa, Petroselinum crispum
MAAYRGDDDYDYLFKVVIIGDSGVGKSNLLSRFTKNEFSLDSKSTIGVEFATRSIRVDDKVVKAQIWDTAGQERYRAITSAYYRGAVGALLVYDVTRHVTFENVERWLKELRDHTDANIVIMLVGNKADLRHLRAVSTEDAKAFAEREKTYFMETSALESMNVENSFTEVLSQIYHVVSRKALEMGDDPAVLPKGQTIAVGSKDDASAV

SEQ ID NO: 6411 - protein, 217 aa, Ambrosia trifida
MAAYRADDDYDYLFKLVLIGDSGVGKSNLLSRFAKNEFNLESKSTIGVEFATRSIRVDDKVIKAQIWDTAGQERYRAITSAYYRGAVGALLVYDTSRHVTFENVERWLKELRDHTDSNIVIMLVGNKADLRHLRAVQTEEAKTFAEKENTYFMETSALEALNVETAFTEVLTEIYHVVSRKALDAGDDPSALPKGETINVGSKDDVSAVKKVGCCSA

SEQ ID NO: 6412 - protein, 217 aa, Centaurea maculosa
MGGYHGDDDYDYLFKVVLIGDSGVGKTNLLSRFSKNEFSLESKSTIGVEFATRSINVDDKIIKAQIWDTAGQERYRAITSAYYRGAVGALIVYDITRNVTFDNVERWLKELRDHTDQNIVITLVGNKADLRHLRAVQTEDAKAFAEKENNFFMETSALESFNVENAFTEVLTQIYHVVSKKALDIGNDPMVIPKGQSISVGGRDDVSAVKKSGCCSN

SEQ ID NO: 6413 - protein, 217 aa, Cynara scolymus
MAAYRADDDYDYLFKLVLIGDSGVGKSNLLSRFAKNEFNLESKSTIGVEFATRSIRVDDKIVKAQIWDTAGQERYRAITSAYYRGAVGALLVYDTSRHVTFENVERWLKELRDHTDSNIVIMLVGNKADLRHLRAVPTEEAKTFAEKENTYFMETSALEALNVETAFTEVLTQIHHVVSRKALDAGDDPSALPKGQSINVGSKDDVSAVKKVGCCSA

SEQ ID NO: 6414 - protein, 217 aa, Flaveria ramosissima
MAAYRADDDYDYLFKLVLIGDSGVGKSNLLSRFAKNEFNLESKSTIGVEFATRSIRVDDKIVKAQIWDTAGQERYRAITSAYYRGAVGALVVYDTSRHVTFENVARWLKELRDHTDANIVIMLVGNKADLRHLRAVPTEEAKAFAEKENIYFMETSALEALNVETAFTEVLTHIYHVVSRKALEAGDDPSALPKGQTINVGSKDDASAVKKVGCCSA

SEQ ID NO: 6415 - protein, 216 aa, Musa acuminata
MAYRADEEYDYLFKVVLIGDSGVGKSNLLSRFARNEFSIESKSTIGVEFATRTVHVDDKVVKAQIWDTAGQERYRAITSAYYRGAVGALVVYDVTRHATFENVERWLKELRSHTDPSIVVMLVGNKADLRHLRSVSLEDAEVFAEKEKTFFMETSALESLNVENAFTEVLSQIYRVTSKKSLDVGDDAAVFPKGQTINMGGKDDVSAVKKRGCCST

SEQ ID NO: 6416 - protein, 215 aa, Curcuma longa
MAYRADDEYDYLFKVVLIGDSGVGKSNLLSRFTRNEFSLESKSTIGVEFATRSIRVDDKVIKAQIWDTAGQERYRAITSAYYRGAVGALIVYDITRHVTFENLERWLKELRDHTDSNIVIMLVGNKADLRHLRAVSTEDAKDFAERERAFFMETSALESVNVEEAFTEVLSQIYNIASRKALEAADDSATLPKGQKINVGKDDVSAVKKVGCCST

SEQ ID NO: 6417 - protein, 209 aa, Saccharum officinarum
MAYRAEDDYDYLFKVVLIGDSGVGKSNLLSRFTRNEFSLESKSTIGVEFATRSIRVDDKVVKAQIWDTAGQERYRAITSAYYRGAVGALVVYDVTRHVTFENVERWLKELRDHTDANIVIMLVGNKADLRHLRAVSVEDAKGFAERESTFFMETSALESMNVESGFNEGLTQIYRVVSKKAFTLAITWWSTKRGNHQVGGQDDFFLLIN

SEQ ID NO: 6418 - protein, 218 aa, Brassica oleracea
MGAYRAEDDYDYLFKVVLTGDSGVGKSNLLSRFTRNDFSNDSRATIGVEFATRSIQCDDKIVKAQIWDTAGQERYRAITSAYYRGAVGALLVYDVTRHVTFENVERWLKELRDHTDANIVIMLVGNKADLRHLRAISTEDAKGFAERENTFFMETSALEALNVENAFTEVLTEIYRVVSKKALEAGDDPTTALPKGQTINVGGRDDISAVKKPGCCSA

SEQ ID NO: 6419 - protein, 217 aa, Capsicum annuum
MAGGYRAEDDYDYLFKLVLIGDSGVGKSNLLSRFSRNEFNLESKSTIGVEFATRSIRVDDKIVKAQIWDTAGQERYRAITSAYYRGAVGALLVYDITRHVTFENVERWLKELRDHTDQNIVIMLVGNKADLRHLRAVTIEDAKAFAERESTFFMETSALESLNVENAFTEVLTEIYRVVCRKALEVGDNPAALSKGQTINVGKDDVSAVKKVGCCNV

SEQ ID NO: 6420 - protein, 218 aa, Brassica rapa
MGAYRAEDDYDYLFKVVLTGDSGVGKSNLLSRFTRNDFSNDSRATIGVEFATRSIQCDDKIVKAQIWDTAGQERYRAITSAYYRGAVGALLVYDVTRHVTFENVERWLKELRDHTDANIVIMLVGNKADLRHLRAISTEEAKAFAERENTFFMETSALEALNVENAFTEVLTEIYRVVSKKALEAGDDPTTALPKGQTINVGGRDDISAVKKPGCCSA

SEQ ID NO: 6421 - protein, 217 aa, Cichorium intybus
MAAYRADDDYDYLFKLVLIGDSGVGKSNLLSRFAKNEFNLESKSTIGVEFATRSIRVDDKIVKAQIWDTAGQERYRAITSAYYRGAVGALLVYDTSRHVTFENVERWLKELRDHTDSNIVIMLVGNKSDLRHLRAVPTEEARAFAEKENTYFMETSALEALNVETAFTEVLTQIHQVVSRKALDAGDDPSALPKGQTISVGGKDDVSAVKKVGCCSA

SEQ ID NO: 6422 - protein, 201 aa, Petunia hybrida
MGAYRADDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDSSIVIMLVGNKADLRHLRAVSTEDAKAFAEKESTFFMETSALESMNVDNAFTEVLTQIHRVVSRKALEVGDDPAALPKGQTINVG

SEQ ID NO: 6423 - protein, 217 aa, Arnica chamissonis
MAAYRADDDYDYLFKLVLIGDSGVGKSNLLSRFAKNEFNLESKSTIGVEFATRSIRVDDKIVKAQIWDTAGQERYRAITSAYYRGAVGALLVYDTSRHVTFENVERWLKELRDHTDSNIVIMLVGNKADLRHLRAVQTEEAKTFAEKENTYFMETSALEALNVETAFTEVLTQIHNVVSRKALDAGNDPSALPKGQTINVGSKDDVSAVKKVGCCSA

SEQ ID NO: 6424 - protein, 217 aa, Arnica chamissonis
MAAYRADDDYDYLFKLVLIGDSGVGKSNLLSRFAKNEFNLESKSTIGVEFATRSIRVDDKIVKAQIWDTAGQERYRAITSAYYRGAVGALIVYDTSRHVTFENVERWLKELRDHTDSNIVIMLVGNKADLRHLRAVPTDEAKMFAEKENTYFMETSALEALNVETAFTEVLTQIYHVVSRKALEAGDDPSALPKGQTINVGSKDDASAVKKVGCCST

SEQ ID NO: 6425 - protein, 217 aa, Centaurea maculosa
  Sequence also found in Organisms: Cirsium arvense
MAAYRADDDYDYLFKLVLIGDSGVGKSNLLSRFAKNEFNLESKSTIGVEFATRSIRVDDKIVKAQIWDTAGQERYRAITSAYYRGAVGALLVYDTSRHVTFENVERWLKELRDHTDANIVIMLVGNKSDLRHLRAVPTEEAKTFAEKENTYFMETSALEALNVETAFTEVLTQIYHVVSRKALDAANDASALPKGQTINVGSKDDVSAVKKVGCCSA

SEQ ID NO: 6426 - protein, 217 aa, Fagopyrum esculentum
MGAFRADDDYDYLFKVVLIGDSGVGKSNLLSRFTRNEFSLESKSTIGVEFATRSIRVDDKIVKAQIWDTAGQERYRAITSAYYRGAVGALVVYDVTRHVTFENVERWLKELRDHTDANIVIMLVGNKSDLRHLRAVTLEDSKGFAERENTFFMETSALEALNVESAFTEVLSEIYHVVSRKALDIGDDPSAVPKGQTININKDHDVNAAEQGGCCSS

SEQ ID NO: 6427 - protein, 217 aa, Flaveria ramosissima
MAAYRADDDYDYLFKLVLIGDSGVGKSNLLSRFAKNEFNLESKSTIGVEFATRSIRVDDKIVKAQIWDTAGQERYRAITSAYYRGAVGALLVYDTSRHITFENVERWLKELRDHTDSSIVIMLVGNKADLRHLRAVPTEEAKTFAEKENTYFMETSALEALNVETAFTEVLTQIYHVVSRKALDAGNDPSALPKGQTINVGSKDDVSAVKKVGCCSA

SEQ ID NO: 6428 - protein, 217 aa, Flaveria ramosissima
MAAYRADDDYDYLFKLVLIGDSGVGKSNLLSRFAKNEFNLESKSTIGVEFATRSIRVDDKIVKAQIWDTAGQERYRAITSAYYRGAVGALVVYDTSRHVTFENVARWLKELRDHTDSNIVIMLVGNKADLRHLRAVPTEEAKAFAEKENIYFMETSALEALNVETAFTEVLTHIYHVVSRKALEAGDDPSALPKGQTINVGSKDDASAVKKVGCCSA

SEQ ID NO: 6429 - protein, 217 aa, Lactuca sativa
MGAFHADDDYDYLFKVVLIGDSGVGKTNLLSRFSKNEFSLESKSTIGVEFATRSINVDDKIIKAQIWDTAGQERYRAITSAYYRGAVGALIVYDITRSITFENVQRWLKELRDHTDQNIVIMLVGNKADLRHLRVVQMDDAKAFAERENNFFMETSALESLNVENAFTEVLTQIYHVVSKKALDIGNDPMVVPKGQTINVGGKDDVSAVKKAGCCSN

SEQ ID NO: 6430 - protein, 216 aa, Sesamum indicum
MGAYRADEDYDYLFKVVLIGDSGVGKSNLLSRFTKNEFSQESKSTIGVEFATRSIQVDDKVVKAQIWDTAGQERYRAITSAYYRGAVGALLVYDVTRNVTFQNVERWLKELRGHTDTNIVIMLVGNKADLRHLRAVPTQEAKDFAEREKTFFMETSALEALNVDQAFTEVLTQIYHVVSRKALDIGDDPTALPKGQTINIGSKDDVSAVKNTGCCS

SEQ ID NO: 6431 - protein, 217 aa, Helianthus annuus
MAAYRADDDYDYLFKLVLIGDSGVGKSNLLSRFAKNEFNLESKSTIGVEFATRSIRVDDKIVKAQIWDTAGQERYRAITSAYYRGAVGALLVYDTSRHVTFENVERWLKELRDHTDSNIVIMLVGNKADLRHLRAVPTEEAKTFAEKENTYFMETSALEALNVETAFTEVLTQIYHVVSRKALDAANDPSDLPKGQTINVGSKDDVSAVKKVGCCSA

SEQ ID NO: 6432 - protein, 96 aa, Flaveria ramosissima
MLVGNKADLRHLRAVPTEEAKAFAEKENIYFMETSALEALNVEIAFTEVLTNIYHVVSRKALEAGDDPSALPKGQTINVGSKDDASAVKKVGCCSA

SEQ ID NO: 6433 - protein, 216 aa, Musa acuminata
MAYRSDDDYDYLVKVVLIGDSGVGKSNLLSRFTRNEFNLESKSTIGVEFATRSIRVEDKVVRAQIWDTAGQERYRAITSAYYRGAVGALLVYDVTRHTTFEAVERWLKELRDHTDSNIVIMLVGNKADLRHLRAVTVDDAKAFAERENTFFMETSALESMNVDNAFTEVLTQIYRVTRRKALDAGDDPETLPKGQTIDIGTNDDVSAVKKAGCCSA

SEQ ID NO: 6434 - protein, 215 aa, Echinochloa colona
MAGAGEKVDYVFKVVLIGDSAVGKSQILARFARNEFSLDSKATIGVEFQTRTLVIDKRSVKAQIWDTAGQERYRAITSAYYRGAVGALVVYDVTRHVTFENVERWLKELRDHTDANIVIMLVGNKADLRHLRAVSVEDAKGFAERESTFFMETSALESMNVESAFTEVLTQIYRVVSKKALDIGDDPAAPPRGQTINVGGKDDVSAVKKSGCCSS

SEQ ID NO: 6435 - protein, 218 aa, Brassica oleracea
MATYTADDDYDFLYKVVLIGDSGVGKSNLLSRFTRNEFSLESKSTIGVEFATRTIHVDDKIVKAQIWDTAGQERYRAITSAYYRGAVGALLVYDVTRHVTFENVERWLKELRDHTDANIVIMLVGNKADLRHLRAVSTEDATAFAEREKTFFMETSALEALNVEDAFTQLLSQIYRVASKKALDVGDDDRSGVPKGQSVNVGSKGDVSEVKKIGCCSS

SEQ ID NO: 6436 - protein, 218 aa, Arabidopsis thaliana
MGAYRAEDDYDYLFKVVLTGDSGVGKSNLLSRFTRNDFSHDSRATIGVEFATRSIQCDDKIVKAQIWDTAGQERYRAITSAYYRGAVGALLVYDVTRHVTFENVERWLKELRDHTDANIVIMLVGNKADLRHLRAISTEEAKAFAERENTFFMETSALEAVNVDNAFTEVLTQIYRVVSKKALEAGDDPTTALPKGQMINVGGRDDISAVKKPGCCSA

SEQ ID NO: 6437 - protein, 217 aa, Capsicum annuum
MAGGYRAEDDYDYLFKLVLIGDSGVGKSNLLSRFSRNEFNLESKSTIGVEFATRSIRVDDKIVKAQIWDTAAQERYRAITSAYYRGAVGALLVYDITRHVTFENVERWLKELRDHTDQNIVIMLVGNKADLRHLRAVTIEDAKAFAERESTFFMETSALESLNVENAFTEVLTEIYRVVCRKALEVGDNPAALSKGQTINVGKDDVSAVKKVGCCNV

SEQ ID NO: 6438 - protein, 218 aa, Raphanus sativus
MGAYRAEDDYDYLFKVVLTGDSGVGKSNLLSRFTRNDFSNDSRATIGVEFATRSIQCDDKIVKAQIWDTAGQERYRAITSAYYRGAVGALLVYDVTRHVTFENVERWLKELRYHTDANIVIMLVGNKADLRHLRAISTEDAKGFAERENTFFMETSALEALNVENAFTEVLTEIYRVVSKKALEAGDDPTTALPKGQTINVGGRDDISAVKKPGCCSA

SEQ ID NO: 6439 - protein, 217 aa, Taraxacum officinale
MAAYRADDDYDYLFKLVLIGDSGVGKSNLLSRFAKNEFNLESKSTIGVEFATRSIRVDDKIVKAQIWDTAGQERYRAITSAYYRGAVGALLVYDTSRHVTFENVERWLKELRDHTDSNIVIMLVGNKSDLRHLRAVPTEEARAFAEKENTYFMETSALEALNVETAFTEVLTQIHHVVSRKAIDAGDDPAGLPKGQTISVGSKDDVSAVKKVGCCSA

SEQ ID NO: 6440 - protein, 215 aa, Fagopyrum esculentum
MAYLADDDYDYLFEVVLIGDSGVGKSNLLSRFTRNEFSLESKSTIGVEFATRSITVDDKVVKAQIWDTAGQERYRAITSAYYRGAVGALVVYDITRHITFDNIERWLKELRDHTDTNIVVMLVGNKADLRHLKAVSTSEANSFAERENTFFMETSALESLNVENAFKEVLAQIYHVVSRKALDIGDDPAAMPKGKTIDISGKDEITAVEGGCCSS

SEQ ID NO: 6441 - protein, 217 aa, Flaveria ramosissima
MAAYRADDDYDYLFKLVLIGDSGVGKSNLLSRFAKNEFNLESKSTIGVEFATRSIRVDDKIVKAQIWDTAGQERYRAITSAYYRGAVGALLVYDTSRHITFENVERWLKELRDHTDSSIVIMLVGNKADLRHLRAVPTEEAKTFAEKENTYFMETSALEALNVETAFTEVLTQIYHVVSRKALDAGNDPSALPKGQTINMGSKDDVSAVKKVGCCSA

SEQ ID NO: 6442 - protein, 217 aa, Helianthus annuus
MAAYRADDDYDYLFKLVLIGDSGVGKSNLLSRFAKNEFNLESKSTIGVEFATRSIRVDDKIVKAQIWDTAGQERYRAITSAYYRGAVGALLVYDTSRHVTFENVERWLKELRDHTDSNIVIMLVGNKADLRHLRAVPTEEAKTFAEKENTYFMETSALEALNVETAFTEVLTQIYHVVSRKALDAANDPSDLPKGQTIKVGSKDDVSAVKKVGCCSA

SEQ ID NO: 6443 - protein, 202 aa, Valeriana officinalis
VVLIGDSGVGKSNLLSRFTKNEFSLESKSTIGVEFATRSIRVDDKIVKAQIWDTAGQERYRAITSAYYRGAVGALLVYDVTRHVTFENVERWLKELRDHTDSNIVIMLVGNKADLRHLRAVSVEDAKSFAEKENTFFMETSALESMNVENSFTEVLTQIYHVVSRKALDIGDDHTTLPKGQTINVGSKDDVSAVKKAGCCST

SEQ ID NO: 6444 - protein, 233 aa, Euphorbia peplus
MGAYRADDDYDYLFKVVLIGDSGVGKSNLLSRFTRNEFSLESKSTIGVEFATRSIHVDDKVVKAQIWDTAGQERYRAITSAYYRGAVGALVVYDVTRRVTFENVERWLKELRDHTDSNIVIMLVGNKADLRHLRAVTTEDSTAFAEKENTFFMETSALESLNVENAFTEVLTQIYRVVSRKALDIGDDPTSLPKGQTIHVGKDDVSAVKKVGCCSASSFSFLKDLHFGDLELP

SEQ ID NO: 6445 - protein, 218 aa, Arabidopsis lyrata
  Sequence also found in Organisms: Eutrema halophilum
MGAYRAEDDYDYLFKVVLTGDSGVGKSNLLSRFTRNDFSHDSRATIGVEFATRSIQCDDKIVKAQIWDTAGQERYRAITSAYYRGAVGALLVYDVTRHVTFENVERWLKELRDHTDANIVIMLVGNKADLRHLRAISTEEAKAFAERENTFFMETSALEAVNVDNAFTEVLTQIYRVVSKKALEAGDDPTTALPKGQMINVGSRDDISAVKKPGCCSA

SEQ ID NO: 6446 - protein, 218 aa, Brassica rapa
MATYTADDDYDFLYKVVLIGDSGVGKSNLLSRFTRNEFSLESKSTIGVEFATRTIHVDDKIVKAQIWDTAGQERYRAITSAYYRGAVGALLVYDVTRHVTFENVERWLKELRDHTDANIVIMLVGNKADLRHLRAVSTEDATVFAEREKTFFMETSALEALNVEDAFTQLLSQIYRVASKKALDVGDDDRSGVPKGQSVNVGSKGDVSEVKKIGCCSS

SEQ ID NO: 6447 - protein, 215 aa, Brassica rapa
MGAYRAEDDYDYLFKVVLTGDSGVGKSNLLSRFTRNDFSNDSRATIGVEFATRSIQCDDKIVKAQIWDTAGQERYRAITSAYYRGAVGALLVYDVTRHVTFENVERWLKELRDHTDANIVIMLVGNKADLRHLRAISTEDAKGFAERENTFFMETSALEALNVENAFTEVLTEIYRVVSKKALEAGDDPTTALPKGQTINVGDISAVKKPGCCSA

SEQ ID NO: 6448 - protein, 217 aa, Arnica chamissonis
MGSYRADDDYDYLFKLVLIGDSGVGKSNLLSRFTRNEFSLDSKSTIGVEFATRSIRLDDKVIKAQIWDTAGQERYRAITSAYYRGAVGALLVYDVTRHVTFENVERWLKELRDHTDSNTVMMLVGNKSDLRHLRAVNSEDAKTFAEKENMYFMETSALESLNVETAFTEVLTQIHQVVSRKALDVVDDTAALPKGQTINVGNKDDVSALKKVGCCST

SEQ ID NO: 6449 - protein, 217 aa, Flaveria ramosissima
MAAYRADDDYDYLFKLVLIGDSGVGKSNLLSRFAKNEFNIESKSTIGVEFATRSIRVDDKIVKAQIWDTAGQERYRAITSAYYRGAVGALVVYDTSRHVTFENVARWLKELRDHTDSNIVIMLVGNKADLRHLRAVPTEEAKAFAEKENIYFMETSALEALNVETAFTEVLTHIYHVVSRKALEAGDDPSTLPKGQTINVGSKDDASAVKKVGCCSA

SEQ ID NO: 6450 - protein, 201 aa, Actinidia deliciosa
MAAYRADDDYDYLFKVVLIGDSGVGKSNLLSRFTRNEFSLESKSTIGVEFATRSIRVDDKVVNAQIWDTAGQERYRAITSAYYRGAVGALLVYDVTRHVTFENVERWLKELHDHTDSNIVIMLVGNKADLRHLRAVSTEDATAFAERENIFFMETSALESMNVENAFTEALTQIYHVISMKALEVRDDPAALPKGQTINVG

SEQ ID NO: 6451 - protein, 217 aa, Selaginella moellendorffii
MAYRSDEDYDYLFKVVLIGDSGVGKSNLLSRFTRNEFSLESKSTIGVEFATRSINVDGKLVKAQIWDTAGQERYRAITSAYYRGAVGALLVYDITRPVTYENVERWLKELKDHTDSNIVVMLVGNKSDLRHLRAVSTEDGQAFSEREGLYFMETSALESTNVENAFKQILTQIYRVVSKKALDVGEDPSAAPAKGQTINVGGKDDVTATKKVGCCSA

SEQ ID NO: 6452 - protein, 214 aa, Helianthus annuus
MAAYRADDDYDYLFKLVLIGDSGVGKSNLLSRFAKNEFNLESKSTIGVEFATRSIRVDDKIVKAQIWDTAGQERYRAITSAYYRGAVGALVVYDTSRHVTFENVERWLKELRDHTDPNIVIMLVGNKADLRHLRAVPTEEAKTFAEKENTYFMETSALEALNVETAFTEVLTQIHQVVSRKALEAGDDPSALPKGQTINVGSKDDVKKVGCCSA

SEQ ID NO: 6453 - protein, 216 aa, Musa acuminata
MAYRADEDYDYLFKVVLIGDSGVGKTNLLSRFARNEFSSESKSTIGVEFATRTIRVDEKLVKAQIWDTAGQERYRAITSAYYRGAAGALVVYDVTRHITFENVERWLKELRNHTDGNIVIMLLGNKADLRHIRAVSVEDAQAFAQQEKAFFMETSALESMNVENAFTEVLTQIYHVVSKKMLDVGDDPSAVPKGQTINIGAEDDVQASKKTGCCSD

SEQ ID NO: 6454 - protein, 218 aa, Arabidopsis thaliana
  Sequence also found in Organisms: Arabidopsis lyrata
MGTYKAEDDYDYLFKVVLTGDSGVGKSNLLSRFTRNDFSHDSRSTIGVEFATRSIQVDDKIVKAQIWDTAGQERYRAITSAYYRGAVGALLVYDVTRHVTFENVERWLKELRDHTDANTVIMLVGNKADLNHLRAISTEEVKDFAERENTFFMETSALEAINVENAFTEVLTQIYRVVSKKALDAGDDPTTALPKGQMINVGSRDDVSAVKKSGCCAT

SEQ ID NO: 6455 - protein, 218 aa, Brassica napus
MATYTADDDYDFLYKVVLIGDSGVGKSNLLSRFTRNEFSLESKSTIGVEFATRTIHVDDKIVKAQIWDTAGQERYRAITSAYYRGALGALLVYDVTRHVTFENVERWLKELRDHTDANIVIMLVGNKADLRHLRAVSTEDATVFAEREKTFFMETSALEALNVEDAFTQLLSQIYRVASKKALDVGDDDRSGVPKGQSVNVGSKGDVSEVKKIGCCSS

SEQ ID NO: 6456 - protein, 215 aa, Olea europaea
MAGGYRAEDDYDYLFKVVLIGDSGVGKSNLLSRFARNEFNLESKSTIGVEFATRSIHVEDKIVKAQIWDTAGQERYRAITSAYYRGAVGALLVYDVTRHVTFENVERWLKELRDHTDQNIVIMLVGNKVDLRHLRAVSTEDGTSFAEREKTYFIETSALESMNVENAFTELLTQIYHVVRRKAIEIGDDPATLPKGQTVKVDTKDDVSKVACCSI

SEQ ID NO: 6457 - protein, 216 aa, Capsicum annuum
MGAYRADEDYDYLFKVVLIGDSGVGKSNLLSRFTKNEFSQESKSTIGVEFATRTIHVDDKIIKAQIWDTAGQERYRAITSAYYRGAVGALLVYDITRHVTFENVARWLKELRDHTDQNIVVMLVGNKADLRHLRAVPTGESSGFAERENTFFMETSALEALNVENSFTEVLTQIYRVVSRKALDIGDDPASVPRGQTINIGKDDVSAVKKGGCCSG

SEQ ID NO: 6458 - protein, 215 aa, Gossypium hirsutum
  Sequence also found in Organisms: Gossypium raimondii
MGAYRADDDYDYLFKVVLIGDSGVGKSNLLSRFTKNEFSLESKSTIGVEFATRSITIEDKVVKAQIWDTAGQERYRAVTSAYYRGAVGALLVYDATRHVTFENIERWLKELRDHTDGSIVIMLLGNKSDLRHLRAVLTEDAKAFAEKEKTYFMETSALESLNVESAFTEVLTQIYHVVSKKALEGGNIQATLPKGQMINVGSKDDVSAIKKGGCC

SEQ ID NO: 6459 - protein, 217 aa, Fagopyrum esculentum
MGAFRADDDYDYLFKVVLIGDSGVGKSNLLSRFTRNEFSLESKSTIGVEFATRSIRVDDKIVKAQIGNTAGQERYRAITSAYYRGAVGALVVYDVTRHVTFENVERWLKELRDHTDANIVIMLVGNKSDLRHLRAVTLEDSKGFAERENTFFMETSALEALNVESAFTEVLSEIYHVVSRKALDIGDDPSAVPKGQTININKDHDANAGEQGGCCSS

SEQ ID NO: 6460 - protein, 216 aa, Nicotiana benthamiana
MGAYRADEDYDYLFKVVLIGDSGVGKSNLLSRFTKNEFSQESKSTIGVEFATRTIHVDDKIIKAQIWDTAGQERYRAITSAYYRGAVGALLVYDITRHVTFENVARWLKELRDHTDQNIVVMLVGNKADLRHLRAVPTGESSGFAERENTFFMETSALEALNVENAFTEVLTQIYRVVSRKALDIGDDPTAVPRGQTINIGKDDVSSVKKGGCCSG

SEQ ID NO: 6461 - protein, 216 aa, Nicotiana benthamiana
MGAYRTDEDYDYLFKVVLIGDSGVGKSNLLSRFTKNEFSQESKSTIGVEFATRTIHVDDKIVKAQIWDTAGQERYRAITSAYYRGAVGALLVYDITRHVTFENVARWLKELRDHTDQNIVVMLVGNKADLRHLRAVPTGESSGFAERENTFFMETSALEALNVENAFTEVLTQIYRVVSRKALDIGDDPTFVPRGQTINIGKDDVSAVKKGGCCSG

SEQ ID NO: 6462 - protein, 216 aa, Solanum phureja
MGAYRADEDYDYLFKVVLIGDSGVGKSNLLSRFTKNEFSQESKSTIGVEFATRTIHVDDKIIKAQIWDTAGQERYRAITSAYYRGAVGALLVYDITRHVTFENVARWLKELRDHTDQNIVVMLVGNKADLRHLRAVPTGESSGFAERENTFFMETSALEALNVENAFTEVLTQIYRVVSRKALDIGDDPTSVPRGQTINIGKDDVSAVKKGGCCSG

SEQ ID NO: 6463 - protein, 187 aa, Petunia hybrida
MGAYRADEDYDYLFKVVLIGDSGVGKSNLLSRFTKNEFSQESKSTIGVEFATRTIHVDDKIVKAQIWDTAGQERYRAITSAYYRGAVGALLVYDITRHVTFENVARWLKELRDHTDQNIVVMLVGNKADLRHLRAVPTGESSGFAERENTFFMETSALEALNVKNAFTEVLTQIYRVVSRKALEYRR

SEQ ID NO: 6464 - protein, 215 aa, Musa acuminata
MTYRADDDYDYLFKVVLVGDSGVGKSNLLSRFTRNEFSNESKATIGVEFATRSIRIDGKVVKAQIWDTAGQERYRAITSAYYRGAVGALVVYDITRNVTFENVERWLKELRDHTDTSIVIMLVGNKADVRHLRAATTEDATAFAERENTFFMETSALESTNVEAAFNEVLTQIYQVVSRKALEAGNDSTSLPKGQTINVGKDDVSAIKKVRCCST

SEQ ID NO: 6465 - protein, 233 aa, Euphorbia esula
MGAYRADDDYDYLFKVVLIGDSGVGKSNLLSRFTRNEFSLESKSTIGVEFATRSIHVDDKVVKAQICDTAGQERYRAITSAYYRGAVGALVVYDVTRRVTFENVERWLKELRDHTDSNIVIMLVGNKADLRHLRAVTTEDSTAFAEKENTFFMATSALESLNVENAFTEVLTQIYRVVSRKALDIGDDPTSLPKGQTIHVGKDDVSAVKKVGCCSASSFSFLKDLHFGDLELP

SEQ ID NO: 6466 - protein, 199 aa, Antirrhinum majus
MGAYRADDDYDYLFKLVLIGDSGVGKSNLLSRFARNEFSLESKSTIGVEFATRSIRVDEKVVKAQIWDTAGQERYRAITSAYYRGAVGALLVYDVTRHVTFENVERWLKELRAHTDSNIVIMLVGNKADLRHLRAVSTEDAKAFAERENTFFMETSALESMNVENAFTEVLTQIHRVVSRKALEAGDDPAALPKGQTIN

SEQ ID NO: 6467 - protein, 217 aa, Marchantia polymorpha
MAYRSDDDYDYLFKVVLIGDSGVGKSNLLSRFTRNEFSLESKSTIGVEFATRSINVDSKLIKAQIWDTAGQERYRAITSAYYRGAVGALLVYDITRHVTFENVERWLKELKDHTDSNIVVMLVGNKSDLRHLRAVSTDDGQSFSEKESLFFMETSALESTNVENAFKQILTQIYRVVSKKALDVGEDPSAGPGKGQTIQVGNKDEVTATKKVGCCSA

SEQ ID NO: 6468 - protein, 218 aa, Lippia dulcis
MAGGYRAEDDYDYLFKLVLIGDSGVGKSNLLSRFTRNEFSLESKSTIGVEFATRSIRVDDKIIKAQIWDTAGQERYRAITSAYYRGAVGALLVYDVTRHVTLENIERWLKELRDHTDENVVIMLVGNKADLRHLRAVSTEEATSFAEKEKTYFMETSALESMNVDSAFTEVLSQIYHVVSRKALDVGDDHATLPKGETIDIGSKDDVSVLKKVGCCSV

SEQ ID NO: 6469 - protein, 216 aa, Platanus occidentalis
MAAYRADDDYDYLFKVVLIGDSGVGKSNLLSRFTRNEFSLESKSTIGVEFATRSIRVDDKVIKAQSWDTAGQERYRAITSAYYRGAVGALLVYDVTRHVTFENVERWLKELRDHTDSNIVIMLVGNKADLRHLRAVSTEDAKAFAERESNFFMETSALESMNVENAFTEVLTQIYHVVSRKALEVGMTLRPCPRGRRSMWATKADVSAIKKSMLLH

SEQ ID NO: 6470 - protein, 216 aa, Pteridium aquilinum
MAYRSDDDYDYLFKVVLIGDSGVGKSNLLSRFTRNEFSLESKSTIGVEFATRSISVDGKTIKAQIWDTAGQERYRAITSAYYRGAVGALLVYDITRHVTFENVERWLKELKDHTDSNIVVMLVGNKSDLRHLRAVSTEDSQAFAEREGLYFMETSALESTNVENAFKQILTQIYRVVSKKALDIGEDPAAVPSQGQTISYGSNDVTATKKIGCCSA

SEQ ID NO: 6471 - protein, 218 aa, Eutrema halophilum
MGTYKAEDDYDYLFKVVLTGDSGVGKSNLLSRFTKNDFSHDSRSTIGVEFATRSIQVDDKIVKAQIWDTAGQERYRAITSAYYRGAVGALLVYDVTRHVTFENVERWLKELRDHTDANTVIMLVGNKADLCHLRAISMEEVKAFAEREHTFFMETSALEALNVENAFTEVLTQIYRVVSKKALDAGDDPATALPKGQLISVGSRDDVSAVKKSGCCST

SEQ ID NO: 6472 - protein, 218 aa, Eutrema parvulum
MGAYRAEDDYDYLFKVVLTGDSGVGKSNLLSRFTRNDFSHDSRATIGVEFATRSIQCDDKIVKAQIWDSAGQERYRAITSAYYRGAVGALLVYDVTRHVTFENVERWLKELRDHTDANIVIMLVGNKADLRHLRAISTEEAKAFAERENTFFMETSALEAVNVDNAFTEVLTQIYRVVSKKALEAGNDPTTALPKGQMINVGSRDDISAVKKPGCCSA

SEQ ID NO: 6473 - protein, 218 aa, Eutrema parvulum
MGTYKSEDDYDYLFKVVLTGDSGVGKSNLLSRFTKNDFSHDSRSTIGVEFATRSIQVDDKIVKAQIWDTAGQERYRAITSAYYRGAVGALLVYDVTRHVTFENVERWLKELRDHTDANTVIMLVGNKADLRHLRAISTEEVKAFAERENTFFMETSALEALNVENAFTEVLTQIYRVVSKKALEAGDDPTTALPKGQMINVGSRDDVSAIKKSGCCST

SEQ ID NO: 6474 - protein, 216 aa, Solanum lycopersicum
MGAYRADEDYDYLFKVVLIGDSGVGKSNLLSRFTKNEFSQESKSTIGVEFATRTIHVDDKIIKAQIWDTAGQERYRAITSAYYRGAVGALLVYDITRHVTFENVARWLKELRDHTDQNIVVMLVGNKADLRHLRAVPTGESSGFAERENTFFMETSALEALNVENAFTEVLTQIYRVVSRKALDIGDDPTSVPRGQTINIGKDDVSAVKNGGCCSG

SEQ ID NO: 6475 - protein, 193 aa, Pennisetum glaucum
LKSNLLSRFTRNEFSLESKSTIGVEFATRSIRVDDKVVKAQIWDTAGQERYRAITSAYYRGAVGALVVYDVTRHVTFENVERWLKELRDHTDANIVIMLVGNKADLRHLRAVSVEDAKGFAERESTFFMETSALEAMNVESAFTEVLTQIYRVVSKKALDIGDDPAAPPRGQTINVGGKDDVSAVKKSGCCSS

SEQ ID NO: 6476 - protein, 227 aa, Petroselinum crispum
MAAYRADDDYDYLFKLVLIGDSGVGKSNLLSRFTKNEFSLESKSTIGVEFATRTIKVDDKIVKAQIWDTAGQERYRAITSAYYRGAVGALLVYDVTRNITFENVERWLKELRDHTDANIVIMLVGNKADLRHLRAVTTETAKAYAEKEETFFMETSALESMNVESAFTEVLSQIYHVVSRKALEVGDDPAALPKGQTINVGSKDDVSAVKKLVAALPNYTSMASVSD

SEQ ID NO: 6477 - protein, 219 aa, Arachis hypogaea
MASYNRGDDDYDYLFKLVLIGDSGVGKSNLLSRFTRNEFNLESKSTIGVEFATRTITVDDNKVLKAQIWDTAGQERYRAITSAYYRGAVGALLVYDVTRHITFENVERWLKELRDHTDANIIVMLVGNKADLRHLRSVSTEDATAFAERENIFFMETSALESMNVDNAFTQVLTQIYRLMTRKALEAGNDPAGLPQGQTISVGNKDDVSAVKKVGCCSE

SEQ ID NO: 6478 - protein, 217 aa, Musa acuminata
MAYKADEDYDYLFKVVLIGDSGVGKTNLLSRFSRNEFSSESKSTIGVEFATRTIRVDEKLVKAQIWDTAGQERYRAITSAYYRGAAGALVVYDVTRHITFENVERWMKELKNHTDANTVMMLLGNKADLRHIRAVSVEDAQAFAQRERAFFMETSALESMNVETAFTEVLTQIYHVVSKKVLDLGDDPSAVPKGQTINIGADDDVQAAAKKTGCCAE

SEQ ID NO: 6479 - protein, 215 aa, Ambrosia trifida
MAAYRADDDYDYLFKLVLIGDSGVGKSNLLSRFAKNEFNLESKSTIGVEFATRSIRVDDKIVKAQIWDTAGQERYRAITSAYYRGAVGALVVYDTSRHVTFENVERWLKELRDHTDPNIVIMLVGNKADLRHLRAVPTEEAKTFAEKENIYFMETSALEALNVETAFTEVLTHIHQVVSRKALEAGEDPSALPKGQTINVGSKDDANKKVGCCSA

SEQ ID NO: 6480 - protein, 215 aa, Ambrosia trifida
MAAYRADDDYDYLFKLVLIGDSGVGKSNLLSRFAKNEFNLESKSTIGVEFATRSIRVDDKIVKAQIWDTAGQERYRAITSAYYRGAVGALVVYDTSRHVTFENVERWLKELRDHTDPNIVIMLVGNKADLRHLRAVPTEEAKRFAEKENIYFMETSALEALNVETAFTEVLTHIHQVVSRKALEAGEDPSALPKGQTINVGSKDDANKKVGCCSA

SEQ ID NO: 6481 - protein, 210 aa, Nicotiana benthamiana
MGAYRADDDYDYLFKVVLIGDSGVGKSNLLSRFSRNEFSLESKSTIGVEFATRSIRVEDKVVKAQIWDTAGQERYRAITSAYYRGAVGALLVYDVTRHVTFENVERWLKELRDHTDSNIVVMLVGNKADLRHLRAVSTEDAKAFAEKESTFFMETSALESMNVENAFTEVLTQIYRVVSRKALEAGDDPAALPKGQGRLLMSEIRMMFQQ

SEQ ID NO: 6482 - protein, 203 aa, Eutrema halophilum
MAAYRADDDYDYLFKVVLIGDSGVGKSNLLSRFTRNEFSLESKSTIGVEFATRSIHVDDKIVKAQIWDTAGQERSVACYDVTRHVTFENVERWLKELRDHTDSNIVIMFVGNKADLRHLRAVSTEDAKAFAERENTFFMETSALESLNVENAFTEVLSQIYRVVSRKALDLGDDPTALPKGQTINVGSKDDVSAVKKVGCCST

SEQ ID NO: 6483 - protein, 221 aa, Raphanus sativus
MATYTADDDYDFLYKVVLIGDSGVGKSNLLSRFTRNEFSLESKSTIGVEFATRTIHVDDKIVKAQIWDTAGQERYRAITSAYYRGALGALLVYDVTRHVTFENVERWLKELRDHTDANIVIMLVGNKADLRHLRAVSTEDATAFAEREKTFFMETSALEALNVEDAFTQLLSQIYRVASKRALDVGDGDDGDRSALPKGQSVDVGSKGDVSEVKKIGCCSS

SEQ ID NO: 6484 - protein, 219 aa, Cyclamen graecum
MTAAAYGADEDYDYLFKLVLIGDSGVGKSNLLSRFTKNEFNLESKSTIGVEFATRSIRVNDKIVKAQIWDTAGQERYRAITSAYYRGAVGALLVYDVTRNITFENVERWLRELRNHTDSNIVIMLVGNKADLRHLRAVPMEDAKAFAERENTFFMETSALESLNVENAFSEVLTQIYNVVSRKALEAGNDATSLPKGETINVGRKDDVSAMKKVGCCSE

SEQ ID NO: 6485 - protein, 217 aa, Gossypium hirsutum
MAAYRADDDYDYLFKVVLVGDSGVGKSNLLSRFTRNEFSLQSKSTIGVEFATRSIRVNDKIVKAQIWDTAGQERYRAITSAYYRGAVGALLVYDVTRRVTFENVQRWLKELRDHTDSSIVIMLIGNKADLRHLFAVTTDDAKAYAESENTFFMETSALESTNVEHAFTEVLTKIHHVISRKALEGGNDQTTLPKGQTINVGSRDDVSAVKKDGCCSA

SEQ ID NO: 6486 - protein, 215 aa, Ambrosia trifida
MAAYRADDDYDYLFKLVLIGDSGVGKSNLLSRFAKNEFNLESKSTIGVEFATRSIRVDDKIVKAQIWDTAGQERYRAITSAYYRGAVGALVVYDTSRHVTFENVERWLKELRDHTDPNIVIMLVGNKADLRHLRAVPTEEAKTFAEKENIYFMETSALEALNVETAFTEVLTHIHQVVSRKALEAGEDPSALPKGQTINLGSKDDANKKVGCCSA

SEQ ID NO: 6487 - protein, 204 aa, Cedrus atlantica
KVVLIGDSGVGKSNLLSRFTRNEFSLESKSTIGVEFATRSITVDDKVIKAQIWDTAGQERYRAITSAYYRGAVGALLVYDVTRHVTFENVERWLKELRDHTDANIVIMLVGNKADLRHLRAVSVEDGKAFAERENTYFMETSALESTNVENAFTEVLSQIYRIVSKKSLDVGEDPAAVPSKGQTIHVGNKDDVTAMKKVGCCSV

SEQ ID NO: 6488 - protein, 215 aa, Nicotiana benthamiana
MGAYRSEEDYDYLFKVVLIGDSGVGKSNLLSRFTKNEFSQQSKSTIGVEFATRTIHVDDKIIKAQIWDTAGQERYRAITSAYYRGAVGALLVYDITRNVTFENVARWLKELRDHTDQNIVVMLVGNKADLRHLRAVPTEDSKGFAERERTFFMETSALEALNVENAFTEVLTQIYRVVSKKALDAGDDPASLPAGQTINIGNDVSAVKKGGCCSG

SEQ ID NO: 6489 - protein, 215 aa, Podocarpus macrophillus
MAYKADDDYDYLFKVVLIGDSGVGKSNLLSRFTRNEFSLESKSTIGVEFATRSINVDGKMIKAQIWDTAGQERYRAITSAYYRGAVGALLVYDITRHVTFENVERWLKELRDHTEHNIVVMLVGNKSDLRHLRALSTEDAQTFAEREGLYFIETSALESTNVENAFKQVLTQIYRVVSKKALDASEDNSAAPPQGQTINVKDDVTATKKAGCCST

SEQ ID NO: 6490 - protein, 216 aa, Pteridium aquilinum
MAYRSDDDYDYLFKVVLIGDSGVGKSNLLSRFTRNEFSLETKSTIGVEFATRTINVDGKMVKAQIWDTAGQERYRAITSAYYRGAVGALLVYDLTRHVTFENVERWLKELKDHTDTNIVVMLVGNKSDLRHLRAVSTEDGQAFAEQESLYFIEASALESTNVENAFKQVLTQIYRVVSKKALDVGEDPSAVPSQGQTVNVGSNDVSATKKVGCCSA

SEQ ID NO: 6491 - protein, 215 aa, Solanum phureja
MGTYRSEEDYDYLFKVVLIGDSGVGKSNLLSRFTKNEFSQQSKSTIGVEFATRTIHVDDKIVKAQIWDTAGQERYRAITSAYYRGAVGALLVYDITRHVTFENVARWLKELRDHTDQNIVVMLVGNKADLRHLRAVPTDDSKGFAERENTFFMETSALEALNVENAFTEVLTQIYRVVSKKALDAGDDPASLPAGQTIHIGNDVSAVKKGGCCSG

SEQ ID NO: 6492 - protein, 201 aa, Fagopyrum esculentum
VLIGDSGVGKSNLLSRFTRNEFSLESKSTIGVEFATRSVRVDEKIVKAQIWDTAGQERYRAITSAYYRGAVGALLVYDVTRHVTFENVERWLKELRDHTETNIVIMLVGNKADLRHLRAVSTEDGKTFAEKENTFFMETSALESINVENAFTEVLTQIYNVVSRKALEIGGDPAALPKGQTIDISGKDDVSALKKDGCCSS

SEQ ID NO: 6493 - protein, 123 aa, Selaginella moellendorffii
MAYRSDEDYDYLFKVVLIGDSGVGKSNLLSRFTRNEFSLESKSTIGVEFATRSINVDGKLVKAQIWDTAGQESSCAGIGPSPAPTTAAPWEPYSSTTSPGPSRMKMWSAGSRSSKTTPIPTSW

SEQ ID NO: 6494 - protein, 216 aa, Abies balsamea
  Sequence also found in Organisms: Cedrus atlantica, Picea glauca
MAYKVDDDYDYLFKVVLIGDSGVGKSNLLSRFTRNEFSLESKSTIGVEFATRSINVDGKMIKAQIWDTAGQERYRAITSAYYRGAVGALLVYDITRHVTFENVERWLKELRDHTEHNIVVMLVGNKSDLRHLRAVSTEDAQTFAEREGLYFIETSALESTNVENAFKQVLTQIYRIVSKKALDVSEDNAAAPPQGQTINVKDDVTATKKVGCCSTS

SEQ ID NO: 6495 - protein, 207 aa, Brassica napus
FLYKVVLIGDSGVGKSNLLSRFTRNEFSLESKSTIGVEFATRSIRVDENVVKAQIWDTAGQERYRAITSAYYRGAVGAFLVYDVTRRVTFENVERWLKELRDHTDANIVCMLVGNKADLRHLRAVSTEDATAFAERESTFFMETSALEALNVEDAFTQVLSQIYRVASKKALDVGGDDHAALPKGQSINVGGKDDVSEVKKVGCCSS

SEQ ID NO: 6496 - protein, 201 aa, Centaurea maculosa
MGAYRAEDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDSNIVIMLVGNKADLRHLRAVQTEDATSFAEKEHTYFMETSALESLNVESAFTEVLTQIYQIVSRKALESGDDAAAVPKGQTINVD

SEQ ID NO: 6497 - protein, 215 aa, Cephalotaxus harringtonia
MAYKADDDYDYLFKVVLIGDSGVGKSNLLSRFTRNEFSLESKSTIGVEFATRSISVDGKMIKAQIWDTAGQERYRAITSAYYRGAVGALLVYDITRHVTFENVERWLKELRDHTEHNIVVMLVGNKSDLRHLRALSTEDAQTFAEREGLYFIETSALESTNVENAFKQVLTQIYRVVSKKALDASEDTAAAPPQGQSINVKDDVTATKKMGCCSM

SEQ ID NO: 6498 - protein, 217 aa, Gossypium raimondii
MAAYRVDDDYDYLFKVVLVGDSGVGKSNLLSRFTRNEFSLQSKSTIGVEFATRSIRVNDKIVKAQIWDTAGQERYRAITSAYYRGAVGALLVYDVTRRVTFENVQRWLKELRDHTDSSIVIMLIGNKADLRHLFAVTTDDAKAYAESENTFFMETSALESTNVEHAFTEVLTKIHHVISRKALEGGNDQTTLPKGQTINVGSRDDVSAVKKDGCCSA

SEQ ID NO: 6499 - protein, 215 aa, Solanum lycopersicum
MGTYRSEEDYDYLFKVVLIGDSGVGKSNLLSRFTKNEFSQQSKSTIGVEFATRTIHVDDKIVKAQIWDTAGQERYRAITSAYYRGAVGALLVYDITRHVTFENVARWLKELRDHTDQSIVVMLVGNKADLRHLRAVPTDESKGFAERENTFFMETSALEALNVENAFTEVLTQIYRVVSKKALDAGDDPASLPAGQTIHIGNDVSAVKKGGCCSS

SEQ ID NO: 6500 - protein, 218 aa, Cucumis sativus
MAGYRAEDDYDYLFKVVLIGDSGVGKSNLLSRFTKNEFSLESKSTIGVEFATRSLNVDGKVVKAQIWDTAGQERYRAITSAYYRGAVGALLVYDVTRHSTFENVERWLRELRDHTDPNIVVMLVGNKSDLRHLVAVSTEDGKSFAEKESLYFMETSALEATNVENSFAEVLTQIYHIVSKKAMEAGDGTAAASVPPKGEKIDVSKDVSAVKKAGCCSS

SEQ ID NO: 6501 - protein, 218 aa, Cucurbita pepo
MAGYRAEDDYDYLFKVVLIGDSGVGKSNLLSRFTKNEFSLESKSTIGVEFATRSLNVDSKVVKAQIWDTAGQERYRAITSAYYRGAVGALLVYDVTRHSTFENVERWLRELRDHTDPNIVVMLVGNKSDLRHLVAVSTEDGKSFAEKESLYYMETSALEATNVENAFAEVLTQIYHIVSKKAMEAGEDAAAASVPSKGEKIDVGKDVSAVKKGGCCSS

SEQ ID NO: 6502 - protein, 214 aa, Arabidopsis thaliana
MAGYRADDDYDYLFKVVLIGDSGVGKSNLLSRFTRNEFSLESKSTIGVEFATRSLNVNEKVIKAQIWDTAGQERYRAITSAYYRGAVGALLVYDVTRHSTFENVERWLRELRDHTDPNIVVMLVGNKSDLRHLVAVQTEDAKSFAENESLYFMETSALESTNVENAFSEVLTQIYHVVSKKAMEAGEDSGNVPSKGEKIDVDVSAVKKTGCCSN

SEQ ID NO: 6503 - protein, 214 aa, Arabidopsis lyrata
MAGYRADDDYDYLFKVVLIGDSGVGKSNLLSRFTRNEFSLESKSTIGVEFATRSLNVNEKVIKAQIWDTAGQERYRAITSAYYRGAVGALLVYDVTRHSTFENVERWLRELRDHTDPNIVVMLVGNKSDLRHLVAVQTEDAKSFAENESLYFMETSALESTNVENAFSEVLTQIYHVVSKKAMEAGQDSGNVPSKGEKIDVDVSAVKKTGCCSN

SEQ ID NO: 6504 - protein, 218 aa, Brassica rapa
MGAYKSEDDYDYLFKVVLTGDSGVGKSNLLSRFTKNDFSHDSRSTIGVEFATRSIQVDDKIVKAQIWDTAGQERYRAITSAYYRGAVGALLVYDVTRHVTFENVERWLKELRNHTDANIVIMLVGNKSDLRHLRAIPTEEVKAFAERENTFFMETSALEALNVESAFTEVLTQIYRVVSKNALEGGADPTTALPKGQVINVGSRDDVSAVKKAGCCST

SEQ ID NO: 6505 - protein, 208 aa, Centaurea maculosa
MAAYRADDDYDYLFKLVLIGDSGVGKSNLLSRFAKNEFNLESKSTIGVEFATRSIRVDDKIVKAQIWDTAGQERYRAITSAYYRGAVGALLVYDTSRHVTFENVERWLKELRDHTDANIVIMLVGNKSDLRHLRAVPTEEAKTFAEKENTYFMETSALEALNVETAFTEVLTQIYHVVSRKALDAANDASALPKGQTINVGSKDDVLL

SEQ ID NO: 6506 - protein, 216 aa, Pinus pinaster
  Sequence also found in Organisms: Pinus taeda
MAYKVDDDYDYLFKVVLIGDSGVGKSNLLSRFTRNEFSLESKSTIGVEFATRSINVDGKMIKAQIWDTAGQERYRAITSAYYRGAVGALLVYDITRHVTFENVERWLKELRDHTEHNIVVMLVGNKSDLRHLRAVSTEDAQTFAEREGLYFIETSALESTNVENAFKQVLTQIYRIVSKKALDVSEDNAAAPAQGQTINVKDDVTATKKVGCCSTS

SEQ ID NO: 6507 - protein, 216 aa, Pseudotsuga menziesii
MAYKVDDDYDYLFKVVLIGDSGVGKSNLLSRFTRNEFSLESKSTIGVEFATRSINVDGKMIKAQIWDTAGQERYRAITSAYYRGAVGALLVYDITRHVTFENVERWLKELRDHTEHNIVVMLVGNKSDLRHLRAVSTEDAQTFAEREGLYFIETSALESTNVENAFKQVLTQIYRIVSKKALDVSEDNAAAPSQGQTINVKDDVTATKKVGCCSTS

SEQ ID NO: 6508 - protein, 216 aa, Pteridium aquilinum
MAYRSDDDYDYLFKVVLIGDSGVGKSNLLSRFTRNEFSLESKSTIGVEFATRSISVDGKTIKAQIWDTAGQERYRAITSAYYRGAVGALLVYDITRHVTFENVERWLKELRDHTDSNIVVMLVGNKSDLRHLRAVSADDSQSFAEREGLYFMETSALESTNVENAFKQILTQIYRVVSKKALDIGEDPAAVPSQGQTISVNSNDVTATKKVGCCSA

SEQ ID NO: 6509 - protein, 216 aa, Selaginella moellendorffii
MAYRSEDDYDYLFKVVLIGDSGVGKSNLLSRFTRNEFSLESKSTIGVEFATRSINVDGKLIKAQIWDTAGQERYRAITSAYYRGAVGALLVYDVTRLATFENVERWLKELKDHTDSNIVVMLVGNKSDLRHLRCVSTEDGQAYSEKEGLYFMETSALESVNVENSFKQILTQIYRVVSKKALDVGEDPSAVPGKGQTINVSKDDVTATKKVGCCPE

SEQ ID NO: 6510 - protein, 217 aa, Cocos nucifera
MAGYRAEDDYDYLFKVVLIGDSGVGKSNLLSRFTRNEFNLESKSTIGVEFATRSLNVDGKVIKAQIWDTAGQERYRAITSAYYRGAVGALLVYDVTRHATFENAERWLRELRDHTDPNIVVMLVGNKSDLRHLVAVSTEDGKAFAERESLYFMETSALEATNVENAFAEVLTQIYRIVSKKAVEAGDDSASAVPSKGEKINVKDDVSALKRVGCCSS

SEQ ID NO: 6511 - protein, 217 aa, Cocos nucifera
MAGYRAEDDYDYLFKVVLIGDSGVGKSNLLSRFTRNEFSLESKSTIGVEFATRSLNVDAKVIKAQIWDTAGQERYRAITSAYYRGAVGALLVYDVTRHSTFENAERWLRELRDHTDPNIVVMLVGNKSDLRHLVAVSTEDGKAFAERESLYFMETSALEATNVENAFAEVLTQIYRIVSRKAVEAADDSASPVPSKGEKINVKDDVSALKRVGCCSS

SEQ ID NO: 6512 - protein, 218 aa, Gossypium raimondii
MAGYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIVVMLVGNKSDLRHLVAVSTEDGKSFAEKESLYFMETSALEATNVEIAFAEVLTQIYNVVSKKAMETSDDGAASAVPSKGEKIDVGKDVSAMKKGGCCSS

SEQ ID NO: 6513 - protein, 217 aa, Phalaenopsis aphrodite
MAAYRAEDDYDYLFKVVLIGDSGVGKSNLLSRFTRNEFSLESKSTIGVEFATRSVNVDGKVIKAQIWDTAGQERYRAITSAYYRGAVGALLVYDVTRHATFENAERWLRELRDHTDPNIIVMLVGNKSDLRHLVAVSTEDSKAFAEKESLYFMETSALEATNVENAFAEVLTQIYRIVSKKIIDSGDDGTSSVPGKGEKINVKDDVSALKKAGCCSS

SEQ ID NO: 6514 - protein, 216 aa, Eutrema parvulum
MAGYRADDDYDYLFKVVLIGDSGVGKSNLLSRFTRNEFSLESKSTIGVEFATRSLNVNEKVIKAQIWDTAGQERYRAITSAYYRGAVGALLVYDVTRHSTFENVERWLRELRDHTDPNIVVMLVGNKSDLRHLVAVQTEDAKSFAENESLYFMETSALESTNVENAFSEVLTQIYHVVSKKAMEAGDDPNSSNVPSKGEKIDIDVSAVKKTGCCSN

SEQ ID NO: 6515 - protein, 218 aa, Citrullus lanatus
MAGYRAEDDYDYLFKVVLIGDSGVGKSNLLSRFTKNEFSLESKSTIGVEFATRSLNVDGKVVKAQIWDTAGQERYRAITSAYYRGAVGALLVYDVTRHSTFENVERWLRELRDHTDPNIVVMLVGNKSDLRHLVAVSTEDGKSFAEKESLYFMETSALEATNVENSFAEVLTQIYHIVSKKAMEAGEGAAAASVPSKGEKIDVGKDVSAVKKAGCCSS

SEQ ID NO: 6516 - protein, 100 aa, Cucumis melo
MAGYRAEDDYDYLFKVVLIGDSGVGKSNLLSRFTKNEFSLESKSTIGVEFATRSLNVDQGCQGSDLGYCWPGKVSCDNQCLLPRCRWCTPCLRCHTTFHF

SEQ ID NO: 6517 - protein, 221 aa, Utricularia gibba
LDMAAGGYRAEDDYDYLFKLVLIGDSGVGKSNLLSRFTRNEFNLESKATIGVEFATRTIRVDEKVIKAQIWDTAGQERYRAITSAYYRGAVGALLVYDVTRHITFENVERWLKELRDHTDQNIVIMLVGNKADLRHLRAVSTEEGTAYAEKENVYFMETSALESLNVESAFTEVLTQIHHVVSRKALEIGSDSSALPTGQTINVGSRDDASGTKRTGCCSE

SEQ ID NO: 6518 - protein, 218 aa, Amorphophallus konjac
MAYRADDDYDYLFKVVLIGDSGVGKSNLLSRFARNEVQPGVQVHQSAWSSPPAASEVDDKVVKAQIWDTAGQERYRAITSAYYRGAVGALLVYDVTRHITFENVERWLKELRDHTDQNIVIMLVGNKADLRHLRAVPTADAQAFAERESTFFMETSALESMNVENAFREVLTQVYHVVSRKALDIGDDPSAVPRGQTINVGTKDDVSAVKKVGCCSVE

SEQ ID NO: 6519 - protein, 214 aa, Brassica rapa
MAGYKADDDYDYLFKVVLIGDSGVGKSNLLSRFTRNEFSLESKSTIGVEFATRSLTVNDKVIKAQIWDTAGQERYRAITSAYYRGAVGALLVYDVTRHSTFENVERWLRELRDHTDPNIVVMLVGNKSDLRHLIAVQTEDAKSFAENESLYFMETSALESTNVENAFSEVLTQIHQVVSKKAMEAGDDSGNVPSKGEKIDIDVSAVKKTGCCSS

SEQ ID NO: 6520 - protein, 216 aa, Cleome gynandra
MAGYRADDDYDYLFKVVLIGDSGVGKSNLLSRFTRNEFSLESKSTIGVEFATRSLTVDGKVIKAQIWDTAGQERYRAITSAYYRGAVGALLVYDVTRHSTFENVERWLRELRDHTDPNIVVMLVGNKSDLRHLVAVQTDDSKSFAEKESLYFMETSALESTNVENAFAEVLTQIYHIVSKKAMEANDEAANVPSKGEKIDVSKDVSAVKKGGCCSN

SEQ ID NO: 6521 - protein, 208 aa, Guizotia abyssinica
MGAYRADDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDSNIVIMLVGNKADLRHLRAVQSEDATSFAEKEHTYFMETSALESLNVENAFTEVLTQIYHIMSRKALDGGDDQAALPKGRRLMWVGRMTCQQ

SEQ ID NO: 6522 - protein, 215 aa, Sciadopitys verticillata
MAYKADDDYDYLFKVVLIGDSGVGKSNLLSRFTRNEFSLESKSTIGVEFATRSISVDGKMIKAQIWDTAGQERYRAITSAYYRGAVGALLVYDITRHVTFENVERWLKELRDHTEHNIVVMLVGNKSDLRHLRALSTEDAQTFAEREGLYFIETSALESTNVENAFKQVLTQIYRVVSKKALDASEDTATAPPQGQSINVKDEVTATRKVACCGT

SEQ ID NO: 6523 - protein, 111 aa, Brassica oleracea
MAEKSQIPDNNNSATPSSGKKPAAEVGSGSSYPGQKMPYPNRPESVNPDQATLREQWKFAIRQYSKWYSHAWGTAILAGGVFFGLGWIIKGSNPLPSLQSSSKHTKRDEDK

SEQ ID NO: 6524 - protein, 218 aa, Brassica oleracea
MGAYKSEDDYDYLFKVVLTGDSGVGKSNLLSRFTKNDFSHDSRSTIGVEFATRSIQVDDKIVKAQIWDTAGQERYRAITSAYYRGAVGALLVYDVTRHVTFENVERWLKELRNHTDANIVIMLVGNKSDLRHLRAIPTEEVKAFAERENTFFIETSALEALNVESAFTEVLTQIYRVVSKNALEGGVDPTTALPKGQVINVGSRDDASAVKKAGCCST

SEQ ID NO: 6525 - protein, 209 aa, Distylium racemosum
MMTMTIVKVVLIGDSGVGKSNLLSRFTRNEFSLESKSTIGVEFATRSINVDGKMIKAQIWDTAGQERYRAITSAYYRGAVGALLVYDITRHVTFENVERWLKELRDHTEHNIVVMLVGNKSDLRHLRGLSTEDAQTFAEKEGLYFIETSALESTNVENAFKQVLTQIYRVVSKKALDASEDASAVPPQGQTINVKDDVTATKKVGCCST

SEQ ID NO: 6526 - protein, 216 aa, Trifolium pratense
MGVTADEEYDYLFKLVLIGDSGVGKSNLLSRFTRNEFNLESKSTIGVEFATRSVKILDKLVKAQIWDTAGQERYRAITSAYYRGAVGALLVYDTTRHVTFENVERWLKELRDHTDASIVIMLVGNKADLRHLQAVSTEEATTFAEKENIYFMETSALESLNVDSAFVEVLTQIYNVVSKKALEKENGSASLPKGETINIGKDDVSEVKKSGCCSTA

SEQ ID NO: 6527 - protein, 227 aa, Brassica napus
MGAYRAEDDYDYLFKGVLTGDSGVGKSNLLSRFTRNDFSHDSRATIGVEFATRSIKCDDKIVKAQIWDTAGQERYRAITSAYYRGAVGALLVYDVTRHVTFENVERWLKELRDHTDANIVIMLVGNKADLRHLRAISTEDAKAFAERENTFFMETSALEALNVENAFTEVLTQIYRVVSKKALEAGDDPTTALPKGQTINVGGRDDISAVKNLVAALLRHTHLSLSL

SEQ ID NO: 6528 - protein, 217 aa, Eutrema halophilum
MGAYRADDDYDYLFKLVLIGDSGVGKSNLLSRFTRNEFSIESKSTIGVEFATRSVHVDEKIIKAQLWDTAGQERYRAITSAYYRGAVGALLVYDITRHVTFENVERWLKELRDHTDANVVIMLVGNKADLRHLRAVPTEEARSFSERENMFFMETSALDATNVEQAFTHVLTQIYRVMSRKALDGTGDPTSLPKGQTIDIGSKDDVTAVKSSGCCSG

SEQ ID NO: 6529 - protein, 218 aa, Gossypium hirsutum
MAGYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIVVMLVGNKSDLRHLVAVSTEDGKSFAEKESLYFMETSALEATNVEIAFAEVLTQIYNIVSKKAMETSDDGAASAVPSKGEKIDVGKDVSAMKKGGCCSS

SEQ ID NO: 6530 - protein, 218 aa, Aristolochia fimbriata
MASYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHATFENVERWLKELRDHTDPNIVVMLIGNKSDLRHLVAVSTEDGKAFAEKESLYFMETSALEATNVDNAFAEVLTQIYRIVSKKAVETGDEGAAAAVPSKGERINVKDDVSALKKVGCCST

SEQ ID NO: 6531 - protein, 218 aa, Theobroma cacao
MAGYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIVVMLIGNKSDLRHLVAVSTEDGKSFAEKESLYFMETSALEATNVENAFAEVLTQIYHIVSKKAMETGDEGAASAVPSKGEKIDVSKDVSAMKKGGCCSS

SEQ ID NO: 6532 - protein, 218 aa, Helianthus annuus
MAHFCRDDDYDYLFKVVLIGDSGVGKTNLLSRFSKNEFNMECKSTIGVEFATRSIEVDDKIIKAQIWDTAGQERYRAITSAYYRGAVGALIVYDITRHVTFENVERWLKELRDHTDQNIVIMLVGNKADLRHLRAIQMDDAKLFAERENNFFMETSALESLNVENAFTELLTQIYHVVSKRALEVGSDPMVPSRGQTINVGGKDDSPAAVKKNEGCCS

SEQ ID NO: 6533 - protein, 1217 aa, Ananas comosus
MLTKFETKSNRVKGLSFHSKRPWILTSLHSGVIQLWDYRMGTLIDRFDEHDGPVRGVHFHKSQPLFVSGGDDYKIKVWNYKTHRCLFTLLGHLDYIRTVQFHDEYPWIVSASDDQTIRIWNWQSRTCISVLTGHNHYVMCASFHPKEDLVVSASLDQTVRVWDIGALRKKTVSPADDMLRLSQMNTDLFGGVDAVVKYVLEGHDRGVNWASFHPSLPLIVSGADDRQVKIWRMNDTKAWEVDTLRGHMNNVSCVMFHAKQDIIVSNSEDKSIRIWDATKRTGIQTFRREHDRFWILAAHPEMNLLAAGHDSGMIVFKLERERPSFSVSGDTMYYVKDRFLRFYEFSSQKDNQVVSIRRPGSMSLNQGPRTLSYSPTENAVLICSDVDGGSYELYIIPKESVGRSDYMQDAKKGAGGSAVFVARNRFAVLDKSSNQALVKNLKNEIVKKGTLPVATDAIFYAGTGNLLCKAEDRVVIFDLQQRIVLGELQTPSVKYIVWSSDMESVALLSKHAIVIANKKLVHRCTLHETIRVKSGAWDENGVFIYTTLNHIKYCLPNGDSGIIKTLDVPVYITKVSGSNIYCLDREGKNRVISIDASEYIFKLALFRKRYDHVMSMIKNSQLCGQAVISYLQQKGFPEVALHFVKDERTRFNLALESGNIQIAVASAKEIDEKDHWYRLGIEALRQGNTSIVEYAYQRTKNFERLSFLYLVTGNIEKLSKMLRIAEIKNDIMGQFHNAMYLGDIRERVKILENAGHLPLAYVTAATHGLTEISERLAAELGDKVPSLPEGKARSLLMPPAPLTSSGDWPLLRVMRGVFEGGLDVIGRAEEEEEEEGAGADWGEEELDIVDVERVIQNGDITAEDDEAEQNEENEEEGGWDLEDLELPPEIDTPKASSNVRSLFVAPSPGMPVSQIWINKSSLAGEHAASGNFDTAMRLLNRQLGIKNFAPLKPLFMDLHMGSHTYLRAFAMASVISIAVEKGWSESASPNVRNPPALVFKFSQMDEKLKAAYRATTEGKFPEALRLFLNILHIVPLIVVDSRREVDEVKELIEIAREYVLGLKMEVKRKELKDDLVRQQELAAYFANSKLQKIHMRLVLTSAMTICFKGGNYATAAHFARMLLEGSPNEAQAKKARQVLQACGDRKDANQLNYDYRNPFVVCGATFVPIYRGQKDVSCPYCASRFVPSIAGQLCSVCELAVVGADASGLLCFAAQTR

SEQ ID NO: 6534 - protein, 1216 aa, Phalaenopsis aphrodite
MLTKFETKSNRVKGLSFHSKRPWILASLHSGVIQLWDYRMGTLIDRFDEHDGPVRGVHFHKSQPLFVSGGDDYKIKVWNYKTHRCLFTLLGHLDYIRTVQFHDEYPWIVSASDDQTIRIWNWQSRTCISVLTGHNHYVMCASFHPKEDLIVSASLDQTVRVWDIGALRKKTVSPADDILRLSQMNTDLFGGVDAVVKYVLEGHDRGVNWASFHPNLPLIVSGADDRQVKLWRMNDSKAWEVDTLRGHMNNVSCVMFHAKQDIIVSNSEDKSIRIWDATKRTAIQTFRREHDRFWILSAHSEMNLLAAGHDSGMIVFKLERERPAFSVVGDCLYYVKDRFLRFYEFSSQKDNQVVPIRRPGSVSLNQGPRTLSFSPTENAVIICSDADGGTYELYIVPKDNSGRTDVVQDAKKGGGGSAVFVARNRFVVLDKSTNLAVVKNLNNEIVKKSPLPIVTDAIFYAGTGNLLCRAEDKVVIFELQQRLILGELQVPAVKYIVWSSDMETVALLSKHVIVIASKKLVHRCTLHETIRVKSGAWDENGVFIYTTLNHIKYCLPNGDNGIIRTLDVPIYLTKVSGNSVFCLDRDGKNRIITIDATEYIFKLALLRKKFDHVMSMIKNSQLCGQAVIAYLQQKGFPEVALHFVKDERTRFNLALESGNIQIAVASAKEIDEKDHWYRLGIEALRQGNTGIVEYAYQRTKNFERLSFLYLVTGNKEKLSKMLRIAEMKNDVMGQFHNAMYLGDIQERVKILEKTGHLHLAFITASTHGLIETAERLAAELGDDIPAIPKEKTRSLLLPPVPLLNGGDWPLLRVMRGIFEGGLDIANKSGYDDVEEEVSGADWGDEDLDIVDVERVIQNGDGDAEVDNVEATEENGGWDLEDLELPAEVASPVATSNSRASVFVAPTQGMSVSQIWTQKSSLAGEHAAAGNFDTALRLLNRQLGINNFTPLKPIFLELYTGSHTYLPAFTAAPVISVAVEKGWTESTSPNVRSPPSLVFKFSQLDEKLKAAYRATTEGKFPEALRLFLNILHIIPIIVVDSRREVDEVKELIEIAKEYVLGLKIEVKRKEIKDDVIRQQELAAYFTNCKLQKVHTRLVLTSAMTICFKGGNYATATHFARMLLESSPTDAQAKKARQVLQACGDRKDAHQLNYDYRNPFVVCGATFVPIYRGQKDVSCPYCGARFIPTIQGKLCTVCEIAVVGADASGLLCSSTQLR

SEQ ID NO: 6535 - protein, 1224 aa, Allium cepa
MLTKFETKSNRVKGLSFHPKRPWILASLHSGVIQLWDYRMGTLIDRFDEHDGPVRGVHFHKSQPLFVSGGDDYKIKVWNYKTHRCLFTLLGHLDYIRTVQFHDEYPWIVSASDDQTIRIWNWQSRTCISVLTGHNHYVMCASFHPKEDLLVSASLDQTIRVWDTSALRKKSVSPADDVMRLSQMNSDLFGGVDAVVKYVLEGHDRGVNWASFHPNLPLIVSGADDRQVKLWRMNDTKAWEVDTLRGHMNNVSCVMFHAKQDVIVSNSEDKSIRIWDATKRTGIQTFRREHDRFWIMAAHPEMNLLAAGHDSGMIVFKLERERPAFSVSGDVLYYVKDRFLRFYEFSSQRDNQVVPIRRPGSVSLNQSPRTLSYSPTENAVLICSDIDGGSYELHIVPKDTSGRGGDFMQDAKKGAGASAIFVARNRFAVLDRSTNQVLVKNLKNEVVKRSALPIATDAIFYAGTGSLLCRAEDRVVIFDLQQRIVLGELQTPSVKYIVWSTDMESVALLSKHAIVIANKKLSHRCTLHETIRVKSGAWDENGVFIYTTLNHIKYCLPNGDNGIIKTLDVPIYLTKVIGNTLFCLDRDGKNRAITIDATEYIFKLALLKKRYDHVMSMIRNSQLCGQAVIAYLQQKGFPEVALHFAKDERTRFNLALESGNIQIAVASAKEIDEKDHWYRLGIEALRQGNTSIVEYAYQRTKNFERLSFLYLITGNREKLSKMLKIAEMKNDVMGQFHNAMYLGDVEERVKILENAGHLPLAYVTAKTHGLSEIADKLGAELESKGIVPTIPEGKTSSLLMPPAPLLCSGDWPLLRVMRGIFEGGLDSNVGRGGDEDEYEGANADWGEEDLDIVDVADAVQDGDVNAEVDDIEGHGEEDDVEGGWDLEDLELPADVDASRASNARASSVFVAPTAGMPVSQIWIQKSSFAGEHAAAGNFDTAMRLLSRQLGIRNFAPLKPLFKEMHLGSHTYLDAFASAPQFSTALERGWSESASPNVRGPPALVFKFSQMDEKLKAAYRATTEGKFPEALRLFLSILHTIPLIVVDSRREVDEIKELIDIAKEYVLGLKIEVNRKELPREDVVRQQELAAYFTNCKLQKGHARLVLTSAMNICYKGGSYSNAANFARMLLENNPPGNQAERIRRVLAACSDKVDTVQLNYDFRNPFVVCGATFVPIYRGQKDVSCPYCGAHFVPAYEGQICAICELAVVGADASGLLCSPTQRR

SEQ ID NO: 6536 - protein, 411 aa, Cleome spinosa
ARGKIHCSLKARFSSPSSGYKSGLSKGRPPFEALTLWNKLKEQSRQSLLKLVGILACTFLIVPSVDAVDALKTCACLLKECRIELAKCISNPSCAANVACLQTCNNRPDETECQIKCGDLFENSVVDEFNECAVSRKKCVPRKSDLGEFPAPDPAVLVKRFNIGDFSGKWYISSGLNPTFDTFDCQLHEFHTESDKLVGNLSWRIRTPDGGFFTRSTVQKFVQDPNQPGILYNHDNEYLHYQDDWYILSSKVENGPDDYVFVYYRGRNDAWDGYGGAVVYTRSAVLPNNIVPELERAAKSVGRDFSKFIRTDNTCGPEPPLVERIEKTVEEGERTIIREVEQIEGEVAKVGETEMTLLQRLVEGFKELKQDEENFLQGLNKEEMELLSELKMEASEVEKLFGKALPIRKLR

SEQ ID NO: 6537 - protein, 228 aa, Carica papaya
MARGKIEIKRIENTTNRQVTFCKRRNGLLKKAYELSVLCDAEVALIVFSSRGRLYEYANNSVKATIERYKKACSDATNPGSVTEANTQFYQQEATKLRRQIREIQNSNRHILGEALGSLTFKELKNLEGRLEKGISRIRSKKNELLFAEIEYMQKREIELQNDNMYLRAKIAENERVQEQQQSNLMQGSVYESMPSQSQTYNRNFLPVNLLEPNHQYSADDHTALQLV

SEQ ID NO: 6538 - protein, 144 aa, Olea europaea
MSFRGGANALSGMGVADHSKSTYMELQRKKAYRYVIFKIDEKKKEVIVEKTGSPAEGYDDFTASLPENDCRYAVYDFDYVTSENCQKSKIFFIAWSPSVSQIRAKMLYATSKERFRRELQGIHYEIQATDPTEMDLDVIKERAN

SEQ ID NO: 6539 - protein, 143 aa, Petunia hybrida
MSFRGKNATSGMGVADHSKATYMELQRKKVHRYVIFKIDEKKNEVVVEKTGGPAESYDDFTAALPENDCRYAVYDFDFVTSDNCQKSKIFFFAWSPSVSRIRSKMLYATSKDRFRRELEGIHYEIQATDPTEVEIEVLRERAN

SEQ ID NO: 6540 - protein, 146 aa, Theobroma cacao
MSFRGLSRPNATSGMGVADHSKDTFLELKRKKVYRYVIFKIDEKKREVVVEKTGGPVESYDDFTASLPENDCRYAVYDFDFVTSENCQKSKIFFIAWSPSSSRIRAKMLYATSKDRFRRELDGIHYEIQATDATEMDLEVLRDRAH

SEQ ID NO: 6541 - protein, 146 aa, Jatropha curcas
MSFRGLSRPNATSGMGVADHSINTFLELQRKKVHRYVVFRIDEKKKEVVVEKTGGPAESYEDFAASLPENDCRYAVYDFDFVTSENCQKSKIFFIAWSPSTSRIRAKMLYATSKDRFRRELDGIHYEIQATDPTEMDLEVIRERAN

SEQ ID NO: 6542 - protein, 145 aa, Coffea canephora
MSFRIRGQNATSGMGVADHSKDAFLELKRKKAYRYVIFKIDEKKKEVVVEKTGNPAESYDDFTASMPENDCRYAVYDFDFVTSENCQKSKIFFIAWSPAISRIRAKMLYATSKERFKRELDGIHYEIQATDPTEMDLEVIRDRAN

SEQ ID NO: 6543 - protein, 146 aa, Manihot esculenta
MSFRGLSRPNATSGMGVADHSINTFLELQRKKVHRYVVFKIDEKKKEVVVEKTGGPAESYEDFTASLPENDCRYALYDFDFVTAENCQKSKIFFIAWSPSTSRIRAKMLYATSKERFRRELDGIHYEIQATDPTEMDLEVLRDRAN

SEQ ID NO: 6544 - protein, 146 aa, Euphorbia peplus
MSFRGLSRPNATSGMGVADHSMNTFTELQRKKVHRYVVFKIDEKKKEVVVEKIGGPAENYDDFSASLPENDCRYAIYDFDFVTSENCQKSKIFFIAWSPSTARIRAKMLYATSKDKFRRELDGIHYEIQATDPTEMDLEVLRERAN

SEQ ID NO: 6545 - protein, 144 aa, Euphorbia esula
FRGLSRPNATSGMGVADHSLNTFTELQRKKVHRYVVFKIDEKKKEVVVEKIGGPAENYDDFSASLPENDCRYAIYDFDFVTSENCQKSKIFFIAWSPSTARIRAKMLYATSKDKFRRELDGIHYEIQATDPTEMDLEVLRERAN

SEQ ID NO: 6546 - protein, 145 aa, Utricularia gibba
MSFRWGVRNAISGMGVADDTKTTYMELQRKKVYRYVIFKIDEKKKEVVVEKTGNPAENYEDFTASLPESDCRYAVYDFDFVTSDKCQKSKIFFIAWSPSVSRIRSKMLYATSKERFRRELEGVHYEIQATDPTEMDMDVIKERAN

SEQ ID NO: 6547 - protein, 146 aa, Ricinus communis
MSFRGISRPNATSGMGVADHSINTFLELQRKKVHRYVVFKIDEKKKEVVVEKTGGPAESYEDFAASLPDNDCRYAVYDFDFVTSENCQKSKIFFFAWSPSTSRIRAKMLYATSKDRFRRQLDGIHYEIQATDPTEMDLEVLRDRAN

SEQ ID NO: 6548 - protein, 146 aa, Citrus clementina
  Sequence also found in Organisms: Citrus sinensis
MSFRGLSRPNATSGMGVADHSKNAFTELQRKKVHRYVIFKIDEKKKEVVVEKTGGPAESYEDFAAALPENDCRYAVYDFDYVTSENCQKSKIFFIAWSPSTSRIRAKMLYATSKDRFRRELDGIHYEIQATDPTEMDLEELRNRAN

SEQ ID NO: 6549 - protein, 146 aa, Hevea brasiliensis
MSFRGLSRPNATSGMGVADHSINTFLELKRKKVHLYVVFKIYEKKKEVVVEKTGGPAESYEDFTASLPENDCRYAVYDFDFVTSENCQKSKIFFIAWSPSTSRIRAKMLYATSKDRFRRELDGIHYEIQATDSTEMDLEVLRDRAN

SEQ ID NO: 6550 - protein, 132 aa, Eutrema parvulum
MGVADQSKTTYHELQRKKTHRYVVFKIDEAKKEVVVEKTGNPAESYDDFLASLPDNDCRYAVYDFDFVTSENCQKSKIFFVAWSPSTSRIRAKMLYATSKDRFRRELQGIHYEIQATDPTEVDLEVLRERAN

SEQ ID NO: 6551 - protein, 132 aa, Lippia dulcis
MGVADESKSTYMELQRKKVHRYVIFKIDEKKKEVVVEKTGTPAENYDDFTSSLPENDCRYAVYDFDYVTSENCQKSKIFFIAWSPSSSRIRSKMLYATSKERFRRELQGIHYEIQATDPTEMELDVIKERAN

SEQ ID NO: 6552 - protein, 143 aa, Liriodendron tulipifera
MSFRMSSAPSGMGVADHSKAAFMELKRKKVYRYVIFKIDEQKREVLVEKTGGPAESYDDFTAALPENDCRYAVYDFDFVTAENCQKSKIFFIAWSPSISRIRAKMLYATTKERFRRELDGIHYEIQATDPTEMDMDVIRDRAN

SEQ ID NO: 6553 - protein, 146 aa, Eutrema halophilum
MAFRGLSKPNATSGMGVADQSKTTYHELQRKKTHRYVVFKIDEAKKEVVVEKTGNPAESYDDFLASLPDNDCRYAVYDFDFVTSENCQKSKIFFVAWSPSTSRIRAKMLYATSKDRFRRELQGIHYEIQATDPTEVDLEVLRERAN

SEQ ID NO: 6554 - protein, 145 aa, Capsicum annuum
MSFRIKGANAPSGMGVADQSKATYMELQRKKVHRYVIFKIDEKKNEVVVEKTGCPAESYDDFTAALPENDCRYAVYDYDFVTPDNCQKSKIFFFAWSPSVSRIRSKMLYATSKDRFRRELEGIHYEIQATDPTEVELEVLKERAY

SEQ ID NO: 6555 - protein, 146 aa, Castanea mollissima
MSFRWLSRPNALSGMGVADHTKNTFLELKRKKVHRYVIFKVDEGKKEVVVEKTGGPAESYDDFTAALPENDCRYAVYDYDFVTSDNCQKSKIFFIAWAPSSSRIRAKMLYATSRDRFRRELDGVHYEIQATDPTEMDLEVIKDRAH

SEQ ID NO: 6556 - protein, 146 aa, Cleome spinosa
MSFRGFSRPNAASGMGVSDQSKSTYMELQRKKGHRYIVFKIDENKKEVMVEKTGAASESFDDFVGSLPENDCRYAVYDFDFVTSENCQKSKIFFIAWSPSTSRIRAKMLYATSKDRFRRELEGIHYEIQATDPSEVDLEALRERAN

SEQ ID NO: 6557 - protein, 146 aa, Gossypium hirsutum
MSFRGFSRPNATSGMGVADQTKDTFLELKRKKVYRYVIYRIDEKKREVVVEKTGAPAETYDDFAASLPETDCRYAVYDFDFVTSENCQKSKIFFIAWCPSSSRIRAKMLYATSKDRLRRELDGIHYEIQATDPTEMDLEVVRDRAH

SEQ ID NO: 6558 - protein, 146 aa, Gossypium raimondii
MSFRGFSRPNATSGMGVADQTKDTFLELKRKKVYRYVIYRIDEKKREVVVEKTGAPAETYDDFAASLPETDCRYAVYDFDFVTSENCQKSKIFFIAWCPSSSRIRAKMLYATSKDRLRRELDGIHYEIQATDPTEMDLEVLRDRAH

SEQ ID NO: 6559 - protein, 146 aa, Fagus grandifolia
MSFRWLSRPNALSGMGVADHTKNTFLELKRKKVHRYVIFKVDENKKEVVVDKTGGPAESYDDFTAALPENDCRYAVYDYDFVTSDNCQKSKIFFIAWAPSSSRIRAKMLYATSRDRFRRELDGVHYEIQATDPTEMDLEVIKDRAH

SEQ ID NO: 6560 - protein, 132 aa, Eucalyptus grandis
MGISDHSKSTFMDLKRKRVHRYVIFQIDEKKKEVVVEKTGGPAESYEDFTAALPQNDCRYAVYDYDFVTSDNCQKSKIFFIAWSPSTSRIRAKMLYATSRERFRRDLDGIHYEIQATDPTEMDLEVIKERAN

SEQ ID NO: 6561 - protein, 146 aa, Raphanus sativus
MSFRGLSKPNATSGMGVADQSKTTYHELQRKKTHRYVVFKIDELKNQVVVEKTGNPAESYDDFLASLPDNDCRYAVYDFDFVTSENCQKSKIFFVAWSPSTSRIRAKMLYATSKERFRRELQGIHYEIQATDPTEVDLDVLRERAN

SEQ ID NO: 6562 - protein, 146 aa, Glycine max
MSFRGLSRPNATSGMGVADHSKNTFMELKQKKVHRYVIFKVDEKKREVVVEKTGGPAESYDDFAASLPENDCRYAVFDYDFVTSENCQKSKIFFIAWSPSTSRIRAKMLYATTKDRFRRELDGVHYEIQATDPTEMDLEVLRDRAH

SEQ ID NO: 6563 - protein, 831 aa, Zea mays
MEAFGGFFVDEKAARVENIFLEFLKRFKESDGAGEPFYEAEMEVMRSRESTTMYVDFAHVMRFNDVLQKAISEEYLRFEPYLRNACKRFALEHRAGENRAPLISDDSPNKDINIAFYNIPMLKKLRELGTAEIGKLTSVMGVVTRTSEVRPELLQGTFKCLDCGNVVKNVEQQFKYTEPIICVNATCQNRTKWALLRQESKFTDWQRVRMQETSKEIPAGSLPRSLDVILRHEIVEKARAGDTVIFTGTVVAVPDVMALTSPGERAECRREAPQRKNGGVQEGVKGLKSLGVRDLSYRLAFVANSVQVADGRREVDIRERDTDGDDSERQKFTEEEEDEVVRMRNTPDFFNKIVDSICPTVFGHQEIKRAVLLMLLGGVHKITHEGINLRGDINVCIVGDPSCAKSQFLKYTAGIVPRSVYTSGKSSSAAGLTATVAKEPETGEFCIEAGALMLADNGVCCIDEFDKMDIKDQVAIHEAMEQQTISITKAGIQATLNARTSILAAANPTGGRYDKSKPLKYNVALPPAILSRFDLVYIMIDEPDENTDYHIAHHIVRVHQKREEALAPAFSTAQLKRYISFAKSLKPQLSSEAKKVLVESYVTLRRGDSTPGTRVAYRMTVRQLEALIRLSEAIARSHLERVVLPAHVRLAVKLLKTSIISVESSEVDLSDFQDAEDGTNVPSESDAGQPAEEDAAPQQQGAENDQAADNGKKKLVITEEHFQRVTQALVMRLRQHEESVKKDGDGLAGMKQGDLIIWYVEQQNAKGAYSSTAEVKEEVKCIKAIIERLIQREGHLIVIDEGTAAAAEDGSGARRTSESRILAVNPNYVID

SEQ ID NO: 6564 - protein, 830 aa, Zea mays
MEAFGGFFVDEKAVRVENIFLEFLKRFKESDGAGEPFYEAEMEAMRSRESTTMYVDFAHVMRFNDVLQKAISEEYLRFEPYLWNACKRFVLEHRAGENRAPIISDDSPNKDINIAFYNIPMLKKLRELGTAEIGKLTAVMGVVTRTSEVRPELLQGTFKCLDCGNVVKNVEQQFKYTEPIICVNATCQNRTKWALLRQESKFTDWQRVRMQETSKEIPAGSLPRSLDVILRHEIVEKARAGDTVIFTGTVVAVPDVMALTSPGERAECRREAPQRKMGGVQEGVKGLKSLGVRDLSYRLAFVANSVQVADGRREGDIRDRDTDGDDSERQKFTEEEEDEVVRMRNTPDFFNKIVDSICPTVFGHQEIKRAVLLMLLGGVHKITHEGINLRGDINVCIVGDPSCAKSQFLKYTAGIVPRSVYTSGKSSSAAGLTATVAKEPETGEFCIEAGALMLADNGICCIDEFDKMDIKDQVAIHEAMEQQTISITKAGIQATLNARTSILAAANPTGGRYDKSKPLKYNVALPPAILSRFDLVYIMIDEPDENTDYHIAHHIVRVHQKREEALAPAFSTAQLKRYISFAKSLKPQLSSEAKKVLVESYVTLRRGDSTPGTRVAYRMTVRQLEALIRLSEAIARSHLERVVLPAHVRLAVKLLKTSIISVESSEVDLSDFQDAEDGTNVPSENDAGQPAEEGAAPQQQDAENDQAADNGKKKLVITEEHFQRVTQALVMRLRQHEESVKKDGDGMAGMKQGDLIIWYVEQQNAKGAYSSTAEVKEEVKCIKAIIERLIQREGHLIVIDEGTAATAEDGSRSRTSESRILAVNPNYVID

SEQ ID NO: 6565 - protein, 831 aa, Setaria italica
MEAFGGFFVDEKATRVENIFLEFLKRFKESDGAPEPFYETEMEAMRSRESTTMYVDFAHVMHFNDILQKAIAEEYLRFEPYLRNACKRFVLEHRAGENRAPIISDDSPNKDINVAFYNIPMLKKLRELGTAEIGKLTSVMGVVTRTSEVRPELLQGTFKCLDCGNVVKNVEQQFKYTEPIICVNATCQNRSKWALLRQESKFTDWQRVRMQETSKEIPAGSLPRSLDVILRHEIVEKARAGDTVVFTGTVVAVPDVMALTSPGERAECRREAPQRKSGGVQEGVKGLKSLGVRDLSYRLAFVANSVQVADGRREVDIRDRDTDGDDSERQKFTEEEEDEVVRMRNTPDFFNKIVDSICPTVFGHQEIKRAVLLMLLGGVHKVTHEGINLRGDINVCIVGDPSCAKSQFLKYTAGIVPRSVYTSGKSSSAAGLTATVAKEPETGEFCIEAGALMLADNGICCIDEFDKMDIKDQVAIHEAMEQQTISITKAGIQATLNARTSILAAANPTGGRYDKSKPLKYNVALPPAILSRFDLVYIMIDEPDENTDYHIAHHIVRVHQKREEALAPAFSTAELKRYIAFAKSLKPQLSSEAKKVLVESYVTLRRGDSTPGTRVAYRMTVRQLEALIRLSEAIARSHLERTVLPAHVRLAVKLLKTSIISVESSEVDLSDFQDAEDGTNVPSDNDAGQPAEADAAPQQQGAENDQAADNGKKKLVITEEHFQRVTQALVMRLRQHEESIMKDGDGLAGMKQGDLIIWYVEQQNAKGAYSSTAEVKEEVKCIKAIIERLIQREGHLIVIDDGAAAAAEDGAGARRTSESRILAVNPNYVID

SEQ ID NO: 6566 - protein, 831 aa, Panicum virgatum
MEAFGGFFVDEKAARVENIFLEFLKRFKEPEGAPEPFYEMEMEAMRSRESTTMYVDFAHVLRFNDILQKAIAEEYLRFEPYLRNACKRFVLEHRASENRAPIISDDSPNKDINIAFYNIPMLKRLRELGTAEIGKLTSVMGVVTRTSEVRPELLQGTFKCLDCGNVVKNVEQQFKYTEPIICVNATCQNRSKWALLRQESKFTDWQRVRMQETSKEIPAGSLPRSLDVILRHEIVEKARAGDTVIFTGTVVAVPDVLALTSPGERAECRREAPQRKNGGVQEGVKGLKSLGVRDLSYRLAFVANSVQVADGRREVDIRDRDTDGDDSERQKFTEEEEDEVVRMRNTPDFFNKIVDSICPTVFGHQEIKRAVLLMLLGGVHKITHEGINLRGDINVCIVGDPSCAKSQFLKYTAGIVPRSVYTSGKSSSAAGLTATVAKEPETGEFCIEAGALMLADNGICCIDEFDKMDIKDQVAIHEAMEQQTISITKAGIQATLNARTSILAAANPTGGRYDKSKPLKYNVALPPAILSRFDLVYIMIDEPDETTDYHIAHHIVRVHQKREEALAPAFSTAELKRYIAFAKSLKPQLSSEAKKVLVDSYVTLRRGDSTPGTRVAYRMTVRQLEALIRLSEAIARSHLERTVLPAHVRLAVKLLKTSIISVESSEVDLSEFEDAEDGTNVPSDNDAGQPAEADAAPQQEGAENDQAADNGKKKLVITEEYFQRITQALVMRLRQHEESIMKDGDGLAGMKQGDLIIWYVEQQNAKGAYSSTAEVKEEVKCIKAIIERLIQREGHLIVIDEGTAAAAEDGAGARRTSESRILAVNPNYVID

SEQ ID NO: 6567 - protein, 489 aa, Panicum virgatum
MRNTPDFFNKIVDSICPTVFGHQEIKRAVLLMLLGGVHKITHEGINLRGDINVCIVGDPSCAKSQFLKYTAGIVPRSVYTSGKSSSAAGLTATVAKEPETGEFCIEAGALMLADNGICCIDEFDKMDIKDQVAIHEAMEQQTISITKAGIQATLNARTSILAAANPTGGRYDKSKPLKYNVALPPAILSRFDLVYIMIDEPDENTDYHIAHHIVRVHQKREEALTPAFSTAELKRYIAFAKSLKPQLSSEAKKVLVESYVTLRRGDSTPGTRVAYRMTVRQLEALIRLSEAIARSHLERTVLPAHVRLAVKLLKTSIISVESSEVDLSEFQDAEDGTNVPSDNEAGQPAKADATPQQEGAENDQAADNGKKKLVITEEYFQRVTQALVMRLRQHEESVMKDGDGLAGMKQGDLIIWYVEQQNAKGAYSSTAEVKEEVKCIKAIIERLIQREGHLIVIDEGTAAAAEDGAGARRTSESRILAVNPNYVID

SEQ ID NO: 6568 - protein, 475 aa, Triticum aestivum
MSTTEGKPDADAVEEMAREAAAWCAMHGLVVGDRADPRSGTVPGVGLVHAPISLLPSRLPESFWSQACELAPLFNELVDRVSLDGDFLQDSLSKTRQVDDFTSRLLDIHRKMMDANKKENIRLGLHRSDYMLDSETNSLLQIELNTISVSFPGLCSIVTELHRTLINQYGNLLCLDAKRVPGNDASRQFAKALAKAWDEFNVDSAVVMMIVQPEERNMYDQYWLVKYLRESHGVTTIRKTLSEVEAEGRVLPDGTLVVNDRKVTVVYFRAGYTPNDYPSEAEWSARLLMEQSSAVKCPSISYHLVGTKKIQQELAKPNVLERFLENKEEIAKLRQCFAGLWSLDDEEVVKSAIENPDLFVLKPQREGGGNNIYGLDVREALIRLKKEGGDALSAYILMQRIFPKASLASLVRGGVCHEALTVSELGIYGAYLRNKDKVIINDKCGYLMRTKVSSSDEGGVAAGFAVLDSLYLTDK

SEQ ID NO: 6569 - protein, 475 aa, Secale cereale
MSTTEGKPDAAVVEEMAREAAAWCAMHGLVVGDRADPRSGTVPGVGLVHAPISLLPSRLPKSFWSQACELAPLFNELVDRVSLDGDFLQDSLSKTRQVDDFTSRLLDIHRKMMDTNKEENIRLGLHRSDYMLDSETNSLLQIELNTISVSFPGLCSIVTELHRTLINLYGNLLCLDAKRVPGNEASRQFAKALAKAWDEFNVDSAVVMMIVQPEERNMYDQYWLVKYLRESHGVTTIRKTLSEVEAEGQVLPDGTLVVNDRKVAVVYFRAGYTPNDYPSEAEWSARLLMEQSSAVKCPSISYHLVGTKKIQQELAKPNVLERFLENKEEIAKLRQCFAGLWSLDDEEVVKSAIENPDLFVLKPQREGGGNNIYGLDVREALIRLKKEGGDALSAYILMQRIFPKASPANLVRGGVCHEALTVSELGIYGAYLRNKDKVIINDKCGYLMRTKVSSSDEGGVAAGFAVLDSLYLTDK

SEQ ID NO: 6570 - protein, 475 aa, Hordeum vulgare
MSTAEGKPDAAAVEEMARDAAAWCAMHGLVVGDRADPRSGTVPGVGLVHAPISLLPSRLPESFWRQACELAPLFNELVDRVSLDGDFLQDSLSKTRQVDDFTSRLLDIHRKMMDANKEENIRLGLHRSDYMLDSETNSLLQIELNTISVSFPGLCSPVAELHRTLINQYGKLLCLDAKRVPGNEASRQFAKALAKAWDEFNVDSAVVMMIVQPEERNMYDQYWLVKYLRESHGVTTIRKTLSEVEAEGQVLPDGTLVVNDRKVAVVYFRAGYTPNDYPSEAEWSARLLMEQSSAVKCPSISYHLVGTKKIQQELAKPNVLERFLENKEEISKLRQCFAGLWSLDDEEVVKSAIENPDLFVLKPQREGGGNNIYGLDVREALIRLKKEGGDALSAYILMQRIFPKASLANLVRGGVCHEALTVSELGIYGAYLRNKDKVIINDKCGYLMRTKVSSSDEGGVAAGFAVLDSLYLTDK

SEQ ID NO: 6571 - protein, 457 aa, Brassica napus
MSVSTHCFTSPCHDRTRFFSGDDGNKLLRKRIKGTFLVKILPSSQNAYLRITAKSSRPLSGFRSGISKGVFDIVALTSKNALKELSTPLLVKLVGVVACAFLIVPSADAVDALKTCACLLKGCRIELAKCIANPSCAANVACLQTCNNRPDETECQIKCGDLFENSVVDEFNECAVSRKKCVPRKSDLGEFPAPDPSVLVKNFNINDFDGKWYITSGLNPTFDAFDCQLHEFHTEDGKLVGNISWRIKTPDSGFFTRSTVQKFVQDPNQPAVFYNHDNEYLHYQDDWYILSSKIENKQDDYIFVYYRGRNDAWDGYGGAVVYTRSASLPNTIVPDLEKAAKSIGREFSTFIKTDNTCGPEPPLVERLEKTVEEGEKIIVKEVEEIEEEVEKEVEKVGKTEMTLFQRLAEGFEELKQDEENFLKGLSKEEMELLDELKMEANEVEKLFGKALPIRKFR

SEQ ID NO: 6572 - protein, 491 aa, Brassica oleracea
MSYPKAFPHILISLFLFSLYLPPLLPAELSVSSMSVSTHCFTSPCHDRTRFFSGDDGNKLLRKRIKGTFLVKILPSSQNAYLRVTAKSSRPLSGFRSGISKGVFDIVALTSKNALKELSTPLLVKLVGVVACAFLIVPSADAVDALKTCACLLKGCRIELAKCIANPSCAANVACLQTCNNRPDETECQIKCGDLFENSVVDEFNECAVSRKKCVPRKSDLGEFPAPDPSVLVKSFNVNDFDGKWYITSGLNPTFDAFDCQLHEFHTEDGKLVGNISWRIKTPDSGFFTRSTVQKFVQDPNQPAVFYNHDNEYLHYQDDWYILSSKIENKQDDYIFVYYRGRNDAWDGYGGAVVYTRSASLPNTIVPDLEKAAKSIGREFSTFIKTDNTCGPEPPLVERLEKTVEEGEKIIVKEVEEIEEEVEKEVEKVGKTEMTLFQRLAEGFEELKQDEENFLKGLSKEEMELLDELKMEANEVEKLFGKALPIRKFST

SEQ ID NO: 6573 - protein, 489 aa, Raphanus sativus
AFPHILISLFFSLSIFFLCFPRSFQSQLSSMSVSTHCFTSPCHNRARFLSSDDGNNKLLRKRIKGTFLVKILPSSSQNSSLRVTAKSPPPLSGFRSRISKGVFDIVALTSRNALKELNTQLVLKLVGVVACAFLIVPSADAVDALKTCACLLKGCRIELAKCIANPSCAANVACLQTCNNRPDETECQIKCGDLFENSVVYEFNECAVSRKKCVPRKSDLGEFPAPDPSVLVKSFNVKDFDGKWYITSGLNPTFDAFDCQLHEFHTEDGKLVGNISWRIKTPDSGFFTRSTVQKFVQDPNQPAVFYNHDNEYLHYQDDWYILSSKIENKPEDYIFVYYRGSNDAWDGYGGAVVYTRAASLPNSIVPELEKAAKTIGRDFSTFIKTDNTCGPEPPLVERLEKTVEEGEKIIVKEVEEIEEEVEKEVEKVGKTEMTLFQRLAEGFEELKQDEENFLRGLSREEMELLDELKMEANEVEKLFGKALPIRKFR

SEQ ID NO: 6574 - protein, 307 aa, Vigna unguiculata
MHAKTDSEVTSLAASSPTRSPPRRPLYYVQSPSRDSHDGEKTATTSFHSTPVLSPVASPPHSRHSSSTRFSKKDHSHSLKPWKQIDVIEEEGLLQGDDHRNGLPRRCYFLAFVVGFLLLFSLFSLILWGASRPMKPKISVKSIKFDDLRVQAGSDATGVTTDMITMNSTLKFTYRNTGTFFGVHVTATPVELYYSDIVIASGDMKKFYQSRKSQRLVSVAVMGNKIPLYGSGASLSSTTGMPTVPVPLNLKFVLRSRAYVLGKLVKPKYYKTIQCSITLDPKKLTSPVSLKNLAHMIDTCTCDREKK

SEQ ID NO: 6575 - protein, 192 aa, Vigna unguiculata
MEQTIWGHLPVLMRANSKESIEYVLQALWRTRKTGLGTSDRCTIQDMLQLHNESDLDPLLVCLRMLIRRCVYENTSKEDIPKLFPDEVLPELQKLLTLLLQKFQRQWQEDVMKDQNIVPRLKAMTWNMANLEKGSADPAAVIDLKLQNDAPFQLGVQDVKFQLATDSIDMMLKAMHCIRDQFSTMDEALNGH

SEQ ID NO: 6576 - protein, 192 aa, Glycine max
MEQTIWGHLPVLVRANSKESIEYILQALWRTRKTGLGTTDRCIIQEMLQLQNESDLDPLLVCLRMLIRRCVYENTSKEDIPKLFPSEVLPELQKLLTLLLHKFQREWQEDVMKDQNIVPRLKAMTWNMANLDKESADPAAVINLKLQNDGQFHSGEQDVKFKLATDSIDMMLKAMHCIRDQFSTVDEALNGH

SEQ ID NO: 6577 - protein, 192 aa, Glycine max
MEQTIWGHLPVLVRANSKESIEYILQALWRTRKTGLGTTERCIIQEMLQLQNESDLDPLLVCLRMLIRRCVYENTSKEDIPKLFPSEVLPELQKLLMLLLHKFQQEWQEDVMKDQTIVPQLKTMTWNMANLDKESADPAAVINLKLQNDALFHSGEQDMKFQLATDSIDMMLKAMHCIRDQFSTVDEALNGH

SEQ ID NO: 6578 - protein, 192 aa, Cicer arietinum
MEQTVWGHLPVLLRVNSKESIEFILEALWRTRKSGLNSADRCIIQDMLQLQNDSDLDPLLVCLRMLIRRCVYENTCKDDISKLFPGEVLPELQKLLTLLLQKFQHEWQKEVMKDQNVVPRLKAMTWNMANQDKDSSDPAAVINLKLQNDARFHSGELDVKFQLTTDSLEMMLKAMHSIRDQFPAMDEAPKGN

SEQ ID NO: 6579 - protein, 472 aa, Cichorium intybus
RVASASEYLVITGFGIDDIKIAKKAWVLPGQSYSVFDISPVNYTFEVQAMSAEKLPFILPAVFTIGPRSDDDDSLHKYAKLISPHDKLSHHVNELVKGIIEGETRVLAASMTMEEIFKGTKDFKQEVFEKVQLELNQFGLWIYNANVKQLVDVPGHEYFSYLGQKTQMEAANQARVDVAEAKMKGEIGSKLREGQTLQNAAKIDAETKVIATQRQGQGKKEEIKVRTEVKVFENEREAEVAEANAELAMKKAKWAKDSQLAEVVAKKAVALREAELQKEVEIMNALTQTEKLKAEFLSKASVEYETKVQEANWELYRKQKAAEAILYEREKEAEAQKAIAEATFYSRQQVADGELYAKQKEAEGLVALAQAQGTYIRTLLGAMGGNYTALRDYLMINGGMYQEIAKINGEAVKGLQPKISIWTGANGGGDGGDGGAMKEVAGVYKMLPPLFNTVHEQTGMLPPTWMGKITES

SEQ ID NO: 6580 - protein, 351 aa, Setaria italica
MARHAKTDSDVTSLAASTPPRSPRGRPAYYVLSPAASHPDVHLGASGRGAAAAEKMSLAGSTPAESPLHYHFHHHRHSHSGAVAGGGGGVHHSRESSTGRLLFSDQLRSGGDVAAVVSAPWRRLAQSSGAGSVGDDDDEDASLHGGFLASSQWRCYALGAFAFVAVFAFFLLVLWGASRSYKPHVVVKSVVFESYHIQGGTDRTGVPTKMMSMNATVRLRFRNRGTFFSLHVTATPFLLFYGELTVASGEMKEFYQPRKSGRMVTVSVVGKQVPLYGAGVSLHSKPNNGRLGPAVVPVRLAFVLRARAHILGLLLHSKFYRRVHCRLDIREAHLGRPVRGVAADCEYHDGR

SEQ ID NO: 6581 - protein, 617 aa, Secale cereale
ISPRSQRPRRDLVAALLLLLVAAFASAARADLVISRADRKVDLTSHIVRVLTSLKVENAGSEPVSKVLLAFPNIQAKNLAAIRAFGTEGKVKGLSSILPIEVVEPSGVPPELTFFSASLHKPLTKGKILHLDVLTVFTHFLQPFPEEITQADSQLVVFQDSSHYLSPYPVKVQTLSIRLPGGRVESYTKYGNTKLVESELKYGPFEDVPPFSYNPIIVHFENNNPFAVAKELIREIEISHWGNVQITEHYNIVHGGARLKGEFSRLDYQSRPYARGVSSFRNLIARLPPRAHSIYYRDEIGNISTSHLWSDSKKTQLEIEPRFPLFGGWQTTFTIGYGLPLQDFVFSSDGKRFLNITFGSPMEEILIEKLIVKVVLPEGSKDIDVSAPFPTNQWQEVKYSHLDIAGRPVLVLEKPDVIPEHNLHFQVYYKFNNISLLIEPMMLITGFFLLFVACIAYMHTDMSISKNSPSYLAKLQWDEVQATVQQIQGIFGQCLAVHDKLEASLHDLSRTGDAKSCKAARKAADAQFKELAKELRPLLLSVQSSPQSYQISPKLEDLVAKEKDMQDKLMARHATVVDSFEKKQRGQDIENRISSQQQKIAALRQEVESLLEYLSEI

SEQ ID NO: 6582 - protein, 699 aa, Oryza sativa
MAKKGAPRRQQPAPAARQLAVAKKGKAPPKAAKRAPKKKQELLEPSSDDSELEQQQERLQEVEEDESGSDLDAPSDSGAEELSDSDDASLEGGDSGDEEDDDEEEEEDDDDPLADDFLAGSSDDESAEGDDSGVDSDESDDLEAKSRAIDEAKGKAEEEAEEELKLNIRSESDEFRLPTKEELEEEALRPPNLPHLKRRISEIVRVLSNFSKLRQKDVPRKDYVDQLKTDVMSYYGYNDFLVEAFIEMFPAVELVELLESFEKRPPECLRTNTLKTRRRDLAAALIPRGFNLDPIGKWSKVGLVVYDSTISAGATVEYMAGHYMKQGASSFLPVMALAPQEKERIVDMAAAPGGKTTYIGALMKNTGIIYANEFNEKRLHGLLGNIHRMGVTNTIVCNYDGKELPKVLGMNSVDRVLLDAPCTGTGTIWKDPQIKTSKGIEDIRDCAFVQKQLLLAAIDLVDANSKTGGYIVYSTCSLMIPENEAVIDYALKKRNVKLVPCGLDFGRPGFIRFREHRFHTSLDKTRRFYPHVNNMDGFFVAKLKKLSNTIPVTSESSKVPEEAIEKTDPSSDDLQEQPIQSKIHKDVKKMNEETTILDGVTEDKQQTHDRPEKTLKNHKKGEKKRNGPGSGKKETHNEKEEPTSEKKQPVSAKIKKTVPKRTSGTKEKKPDTDQGGKRKRNWMVRREWEAYKKSRSKKV

SEQ ID NO: 6583 - protein, 1181 aa, Zea mays
MIIDAIDWLVLSTTEKVRNIYDDLFEVPSKVMQTAITPRDATSSINFYWNSKGSSLGYIPVFHFSEVLQAGAGVVRQFNININGKRFTSHDYYTPRHLESGYVYGTRPYTNQIRYNVSIVKTDTSTLPPIINADEIFIVISTTNVGTDSEDGTWDGLTCSYAISDPPKITALNMSFSGLTGDISSAFANLKAVQSFYADNPDLCTNAGDSCQTAPQGKSKLVIYYVAVPMALIVVALAVLLCCLLRRRKTRGLADVSVKPRDKTPTSLASMAADEHRLSSLRLENRRFTYEDLEMITDSFKRVIGRGGFGYVYEGFLEDGTQVAVKMRSQSSNQGAKEFLTEAQILTRIHHKNLVSMVGYCKDGVYMALVYEYMSEGSLQEHIAGKRLTWGQRLRIALESAQGLEYLHRGCNPPLIHRDVKTSNILLNAKLEAKVADFGMSKALDRDTYASTNTLVGTPGYVDPEYHLARGDIEVVVDASMGGNHDVNSVWKAAEVALQCTEQASAQRPTMGDVVAQLLECLDLEKGRSANESFCDGDDSGSATASLSHSSAFVTGRIFGTVPMVETGPATRRALVCVSLSPLSPLPRARLPSAPPWDESAFLAMAASHLPPAATLVKKYPTLLHPFGAKPHAQRLIFRCRATSSEGADDGWASFVDELKRSLQVDPSDAVISNAGAGLTSNNDLVTALPLEPSAGPAAGDATTAAAGAVSELLGVDASGAVATPDRLLSSLLHLDASNPVASVAGGALSRLDALTSGLSDAQRWALFGFLAATWLYLTARPGVLSGAVDMYVLAPLQLALDSVLGRRSLKMSDFVVGERIGEGSFGVVYAGAVVPKNGAVVEERSGKAKTSLQNDDRYKEKVILKKIKVMTVGAKECGDYEEWFNYRVSRAAPESCADFLGSFVADKNKAEFVKGGKWLVWKFEGDRTLANYLSERGFPSNLERLMFGRVLQGLGPLEREALVVKQVMRQLITSLKRIHATGIVHRDIKPSNLVVTRRGQVKLIDFGAATDLRIGKNYVPDRALLDPDYCPPELYVLPEETPEPPPEPIAAILSPILWQQQPSLQLNSPDLFDMYSAGIVLMQMAIPTLRTQSGLKNFNAELRSAGYDLNRWRQSARRRPDLQILDLDSGRGWDLATKLISERGANGGGRLSAAAALRHPYFLLGGDQAAAVLSKFSLSK

SEQ ID NO: 6584 - protein, 354 aa, Secale cereale
PAARRAVSTATSSSPPRVKRAARYRCCAEPPSPEQQETPAPLPSPPELPSSLWGVSTSAWTAGVAGLGLLETGYLSYLKLTGSEAFCPVAGGGCGDVLDSDYSVVFGIPLPLVGMMTYGVVTALSLQENREELLPVLDDLDIRLTLLLLATSLATASAYFLFILNTKFVGTSCLYCLSSAFISFTLFFIRLKELLQDIGLARIQKFVGLQLAVAVIVALALTNSYSSATTQLKGTGDFVLEPYKTEVTSESTPFAISLARHLHSIGAKMYGAFWCTHCNDQKQLFGREAMEILDYVECFPNGAGKGKKMADECVATGLEGFPTWVINGKLLSGDQELSVLAEESGFVSESPEQS

SEQ ID NO: 6585 - protein, 350 aa, Theobroma cacao
MPSSPKFFNARTSSLATRPTRSTVLIFSALLVFAIVSFLLALSSFLSSGGSGYRCRSSDPRSVRVLWDRAGNGNNGVAGGDDDNGTKRHKVMGFVGIQTGFGSTGRRRSLRKTWMPSDRQGLQRLEEATGLAFRFIIGRTNDKSKMAELKKEVAEYDDFLLLDIEEEYSKLPYKTLAFFKAAYALFDSEFYVKADDDIYLRPDRLSLLLAKERSHSQTYLGCMKKGPVFTDPKLKWYEPLSYLLGKEYFLHAYGPIYALSADVVASLVALRNNSFRMFSNEDVTIGAWMLAMNVNHEDNRALCEPDCTPSSIAVWDIPKCSGLCNPETKLLELHQKDACSNSPTLPSDDD

SEQ ID NO: 6586 - protein, 242 aa, Brachypodium distachyon
MSEHSENVTEKIMGSIMDTIADNLPKQKSGRFDPAAVSDKVNKLFGRQQSLHGVLGGGKSADVLLWRNKKISSSVLALATAIWIFFEWLDYHFLTIISFALVLGMVVQFVWSNFASRSSNVPRVELPKELFVNIAVAVGAQVNKFLGFLQDVSCERNLKHFVLAIVGLWAAAVAGSWFNFLTVIYIGFVCAHTLPVLYEKYEDQVDSFLYSLLDLLRDQYKKLDSGVLSRIPKGNMKFKKSE

SEQ ID NO: 6587 - protein, 564 aa, Zea mays
MGASGPAAPPATHRRRCIQLLLLLALAVAPLGSRGLRVRAAGADTGGLSRDAFPKGFVFGTATSAYQVEGAATSGGRGPCIWDPFVHTPGKIAEDANADVTTDEYHRYKEDVDLMKSLNFDAYRFSISWSRIFPDGEGKINEEGVQYYNNLIDYMIKQGLTPYANLNHYDLPLALQKKYQGWLGPKIVDIFADYADFCFKTFGNRVKNWFTLNEPRIVAFLGYDKGLNPPNRCTQCTAGGNSSTEPYIVVHNILLSHATAVARYRNKYQATQKGKVGIVLDFNWYEPFTNSTEDQKAAQRARDFHIGWFLDPLINGQYPKIMQDIVKDRLPSFTPEQAKLVKGSSDYFGINQYTTYYIADQQTPPQGPPSYSSDWGVQYYFQRNGVQIGQMAHSIWLYIVPSGMYGVVNYLKEKYHNPIIIISENGMDQPGNLTREEYVHDAVRIDFYKNYLTELKRGIDGGANVIGYFAWSLLDNFEWLSGYTSKFGIVYVDFATLKRYPKDSAYWFRDMLSGTGSKAATPQTGSGGRPAGSASATSNGPALLVSLLVSLGVLLPSIFMVSSV

SEQ ID NO: 6588 - protein, 487 aa, Saccharum officinarum
GPCIWDPFVHTPGKIAEDGNADVATDEYHRYKEDVDLMKSLNFDAYRFSISWSRIFPDGEGKVNEEGVQYYNNLIDYMIKQGLTPYANLNHYDLPLALQKKYQGWLGPKIVDIFADYAEFCFKSFGDRVKNWFTLNEPRIVSFLGYDKGINPPNRCTQCTAGGNSSTEPYIVVHNILLSHATAVARYRNKYQATQKGKVGIVLDFNWYEPLTNSTEDQAAAQRARDFHIGWFLDPLINGQYPKIMQDIVKDRLPSFTPEQAKLVKGSSDYFGINQYTTYYISNEQTTQQGPPSYSSDWGVQYNFERNGVQIGQLAHSVWLYIVPSGMYGVVNYLKEKYQNPTIIISENGMDQPGNLTREEYLHDTIRIDFYKNYLTELKKGIDDGANVVGYFAWSLLDNFEWLSGYTSKFGIVYVDFTTLKRYPKDSAYWFKDMLSGTGSKAATPQTGSGTRPAGSPSATSNGAALLVSLFVSLCVLLPSVFMVSSV

SEQ ID NO: 6589 - protein, 345 aa, Brachypodium distachyon
MASFNAAGAGAANPNPNKSLEVNSPPGDSVSSLSFSPKANHLVATSWDNQVRCWEVQPGGQCQAKASISHDQPVLCSAWKDDGTTVFSGGCDKLVKMWPLLSNGQPTVFSGHDAPVKELAWIPQINLLVSGSWDKTLRYWDPRQPQPVHVQQLPERCYALSLSYPLMAVGTADRKVVIFNLQNPQAEFKRIDSPLKFQTRCLAAFPDQQGFLVGSIEGRVGVHHVDDSQQSKNFTFKCHREGNDIYSVNSLNFHPVHHTFATAGSDGGFNFWDKDSKQRLKAFSKCPSPITCSTFNQDGSIFAYAVCYDWSKGAEKHNPSTAKTNIFLHSVQESDVKGKPRAGKK

SEQ ID NO: 6590 - DNA, 2000 bp, Triticum aestivum
  Wheat SPA Promoter
ttttctcttgcgagagccgctcacctcaaggccccccgccattcctgctgtgaactatagccagcggctggggatgatacaagcaggggcaaccaacgaccaccggagttgccacggttgtcactgatgttgcggtggcgccaccatgaagaccatgtccatgcggtggttggtgcagtttccagcggtgctacaaccgcggaacactaatgctgcaaccggtagcaggagctgttgcgaccgacgacgaaatttgctgccttgaggctgatggtaatggacaagacgagggcggacgccttggtgctacaaccagcatccggtgttgccggaacgacaaccgccatttgctgcaaccggcaatcatgcaacacagagaggaagataccgcgtgctgggatcggccgtcaccctgggcgcgacaaaaagctgcaaccattcgttggtaaagcttcaacctcctgatgaatttcctggaaccagtattcaattttgcttgaactggataattttttgctacaatcgatcaacgagagttcttgctggtaagttgtttttgctagaaccggtgttcaattttgctagaactatattttgctacaatcgatcaccccgagagttcttcttgatgagttgttttgctcgaaccagtattcaattctgctggaactgagtaattttttgcttcaaccaacaaatggtggatttgctgctttccaagttttttgttgggcacgactgtgcaagtcaacgatcgcggcggcgccgatggtgctccaaccatggtgaacgcgcgatggaaccagccgggccggagctgcaatggcctggttcccgagctatggacgcggcgtgcggtgactgcaagcttcagcagaagggtggcagggggctggatgatggtgctgcaaccagtagcggtgcaaggggacggggtgctgccgcccctcgatggagcgcacatgcatgggaccgagagcagagatgctcacggggaacaggaaggaggggatttcctgctcacgttgaccaaagcgagaggaaggagatgattcggtgaccgactacaaatcatcatatcaaacaattgggggccgaccggccaaaacgttcggtcggcgtgctagtggctaataatggcctaccggtatggaccacgttagtcaaatggtaagcgacgcatgtatataaggtatattaatgcgaccaactcgcaaggtccgtcacctatattcggagaacatatttctgtaatatataaatttaataggtaaagtcacatttatcattctcaaaagagggtggcccgtgtgaggaactcgtcctgagcaaagacgaggaggtttccactcaaccgttgtcactctagctatagtgtatattagaagttaagtgtttccgttaccttttcatatacaacaacaatttaaagttagaaaccctgtaaatcacatggaagcgtatggatcgcaacgagtcaaaataaacatggcgcattagtgacacgtattttaaactttctgttaacactttttgttctttcattaaaggatatttgtttgcattagcgttgtcatgctagacgagcacatacattacaacattattatgtgtttgttgtggtttctagagacaagacatgaacacctaaataaagaggacatggacgaaaaggttaaccgtaatagctcatgcaagatgacaagcaaaacatttcattgtatgaggttccgtggatcacacttctctatgtactctcagaaacgaaaacacttgtctagacgatggtagaccgtcggaataggtgaacatcttttgtacaacagaaagtatgactaacgtggcgccgcggccgaaactgcattatcagttcagctgaatttgtactgtatgtcatatctatctcgagtattcaagacagaaaaaccttgtgcagtagtagtactactgaaataaaatagacatgagaggatcgcaccctcaacccatctcattcagca

SEQ ID NO: 6591 - DNA, 1919 bp, Triticum aestivum
  misc_feature (1306)..(1316): n is a, c, g, or t
  misc_feature (1649)..(1649): n is a, c, g, or t
  Wheat LMW Longer Promoter
tatcatgatgacatttctatgtgctaaagattcttctacaaagccggttcaaatacaaaacaaatatgccaaaaaactacttaaattaccagtagcgagtgtacaaaagttagcagcagcgcctcaatagcagtagagcgtccggccaaagagcgctagcgctactagcggtagcgagcttctcataaccgcgctgctgctacacttgtgtagcagtagcgcgggtgctcacgcgttactgctatgagttagctgtagcgccgtattagtagcgcgggtacccgcactactgatacatctaaaacccgcgctgctgctagccttttccctagtagtgctagtcgatgtatctccccacaacctcacctctacaccggactacaaggaagtcttctgacggcgggaattgccgaagcacgcttgaccccacttgttcctcgccggacaaaagacatctagcgcggcataattcaaacgccacgctggaaccaatagtcgtagcggggcggtcaggaactgcgtcatctcgcttattaggcatgcttttcatatttttacttgcgaccctacagcacggttccgtgtcaatatcatagacttctagttgtggagttttgttttttcgtcgtcgacatgagaaatatatggtccacctgcttagcgcgcatagggggaaatttgatgattattggaacttttgaagtgaaattctcagaaagcacatagttatattcagctactaaagccacaaatgtacattactgtcaggcttcccagctgaattctgatgcctgaccctcctaatccgtgcagctagcatggagatgggtctgcctctcggatttatgtgcattgaatcgttggaagagacagacgaaacaaatcgataccttgtgttgatggggaggtcggagtggctgccgtcgacgtacggcccacaatcgacggaggagcttcaaaagtgaccttttttgtcgagcggtggtggtggtggtggggggccggatgttgagggtgggagggaggctgacgtctccgctgccgcggaggtacgtggaggggccgcgagcggtgggcgtccgggagaggctgcgacggcgagcggtccggccggcgaggaggacgaggaagggagggacgcagatccgcggagtgtgggctgggcttgtgtcgttggggcctacgagaactatagcccaaatcgaattggtgccctaacacacggcacttatgttgggcctaatctctcgctccaggctgggggcctctgttccagccccatctatcatttccccctagcgtcatnnnnnnnnnnnaaaaaaatccccctagcataaaaaaactatcatttcccccaaaaaaacccttcacaaatagatgaaactgatgatttatctaaaaaaataggcgaaactgatgatgacgtgtcaagagttaggaccggatatatgctagtaggagtagcttgtaagcaattaccatcctttacatgtaaagggaattcgatgagtcatgtcatgctctataggcgtcggttcatctaatcattttagaggaaaaatacaaagttagttctacacttagtcctacacaagttttgcctttcttgtttatggatgacagcctatacaaggttccaaactcggttnacaaggttccaaactcggttgcaaaagtgatactatccagataagtgtgtgacatgtaaagtgaataaggtgagtcatatataccaaacatcaaggtttctgtactttatgtgtgatcatatgcacaactaaaaagcaactttgatgatcaatccaaaagtacgcgtgtagctagtgcaacctaacacattgtaccaaaaatcattttagatgcatccaaacagaattattaaagctaatgcaaagaagaaaagaggtggtgcccgggct

SEQ ID NO: 6592 - DNA, 326 bp, Triticum aestivum
  misc_feature (56)..(56): n is a, c, g, or t
  Wheat LMW Promoter
agttttgcctttcttgtttatggatgacagcctatacaaggttccaaactcggttnacaaggttccaaactcggttgcaaaagtgatactatccagataagtgtgtgacatgtaaagtgaataaggtgagtcatatataccaaacatcaaggtttctgtactttatgtgtgatcatatgcacaactaaaaagcaactttgatgatcaatccaaaagtacgcgtgtagctagtgcaacctaacacattgtaccaaaaatcattttagatgcatccaaacagaattattaaagctaatgcaaagaagaaaagaggtggtgcccgggct

SEQ ID NO: 6593 - DNA, 2000 bp, Triticum aestivum
  Wheat HMW glutenin-1 longer Promoter
cctaccattagaagaacgtccggcaaagagatgcactgcaacatatgaccaaaacgtcatccatgatcgagtacaatttcttagtgcctttttcatcaaagttatatttgaaacattttagaaaatttgtcttaaattttttcccatggcgtttcgatcaaaaaaatgccttaaaacctacctatataaaggcaataagggaaaacacttcaggataccttcgaatctaaggtgtctttctttagatggtatgctaaactgttcttcatggcgcctcaaatcatcattctgcaagtaaagactaaaaataacgctaaatatggagttaaaggtttacaaacgacgagcggaaaaggagtcttatataattccagtagcatttattccattttgcttcacatagaaaatgtagctgaggtggtcgatgtttattttgactcgcgtgaggtcgccggttcgatctcagaagcaacgctggaatatcccatatagatttatttttcaggctgagtgatgctcgggtacctccagcgtatgggctgaaattcgccccccctgcaaatcatgggccctgtgacgttcgcacgggttgcacatgccttggcccgggcctactaggagtgtacctggattatgttggacgacgggagatgaaagggatgtattaattaacaaagataatgaagcttaattttcttatatgttgttaatattgacaagaaacaagctgctaactcaaagttacggttacatagtcgcaaccttttatatctaaataatatctctctctcaacatgcaaacatgccacctcagcatgtagcatgcatggaaattgtccacttcaacatgcaaccatgcatcaaaatttccattttactaggctatttatttgataaaatttcacaaatatacaataatcaaacacaatagatcatatgtgttttcagttttggttctcacattattactccaaatataaatgtttcgtataaccaaatttcattcaaatatactgcaaaacatttccgtgaaaacatgtggggtacatctagttataaggaaatattagtgatgtcctgcaagtgataaggccaaggagagaagaagtgcaccatctacagaggccagggaaagacaatggacatgcagagaggcgggggcggggaagaaacacatggagatcatagaagaacataagaggttaaacataggaggaggatataatggacaattaaatccacattacctgaactcatttgggaagtggaaaaatcccctattctggtgtaaatcaaactaattgacgcgagttttctctgaagattctatgttaattttagacatgaatgaccaaaggtttcagttagttgagttttgtcatcgaaaggtgtttacataagtccaaaaattctaccagcttttggtacggcgcgtcatagaacagataaatgttgtgagtcattggatagatattatgagtcatagcatggatttgtgttgcctggaaatctaactatgacaagaaacaaaacataaatgggcttttgaaagatgatttatcaacttaccttatccatgcaagctaccttccactagtcgacatgcttagaagcttttagtgaccgcagatttgcaaaagcaatggctaacagacacccaaaccccaagaagcataaccacttctcttagataaaaatagcagatcgatatacaaacgtctacacttctgcaaacaatacccagaagccagaattaggattgaaccgattacgtggctttagcagaccgtccaaaaatctgttttgcaaagctccaattgctccttgcttatccagcttcttttgtgttggcaattgttcttttccaaccgactttattcttttcacatttcttcttaggctgaactaacctcgtcgtgcacacaaccattgtcctgaaccttcaccacgtccctataaaagcccaaccaatctccacaatttcatcatcacccacaaca

SEQ ID NO: 6594 - DNA, 425 bp, Triticum aestivum
  Wheat HMW glutenin-1 Promoter
catgcaagctaccttccactagtcgacatgcttagaagcttttagtgaccgcagatttgcaaaagcaatggctaacagacacccaaaccccaagaagcataaccacttctcttagataaaaatagcagatcgatatacaaacgtctacacttctgcaaacaatacccagaagccagaattaggattgaaccgattacgtggctttagcagaccgtccaaaaatctgttttgcaaagctccaattgctccttgcttatccagcttcttttgtgttggcaattgttcttttccaaccgactttattcttttcacatttcttcttaggctgaactaacctcgtcgtgcacacaaccattgtcctgaaccttcaccacgtccctataaaagcccaaccaatctccacaatttcatcatcacccacaaca

SEQ ID NO: 6595 - DNA, 595 bp, Triticum aestivum
  wheat alpha gliadin (B genome) Promoter
tcaagcttgtctagttacagtaacaacttgtggaacattacaaaatttatgtttgctagtaacttctagaacactacaacacttgacatgtataaggaatttgatgagtcatggcctactaaagcaagttatattactactcttatctatcttaacaggtcacacaagattacaaactaagttctgtatcagccatgcttatctagtttatgcataacaatttgcagaacattacaaacttagtttcggaaaaataggcaatctagattagtgtttgagctataaagtgaataagatgagtcatgcgtgttatcacacctctttggtggtggaatgatagtgcaacaacatgaaacttcagtgactagtccaagaatacacatgtaagtagtgccaccaaacacaacataccaaattatgattttgggaagcatccaagcactttccagacaagaaaatgccaattgtgaaagagatcataccatgggaactataaaaagccttgtagcatgatcatcatccttcctcacccatcattctcataagtagagcgcatcattcaagccaagcaagcagtggtcaatacaaatccacc

SEQ ID NO: 6596 - DNA, 1238 bp, Triticum aestivum
  misc_feature (1231)..(1231): n is a, c, g, or t
  wheat gamma gliadin Promoter
atacttatatagggtagcgatattcacttgggaggtcggggttgtgctcggggaagcaggggcttgccggacgcaaggctcggacggcctccacgcctctgttccgtgaacagaggagatgggatcctccaagtgggcggggccacaatagtttatagtaggcccatgtgcacagcaggtcttccatattttccctttttatctcctgtaatatttccaccactctattgcatttagtttatgcagcaaacgacttttgctataactgaaacttggcacataaatcaagcacacaattttggggtggcacaaaaagtttggggccaaattgaaatcacttaaattataattgcatttaaaagagctaaaagggtgtcgttggtccacagtttaatattcataggcattttaaaagtttccagaaaaaactttgctaatgtatgacagttatgtagtgaatattttcaacctaaggaacatttttaatttattttttataaaattataattcgacttggcattcgaatttggatttgagttttggtttgaaacggaaagaggattagtaaaatgattatgatgacatagcatcattaggcatgagattactgtagcatgacatcgggggtgttacacttgtacaatattcctacccttgacataaaaggagaatttgatgagtcatgtattgataacgtatacaacattactacccttgacataaaaggagaatttgatgagtcatgcattgataacatgtacaagattactatcagcttgttcatcttaccatcatattatacaacactacaagttagttttagaaagaacaagagtccacaacaaatatcagaatacttgcctgatctatcttaacaacatgcacaaggacacaaatttagtcccccgcaagctatgaagatttggtttatgtctaacaacttgtacagatccaaaaggaatgcaatccagataattgtttgacatgtaaagtgaataagatgagtcaatgccaattatcagtattcctcactcttagatgatatgtacaataaaaagacaactttgatgatcactctgaaattacgtttgtatgtagtgccaccaaacacaacataccaaataattagtttgataagcatcaaatcacttttaaaaaagaaagcaataatgaaaagaaacctaaccatggtagctataaaaaggcctacaatatgtagactccataccnactccat

SEQ ID NO: 6597 - DNA, 2162 bp, Triticum aestivum
  wheat TdPR60 longer Promoter
agaagaagaaggagcaccaatacaatggagtttcacccggcttcacagccctgttacttttcccagagccccaaaaactctcctcaacaaatacactcgtggtcatggctttgtaggggcacaacaacgcagcgcccacgtttccttgtgcgcatgtacgcacgccgcctagctagcaaccctgcatgcaatcccatcagcccggccatgcgcactacatgcgcgctacgcacacgacgcggccatctccaccggtcactgctaacaatcatctaactaactcacacgcatcaagcaaacttggccggcacacttgccaacgccctgctctacgtgccagactcgagagtatacacgctacacacacatgcgccacgcttctgcgtcccgtacgtcccgcccgtcccgcatgtcatcgacgcgcccgtcaagcccgacgagcccgacggcaccagtgtgtcccgcctgtcccacgcgcacccgacgcgcccgacgagcccgatcacacatgtcgtggcttattccaaaacacaccccttaagccacggcctagaggagtccgtcatcgtcgacgttggcgccggctaagagtgcatgctccgccgccggtcctttccgcagctgcgggcactcgcgccggaagtgcccgtgctccccgtacttgtagcagcgcctgcgcctgtcgccgccgctccccgacgccacgctgcgcccgtcgtcgtcgtcccgagcaccgccgtgtcgacgctcccatgctgcccactgcgccaccgtcatgagcagctgctcacctccgcgctcgccgccgtcttgtccacagcgccgaacccgctcgtcgaacgcacgcagccgcccgagcgcttcgtcgaacgccatcgtcgtcacgtcgtggaactgctcgataccggcgacgacggggaagaggcgatccgacaccgtatcccagcaacttcttgacaagtgccgtgtcgcccagtgtctccccgaggttggcatacctcgccgccatcgccgcgagcctcccgccgtacacgtcgagctcctcgccgtccaccatcttcatccggtcgaatttgccatgcagcgtccccggcctcgctgcgcgtacccgatcagcgcggacgaacctcaccttcagggagtcccatacctccctgacggtgagcttcgtcgataccagcagcagcacatcctccggcaacgccccgagaagcaacgtgcgcaccatcttgtccttccgcgcgttcaccaccgcgtcgcccggcgccaccgcctcccatacggtgtggacgtcgaggatcgcctacgccttgatggcccagaccgtgtagttgtccgcggtcagcaaaggcatcgccatcgtcgccgattccgcccgcgccgccgccgtgtgggacgggcgccatggtcgccggtgatcgcccgaaccaaagctctgtatatcaattgttggaagcgctctctcacactgatggatggagatagaagaagaaggagcacacagtacaatggagtttcacccggcttcacagccctgttacttttcccagagccccaaaaactctcctcaacaaatacactcgtggtcatggctttgtagtggcacaacaacacaacgcccacgtttccttgtgcgcacgtatgcacaccgcctagctagctaccctgcatgcaatccatcagcccggccatgcgcactacatgcgcgctatgcgcatgacgcggccatctccaccggtcactgctaacaatcagctaactaactcacacgcatcaagcaaacttggccggcacacttgccaacgccctgctctatgtgctagactcgagtgtatacacgctacacacacatatgccacgcttctgcgtcccgcatgtcccgcacgtcaccgacgcgcctgacaagcccgacgagcccgacggcaccagtgtgtgccgcccgttccgcgtgcacccgatgcgctcgacgagcccgatcacacacgccgtggcttattccaacacctagatgtataattaatgtatacattaattgtctgacacggtgctatatcttcatgatatacaactggtgtatgcgtctgtatcatcatctcaaagaaggctatatataccaagacatagctagcgaagtcatgtatcccacacattcacagaagcca

SEQ ID NO: 6598 - DNA, 2147 bp, Triticum aestivum
  wheat TdPR60 Promoter
accaatacaatggagtttcacccggcttcacagccctgttacttttcccagagccccaaaaactctcctcaacaaatacactcgtggtcatggctttgtaggggcacaacaacgcagcgcccacgtttccttgtgcgcatgtacgcacgccgcctagctagcaaccctgcatgcaatcccatcagcccggccatgcgcactacatgcgcgctacgcacacgacgcggccatctccaccggtcactgctaacaatcatctaactaactcacacgcatcaagcaaacttggccggcacacttgccaacgccctgctctacgtgccagactcgagagtatacacgctacacacacatgcgccacgcttctgcgtcccgtacgtcccgcccgtcccgcatgtcatcgacgcgcccgtcaagcccgacgagcccgacggcaccagtgtgtcccgcctgtcccacgcgcacccgacgcgcccgacgagcccgatcacacatgtcgtggcttattccaaaacacaccccttaagccacggcctagaggagtccgtcatcgtcgacgttggcgccggctaagagtgcatgctccgccgccggtcctttccgcagctgcgggcactcgcgccggaagtgcccgtgctccccgtacttgtagcagcgcctgcgcctgtcgccgccgctccccgacgccacgctgcgcccgtcgtcgtcgtcccgagcaccgccgtgtcgacgctcccatgctgcccactgcgccaccgtcatgagcagctgctcacctccgcgctcgccgccgtcttgtccacagcgccgaacccgctcgtcgaacgcacgcagccgcccgagcgcttcgtcgaacgccatcgtcgtcacgtcgtggaactgctcgataccggcgacgacggggaagaggcgatccgacaccgtatcccagcaacttcttgacaagtgccgtgtcgcccagtgtctccccgaggttggcatacctcgccgccatcgccgcgagcctcccgccgtacacgtcgagctcctcgccgtccaccatcttcatccggtcgaatttgccatgcagcgtccccggcctcgctgcgcgtacccgatcagcgcggacgaacctcaccttcagggagtcccatacctccctgacggtgagcttcgtcgataccagcagcagcacatcctccggcaacgccccgagaagcaacgtgcgcaccatcttgtccttccgcgcgttcaccaccgcgtcgcccggcgccaccgcctcccatacggtgtggacgtcgaggatcgcctacgccttgatggcccagaccgtgtagttgtccgcggtcagcaaaggcatcgccatcgtcgccgattccgcccgcgccgccgccgtgtgggacgggcgccatggtcgccggtgatcgcccgaaccaaagctctgtatatcaattgttggaagcgctctctcacactgatggatggagatagaagaagaaggagcacacagtacaatggagtttcacccggcttcacagccctgttacttttcccagagccccaaaaactctcctcaacaaatacactcgtggtcatggctttgtagtggcacaacaacacaacgcccacgtttccttgtgcgcacgtatgcacaccgcctagctagctaccctgcatgcaatccatcagcccggccatgcgcactacatgcgcgctatgcgcatgacgcggccatctccaccggtcactgctaacaatcagctaactaactcacacgcatcaagcaaacttggccggcacacttgccaacgccctgctctatgtgctagactcgagtgtatacacgctacacacacatatgccacgcttctgcgtcccgcatgtcccgcacgtcaccgacgcgcctgacaagcccgacgagcccgacggcaccagtgtgtgccgcccgttccgcgtgcacccgatgcgctcgacgagcccgatcacacacgccgtggcttattccaacacctagatgtataattaatgtatacattaattgtctgacacggtgctatatcttcatgatatacaactggtgtatgcgtctgtatcatcatctcaaagaaggctatatataccaagacatagctagcgaagtcatgtatcccacacattcacagaagcca

SEQ ID NO: 6599 - DNA, 1992 bp, Zea mays
  maize Ub1 Promoter (cultivar Nongda 105)
tctgcagtgcagcgtgacccggtcgtgcccctctctagagataatgagcattgcatgcctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgaccaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgaggcggcacggcaggcggcctcctcctcctctcacggcacggcagcctacgggggattcctttcccaccgctccttcgctttcccttcctcgcccgccgtaataaatagacaccccctccacaccctctttccccaacctcgtgttcgttcggagcgcacacacacacaaccagatctcccccaaatccacccgtcggcacctccgcttcaaggtacgccgctcatcctccccccccccctctctctaccttctctagatcggcgttccggtccatggttagggcccggtagttctacttctgttcatgtttgtgttagatccgtgtttgtgttagatccgtgctgctagcgttcgtacacggatgcgacctgtacatcagacatgttctgattgctaacttgccagtgtttctctttgaggaatcctgggatggctctagccgttccgcagacgggatcgatttcatgatttttttttgtttcgttgcatagggtttggtttgcccttttcctttatttcaatatatgccgtgcacttgtttgtcgggtcatcttttcatgttttttttggcttggttgtgatgatgtggtctggttgggcggtcgttctagatcggagtagaatactgtttcaaactacctggtggatttattaaagatctgtatgtatgtgccatacatcttcatagttacgagtttaagatgatggatggaaatatcgatctaggataggtatacatgttgatgcgggttttactgatgcatatacagagatgctttttttttcgcttggttgtgatgatgtggtctggttgggcggtcgttctagatcggagtagaatactgtttcaaactaactggtggatttattaattttggatctgtatgtgtgtgccatacatcttcatagttacgagtttaagatgatggatggaagtatcgatctaggataggtatacatgttgatgttggttttactgatgcatatacatgatggcatatgcagcatctattcattcatatgctctaaccttgagtacctatctattataataaacaagtatgttttataattattttgatcttgatatacttggatgatggcatatgcagcagctatatgtggattttttttagctctgccttcatacgctatttatttgcttggtactgtttcttttgtcgatgctcaccctgttgtttggtgttacttctgcag

SEQ ID NO: 6600 - DNA, 1358 bp, Zea mays
  Ub1 Promoter (cultivar B73)
gtgcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaaatctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttc

SEQ ID NO: 6601 - DNA, 1266 bp, Oryza sativa
  rice actin 1 Promoter
tagctagcatactcgaggtcattcatatgcttgagaagagagtcgggatagtccaaaataaaacaaaggtaagattacctggtcaaaagtgaaaacatcagttaaaaggtggtataagtaaaatatcggtaataaaaggtggcccaaagtgaaatttactcttttctactattataaaaattgaggatgttttgtcggtactttgatacgtcatttttgtatgaattggtttttaagtttattcgcgatttggaaatgcatatctgtatttgagtcggtttttaagttcgttgcttttgtaaatacagagggatttgtataagaaatatctttaaaaaacccatatgctaatttgacataatttttgagaaaaatatatattcaggcgaattccacaatgaacaataataagattaaaatagcttgcccccgttgcagcgatgggtattttttctagtaaaataaaagataaacttagactcaaaacatttacaaaaacaacccctaaagtcctaaagcccaaagtgctatgcacgatccatagcaagcccagcccaacccaacccaacccaacccaccccagtgcagccaactggcaaatagtctccacccccggcactatcaccgtgagttgtccgcaccaccgcacgtctcgcagccaaaaaaaaaaaaagaaagaaaaaaaagaaaaagaaaaacagcaggtgggtccgggtcgtgggggccggaaaagcgaggaggatcgcgagcagcgacgaggcccggccctccctccgcttccaaagaaacgccccccatcgccactatatacatacccccccctctcctcccatccccccaaccctaccaccaccaccaccaccacctcctcccccctcgctgccggacgacgagctcctcccccctccccctccgccgccgccggtaaccaccccgcccctctcctctttctttctccgttttttttttcgtctcggtctcgatctttggccttggtagtttgggtgggcgagagcggcttcgtcgcccagatcggtgcgcgggaggggcgggatctcgcggctggcgtctccgggcgtgagtcggcccggatcctcgcggggaatggggctctcggatgtagatcttctttctttcttctttttgtggtagaatttgaatccctcagcattgttcatcggtagtttttcttttcatgatttgtgacaaatgcagcctcgtgcggagcttttttgtaggtagaagatggctgacgccgaggatatc

SEQ ID NO: 6602 - DNA, 2199 bp, Oryza sativa
  rice GOS2 longer Promoter
tctagaatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctcctcctcccatctataaattcctccccccttttcccctctctatataggaggcatccaagccaagaagagggagagcaccaaggacacgcgactagcagaagccgagcgaccgccttcttcgatccatatcttccggtcgagttcttggtcgatctcttccctcctccacctcctcctcacagggtatgtgcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttc

SEQ ID NO: 6603 - DNA, 1024 bp, Oryza sativa
  rice GOS2 Promoter
ggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttc

SEQ ID NO: 6604 - DNA, 2103 bp, Arabidopsis thaliana
  arabidopsis Pho1 Promoter
actgtttaaggacaaaaaatgtggaactgatgtctcctaggtggtggaatatgtgaagctagaaaacaaataaatgcggtccgactcagaccatcattttcctcttgtctcattggttttaaaattaaatattatattataaaatctgttgcagtattttttttaatctcaattagagttatttatttaggtctcaacccatggtggggaaaaaaacagctattttaggtaaatttagattacaaaattgtatagtcaatatcaataataggttaaagttttaataaactgggtgaatcagtttttgtttggtcttcttggatctttgtttggtctcaatattttggattacatataaattccatcccgactattatttgggttttgccgctggactctataacacactgattttagttttatatgaattttacgttgttttacgtttgatcatgaactaaaaattcagcaatccataagaaaatattttttggactagttcgaaactcggccagacaatactaaacctattcacatatttaactttttttttttttggacaaacataattaactttagtaagtgttatatttttgtcaatattaaactagatgtggtgtttttaattgtgggaaataaaattaaagaagcaaagttccatgaaatatggactttccgtaattggaaggccgccatatgttgccttcatttgtattttccttttattgacccttttgttttcttataagataaatatatatataactaattaggcagaagctgagtggcattagttagtgaaatatatttatcattatcccaaattcctctagctgacattactttgaatttagaaatttcttatccgcaaaatttgtactaatattatgaagtagtacatcgaatagaatatatattggtgcacattatgatccactttcaatgccatccattcgaatggttgctcagaacgtacttgtagaaaccgcgtgcataaagtttcatatgagcatcgtgtgctttgttatttaattttttcttccctaaataatcagacagaaaaattcataaacttctttaataaaaccatccaaaaggggattatactacgaaaattatggcatctaaacgcaaagtttaatatatttttagtaccaatgcattgtaaaagaatggaaattaaataaaaacaatatgaaactgtttgttcccttggacaaaaaaaaaacttggtatgactatgatttttatatgcgcttttgtaattgcattgtaattttgtcgatatggaagtggattttaaagaacattaatccatgatctgataggtgaaaactcacactacttgactgctatataacatggtttggtagtatctgcatttgtaatgtgaaactatgaaatcagaatttgattggtaattcttcttctgcttcttttttcttgattctttaagatttagtatgtgtttcaaatttttcattgtcctccgaaaaaatgtagtggaaatcgagctggtccaatctaagttcactcaccttttgtgtctcttggcacctaatttctttttggtccatttcagctatcttcttccttttccacacaaaacattacaaaatacttactatttctagttctccgatttacaatacccaaattacccttacccttgcccctcatatagttcgtataacaactttcactctaagatgaaacattttgagtgttgagaaaggtatatgaagctcggtagccggaggaagcacggtggatatacactggcgagaatcaggacggtcccacacgagacaagatttacctctcccaaaagcacaagtggaaggagcataggataaaaattagtacatgaaattaggtttcaagaaggatatttgagaatgtgctttgtgaggcatcgtcagtaggagtaagcaatccagtcaaatatattcttctttttttctctgcctttgcttttgtccactataaaacaaatctcatcctcctctcttgccctacactcacaaaacaaacacactctcttcttgatcattttctcttttgagtttttgagtttaaggacttaaaagagaaaacgctatg

SEQ ID NO: 6605 - DNA, 901 bp, Oryza sativa
  rice ExpB5 longer Promoter
gttgatgggccgtagaggagtataatggcaacgtttgacgagacatctagaaattataaaaataaaacccaacgtgacaataaactctaaaaactataaaatctattttttaaaggttccaagaagtatgaatagaaatagtgatagatcgagcaagcaaataaagaagaagatgacataaggggtagtaattggtgtgacttttaaaaactatataattaaaaacacgagaatgatatggtttggtctttcaaagtcttaagataatgagatagctatttaacaaattttgaataaatcatattaaaatagataattttgtatgggtgctaattgcgcgggctacccagctagttcgattgaattgctgccactaagtgttactatacaacattctcctctaaaagaactatatatatttctccaaaagaaaaaggaactatatatgtaccatatgtacaaacattcgagtggccgggcatgatactcgctactttgctaggcacgttgcgcacgtacagctcacgctcaagtcgtacacattatggagtagccatttgacaaacgtacggatgacacaagacgaatatcaaattgcgaattttcaaagcgtttctaaccaacacaactaccttgtgagaatagtttatccaaacccttgcggctgcgtgatcacctccttcatgcaaggacctccgtaaagtccacaagtatactcttcgatcccacacacacatagttgacatacacatcaacacatgtacaaattcaagttgccacgttcacctcaataatgcttgggtacacataatttgctaccacgtttgtgaccgctaatcttccctataaataccaaccaaatcaaatcatcttaaaaatcaccgagcaatctccgcttaac

SEQ ID NO: 6606 - DNA, 844 bp, Oryza sativa
  rice ExpB5 Promoter
taaaaataaaacccaacgtgacaataaactctaaaaactataaaatctattttttaaaggttccaagaagtatgaatagaaatagtgatagatcgagcaagcaaataaagaagaagatgacataaggggtagtaattggtgtgacttttaaaaactatataataaaaacacgagaatgatatggtttggtctttcaaagtcttaagataatgagatagctatttaacaaattttgaataaatcatattaaaatagataattttgtatgggtgctaattgcgcgggctacccagctagttcgattgaattgctgccactaagtgttactatacaacattctcctctaaaagaactatatatatttctccaaaagaaaaaggaactatatatgtaccatatgtacaaacattcgagtggccgggcatgatactcgctactttgctaggcacgttgcgcacgtacagctcacgctcaagtcgtacacattatggagtagccatttgacaaacgtacggatgacacaagacgaatatcaaattgcgaattttcaaagcgtttctaaccaacacaactaccttgtgagaatagtttatccaaacccttgcggctgcgtgatcacctccttcatgcaaggacctccgtaaagtccacaagtatactcttcgatcccacacacacatagttgacatacacatcaacacatgtacaaattcaagttgccacgttcacctcaataatgcttgggtacacataatttgctaccacgtttgtgaccgctaatcttccctataaataccaaccaaatcaaatcatcttaaaaatcaccgagcaatctccgcttaac

SEQ ID NO: 6607 - DNA, 602 bp, Hordeum vulgare
  barley ExpB1 Promoter
cgtggagttgaaactggttcggggtttgcgtcgtcgcccaactcgcttgtccgtcggctccggccggtggtaaagacgaggagatggcaccgcaggaaaacaaggctgtcttcgatggccgacgacttgagacaccgttattttgatgaaggcaccatgaaggctttcggtgtcgctttaccttcgggggacatcgtttttggagtagctacaggctagagggatgggtcaggatggaccgtttatgaaacgtgcgaacattttatttgaagggtacgaaacattttgaaggctgcataggatggaccgttgaaccccacgtgcacgcaatcacgcaacaaacccggccggatgagtcctctttatccaaaatctccggagttgaaagagccttcagcgccatggctccgtcatcaaaggatcggccggctccgtctcagttgaccacagtgcaaagtatgtatgcgcaccctctccgtgaacaagttgccgccacgttcgcctccataattcgtgtgtgcacgactaaacgtattcgctcccacgtttataacacctagaccttccttatcctatatataccaaccaaccgaaccacccca

SEQ ID NO: 6608 - DNA, 1729 bp, Hordeum vulgare
  Barley SS2 Promoter
gaattgtagtaagtcacgggtgtttatttgatccagactcttttgtaaactaaaggcctctacctacatataaaggagagccctcgagttagaaagatcaagtaaacaactctcgagagctaggttagtgattacgcatccttgtagttgagatccccatcaacatagacaccaaagcaggacgtaggcttttatctccattgaaggggccgaacctgggtaaatccacctctcgttcccgattaacctcttcgagtcgccacaccgccatgatggcctcaacactaagtccgttcacgagctaggtcatgtcgtttggtgacattggccctagactcggagcccgacatcatggggacgaggctccatcgctagggttgcgctccaccccgtgtagttagtcgccactctacctacaaccaatgctcaccacctccattccgtcgcgctcacgcaccttgagttgtcgacgccgctggaaccgagccccactcttgtggatgcaatggggccagagtgactccgacaacggagctcgagtttcctctcgggactagcaaagtgccagctggacgactaactcctcctcgtccgcacatgaggacgaggtcccacccgatggatccagagttgtcaaattcaggctcgctattggccatgtcagaaaagggtggagatcactagagaggagttgggggtggagcggagtggactcggagtgggtggttagggtttcgtttggatagggacacattatgaggccgaggtgggttggtcggggcaagattcaatgtgaagaatgtgtcggggcacctcatatgacatatatgaccggtttaagggtccgattagatggcattttcgtgactagaccgtccgctcagacataaatggacgtgttaagtgcaagacaagttacaaaccaacatgtatatcaaatttaagttctaaactacactcatgcttatatttttcttaaattatttcaaaccttccaacgatgcgacttcaccaggagatgtttctgtcatgaacatatatgcaaatgtattttgcgttaccgtgtttcaaaaagaaaaaagtattccatccgtttttaaatataaaaccttttagagattttactgtagactacgtactgcgatggaaattaaaatgcaaaccacatggcagcggcatacgagagccattcatcgctacaggacactttgcatcggtagccagctagtttccgacggtaccgacgagccgcagagaacttctaaatgcggtttttatgtgcagggacaaacgcgggtttctctgtctgcggaacagaaaaacaaattcggttcccagcaaaaacaaaacaaaacaaagaaacaaaaaaactgcggttgcacgtagtaacaaagtctgtcgcgcacggagcatctcatgcagccgatgatggctcgccagcacgaaaacacttgtcacggcgcgctcccacgaaccggaaacacttggcgcggtgcgtccctccgaaccgaagcacctgtctctaccgcctcgggaaccgggcgctaatctccaaatcaggccggaggcctccacggccgtcgatgcgatgccgccaagagccagtgcggaaaagagagtgtccttttcccccggccgcccggcgagaggaggtggcagcggcgcctgacgcacgcctcctgctggcagctcctccggcgcgccgcgtgtataaataggggcgcagcgc

SEQ ID NO: 6609 - DNA, 879 bp, Oryza sativa
  rice PG5a Promoter
aagcttgcgcgcggaatacggtggtggagatgggttgggaaccctggattccaaacacagcccaagtctatccaaaatgtttagacaagaaaatacgtaacaagttggtttacagaaatagcaattagatcaatcctgcactacaagtagagtaaagtggtgatttctcttaaatctctcgaatggtgatttaagaattcagtgcaaaccaaatccttgctataatcaaatgttcggtaccccatcaacggaacaataaaaagcgcctggctaccataattttgtcattcttcttcaatttgtaatttaagatgcatgaggccacacgaccttaatgttcaacgtgtcatgcattagtgaaataatagctcacaaaacgcaacaaatatagctagataacggttgcaatccttaccaaactaacgtataaagtgagcgattagtcatatcattatctcccgcctgctaaccatcgtgtacaccatccgatccaaaaatgacaacttctagggatgaacctggacaaggtttagggtttagggatgaatctggacaatgattgttcaggttcatccctagatgttgctttctccttacgggacggagggagtatatgtgatggacacaaaagttactttcatgatgaaaggaaaggggatttgttggggcactaatagaacatctgtccaaatggcatgactcacttatatcctaataggacatccaagaaaaactaacactctaaagcaaccgatgaggaattgaaagaaaatacgtgccaccgcatctataaatggacaagcgcaatggaaaccctcctcatcgttcacacagttcaagcattatacagcaaaatagaaagatctatgtcccagagca

SEQ ID NO: 6610 - DNA, 666 bp, Cauliflower mosaic virus
  CaMV 35S (pQXNc) Promoter
gcatgcctgcaggtcaattctcatgtttgacagcttatcatcggtgcgatgccccccatcgtaggtgaaggtggaaattaatgatccatcttgagaccacaggcccacaacagctaccagtttcctcaagggtccaccaaaaacgtaagcgcttacgtacatggtcgataagaaaaggcaatttgtagatgttaacatccaacgtcgctttcagggatcccccctcagaagaccagagggctattgagacttttcaacaaagggtaatatcgggaaacctcctcggattccattgcccagctatctgtcacttcatcgaaaggacagtagaaaaggaaggtggctcctacaaatgccatcattgcgataaaggaaaggctatcgttcaagatgcctctaccgacagtggtcccaaagatggacccccacccacgaggaacatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacaggcttcttgagatccttcaacaattaccaacaacaacaaacaacaaacaacattacaattactatttacaattaca

SEQ ID NO: 6611 - DNA, 781 bp, Brachypodium distachyon
  PJJ 35S from Brachypodium Promoter
tcgacctgcagccaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttagcttcatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactcttgaccatgg

SEQ ID NO: 6612 - DNA, 877 bp, Cauliflower mosaic virus
  CaMV 35S (OLD) Promoter
aagcttgcatgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactctagaggatcc

SEQ ID NO: 6613 - DNA, 2322 bp, Arabidopsis thaliana
  Arabidopsis At6669 (OLD) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctgattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcagacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctacctccttttgcattcttaactttatcttctctacttatttcttttttgggatttttgggggtattattttatcttttgtagatatacacattgatttactacaaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaaaactaaaaaagagaaccccaaaggatcc

SEQ ID NO: 6614 - DNA, 2318 bp, Arabidopsis thaliana
  Arabidopsis At6669 (NEW) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctaattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcggacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctactcccttttgcattcttaactttatcttctctacttatttcttttttgggatttttgggggtattattttatcttttgtagatatacacattgatttactataaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaagactaaaaaagagaaccccaaaga

SEQ ID NO: 6615 - DNA, 1321 bp, Brachypodium distachyon
  RBCS Promoter
ccaagagtcgttgtctccatgacaacgcccccaaggaggaaatcgacgtaaaaacgccgttgtcgcccgatctggccatagccaaatcttaggttttcacccgaagacaccaaacatcaaagtgagggaaagtgaagctcttcgacgacacctccaagaaggaaaacggcgctacaacatcgttgtcttcggcatacctcgcacacgggcagttttcatccagagcaacactccaaacaccggagccgacgtccatacctcgcacacgggcagcagccgaagacgcgaccgaaaatgaaaaccacgccaccatggcatcgaaaaggaccgacttggaccatgtatggccgcagcagcagcccatctgccgccggtgaagttcaatcagccgcctcaccaaactgagaggaaaaatgatggaaacgaagagacctgggacatgccggatcagccggaggagatgacggatctggccaacgagtagctagatccggccgaagagcgccgccgtgaagccgcgcagccacgagcagaccgagcaccagggagaggaagaacgaggggaaacaccggatccgggaggaagccggccggatctagccgaagacgaggcatagcctgccggatcgggccggagacgccgcgaccacgatgaggcagcacctcaaacgcctcagccaagagctctaggacacccccgccaagaaaaacagccccgccgccgccgtccccgtgcgggctttgcccggcggcggcgagggggaggagaggacggggagaggctgctgccggggctggtgtggttgccgcccgtgtcgccccagactgagcgacgcgggggcaagcttcgttctcgataagatcttagaagagtttctcttaatttgttgttcctctagttcataaaaagtgctgctcattttgcattaactcattacaaattttctaataagtgggcgagattttttatggattggagggattagcaagttctgtttttgagtgcatgccgtggcacattggatctatcctgataggtgaaaattggtcacttcatggcatgatttgcagagtgcgttgcagccaattgtatccgtccagaggataacgcgcgccatttcgtgcggccatgtggcgcccgacctgatccgtaggatgccagcgtggcctgggcaaatccgcgcggcgaactgcagccacccctcctagatcttgtgctgatattggatgggtggggagcctacagttatataagccgctgtagctagagagcactcaagcaagcctgcctcctcttgttagctatctacgtacgtgtacg

SEQ ID NO: 6616 - DNA, 1599 bp, Arabidopsis thaliana
  Arabidopsis AT5G06690 Promoter
ggaccatttgtttagacgacattgttaaggggatgacttaaagtgatgagtttcaaattaaaatacccctcgtttttggagttatttacttaaaatgccacttcaaagaagcgtgtcggtgtgttcgagattcgaattttaattactgtcttttgcccctatctatatatatctcactttaatcacacttttattatcgttaatgtttaatgtttatttatgttaatgaaggattagtggttagtggttgtgttactaattgttcgttgctaatgtccttgaaaggtgtaatttgtatgatctatctaactaaattatccggaaataatgcggttgaaataaaatcacgatacatattaggatatcacaatctatttatagtatattttagtcgagatttgaaaataaaaagggaatatattactcgattaaagacattttcaaacgcaaaatcgtatataactatagattgaatcatatatatatctgtgactcaagtcttttatctttgttttttggtttaatgttaaaactttatatcaacaaagacttttatcttgtatcttatgtttactatttctgatgagtaaatattaattttgtaggtaagtaaggtggcaggtttgggtaaagaggaaatcaaaaatgtatggtaggatagtacttgacaaaatacaaaattctaattcgcgtttattaaagtccttagcgtgtggactctacttgtttaatttcgactctctaaacgtcggcctttattttctttcaaacgtacttcaccaactctattagagagatcgattataaccgacaagcataagtatgtgatttctatattagtttatatatagctatgtcttcgaatgattatttatagtaaacacataattatacgtaataagtccgagagtatataaactatgaaggataattaattgaagacaagaaaattaacgaaatagtgtggggaattcccaaggcatcatattcagatcaatgcaccgtcacaagtttggctattctttatttggttttctgattaacacaaagttttaaatagttttgaacgtttctaatccatttgaggcagtgattttttctgttccaagtattttatgttcaatattattaggaatgtgaacggaacgatttttttttttttttgtggaaccgagcgaccaaatttgagaaaataaaacaaattagattgatttaacatttagacgaggtttaattagaaaggaaaaaaaaaacacaattttatataaatatgaacagccaaaataattttcctagagtttataagttcagggtttacctttttcatagagaaaactaataaagtcactattaacattttaagaatatacatttttaaaacaaattataaagacaatgagagaaaggtagcccccaccagtagcacatcgttggcattgtccaactcatcttccggataagctctctatccatctcctcacatctcttcccaaaactttcaaaaacaaaaaaaatatcttaattatggcatttgaaaacttaaaaatatctcgtcacatatcttcatcgacaaaaaatttactgaaagcgaaaaaaata

SEQ ID NO: 6617 - DNA, 1774 bp, Arabidopsis thaliana
  Arabidopsis AT5G61520 (AtSTP3) Promoter
ctgttatgaggtgttcttgcacggcatgtctagttgcaggctgctgaagaattgcccaccggcttttaaacaacgacccaactctttctgcaacatctgcaacattcactttcgcatccttagcaacttccccgacaaaactaccagcagtctgccctgcttccctaagcttcgttcctaattcagtaactccatagtaagctttccaccataaacactcacagagagaaacgaaatgaggttagcatagaaattatcaaacctgatgaagaaaagaatccactagtcctctcctgccattgctgtgagatgagagaaggcattatccaataccaaccactttaaacaagtcactagaaacctgtttgcatcaagaaacaaatgggaagatatatacttattcttagcaaattatgatacaacctcacaagcggtattatccgttgtaatcaacttcatcacatgaaatcatcttcaatctaatcatatacaattgatacagaagaaacacaaaagaaaaccaaaaccttgacttcatcgtcaaccatggaatgaatttcttgacaaagaataaaaaccaagtctttaactgccaaaaggagataacttttaaggaacacaaaccctaatcctatattctctaatcaatcatatacgagaatcaaaaagaacaaatagaacaaaagcaatccgatcatcaaacctttagaacaatccccagaaaaattgagatagctgatgatcgaatcgaactaaacccaattcctcgatacgatcaaagacgacgaagacgagagtcagcgatatgatgaaaaagaaattgatcgctccaggagatgaaaaggttccacttttttaatttccccctggagcagagaaaaaaagatattattgctgtttaggtaaaaaaaaagtcggctttgaattttgaataggaaagtcttcttccctttgcaaatcacagatattctctccgtcacggactgtgacggtaataaatattctgttggtgccacgtgtaataagtttttctcttcacaaaaatggtccttcatcttcttttagtatctcatttgtgacctaagcttctaatttcacagcttatcatccccttaatgttttaagttttttgaccatagagtaaaattattttactataaaattaaaagcaaaaaataaaatttactataaaattataattataaaaagtgaatgtaaaaatgattccataaatttacatgattgatagtaattattctgccaacttaattccacatgtatatcagtatttatatatagaaaatgatggtttttctacatagtcaaattccaaaacaaaatatcagtattatggaattaaacaatcaaagtttgcaacttggtatgtccaatatcatcgaaagagctttatcattcagtcgttgaaaaaagtatagccatctttttcttctatcgattttcaaaaaaaaaaaaaaaaaaaaaaaaaaaaaaaaaaaaaaaaaaagaggaagataatgaaggtaggcagtgaaaagtctttcttcacatgtcttttattgtccactttcgatatctcatcagccagaaccgaaacaaacaaaaactataagtcccacactcaagtcaattaaagcactccaatggtccaacaagtttcgtcgtctaccttgaaactcaacctttggatgattgatatacaaaaatacaggatctaaaaacacctaccgaacttgaatagtaggtgtgttgtgtttgagtgtctctctaggtaaac

SEQ ID NO: 6618 - DNA, 1127 bp, Brassica napus
  Brassica napus NAPIN Promoter
attgattcctttaaagacttatgtttcttatcttgcttctgaggcaagtattcagttaccagttaccacttatattctggactttctgactgcatcctcatttttccaacattttaaatttcactattggctgaatgcttcttctttgaggaagaaacaattcagatggcagaaatgtatcaaccaatgcatatatacaaatgtacctcttgttctcaaaacatctatcggatggttccatttgctttgtcatccaattagtgactactttatattattcactcctctttattactattttcatgcgaggttgccatgtacattatatttgtaaggattgacgctattgagcgtttttcttcaattttctttattttagacatgggtatgaaatgtgtgttagagttgggttgaatgagatatacgttcaagtgaagtggcataccgttgtcgagtaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgctcttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagtctataaattaactcatccgcttcactctttactcaaaccaaaactcatcaatacaaacaagattaaaaacatacaccc

SEQ ID NO: 6619 - DNA, 916 bp, Arabidopsis thaliana
  Arabidopsis AT1G61720 (BAN) Promoter
ttgtacttttgaaattacagagatagagatttagttgttatgagtttatcgtcttgagacttctatataagaagtaaaaagatttgcaaatagtccttgctcattaggtacaacagtagatcaataaggctgttttagaaggtaagcacgtgatctttgaaataaccaacttgtcttcacctaagaatcaaaaaagattgaccttcagagttctgatttgttatcatctaccaaattatcacaagagtttgattatttctgtctctaaacaatataacacagctttagagtaacgaatagtgttacagtaaggttctgttacttcaattttttctttgccgatcttaaaatgagttgcaaaagaatgctttttacttccaccaatctgtcaaattctctgcagtttttaacacaacttggacttgctatgttctgtttcacgaattacacgagtcaattcaacataacttgctctgttcttgtccatgtttcacagaatctggccttaagcaattttatcatatttaagctacaaatccataacagagtttaacaaagataaaataaccagaaagttacattgaaagataaaaagtgaagaagacaaaaaaaagagagggtaaatcctaaatcgaaaacaaaagaaggcattggcaatagcattccgattttaaaaaaccgataaatctatgtatctaatggcttgttcttagaagcttcaacgaacatagaagcaacctcattcaaaaacttagtcttctccaacacaaattccaactccttagcttgcaacaacttatacttctcttcaacaatcttcttactctcaaccgaaaccaaactccattgctgcttcacataatactcatcaacacccaaactagcaatcatcctaacaagagacgagttatcaaac

SEQ ID NO: 6620 - DNA, 3965 bp, Arabidopsis thaliana
  Arabidopsis ABI3 (AT3G24650) longer Promoter
catgttaagttttactagatacgttctcatctaactagatacgacctaaaatacgatatttgtggttttagttgttagatgttgtgtcacacgagagaaagaggtcgacgaagaaaaaaacaaaaagaagaagtaaaacgtagttattggcggacaagggataaagattgctttgaagtcagaaatgctgacacgtggcagcatatgaagacaacccgccgcttaaaaccacgaatggtgacgaaaggcttctttgtttgcatgtgcaaccaatctctctctttctctctgtctttactaattttggttgttcgtagaaaatgaaatatttgaacgaagaagataaaggttggtgatgtacgtatgactctaaattagagtttgataatttgtatgtaagattagatcggttttgttatttgcttgatccaatttattgaagtacatgtgaataatcgtgatatatgtcaatatatatgtgctataattaaatctattaacaaatttctttttatcgatttagttacaccatctttaatatatttctattttctattttaaactaaagcatagtttctccaatatattaatttatatatttactctaggatagaattagattcaaaaactagaatagagaatatagatgctctaaatagacaataattctattacttactctattttagagtaaaacatatagtgatgctgacaaaaatattattttataatagagtttagaaagaaaagaaaaaacaaaaaaaacttgaagatgctggaactattaaaaattaaagaaaaagtttaaaatgaataatgctttttattcttagttttttttttcttttttttcttttagttgatgttaaagttttagtcaaatctccaaaatttgcaaaaaagatacattagttacggacggatatatattaaataaattaagtcacaaatatcatatatatatatatatatattaattttttgcctagttttgttccaaataaaattttcaatttttagtgtacaatatttttcatcgtccaaatacacaaacacaacaaataataataccactaatttatttgttttctaatataattgaaccttttctaattttattaaataggctgaaaaccataaattatttggagccaagattaaattatgttacataaatccttttctcgtcatcaatactcaaatttaaatttttttattttcatagatatttttgggaatttaaaatccttccaaataaatttgggaaaataatagatgttttaaaatatttttgttattttcgagtagtttacactgattttacatcactttatggatcaagaccataaaatttaactacatttattataacttatttgaaaagacatgaaactttcattagagtttaggaaaatacggcaaactattagattatcaccctcttgtgactaatgttaatactatttggtaaagcaaataatcccataactaattttattttgatttgttcactatcaattgtatcatagacgatccgatgattaatgtacctaaattttgatttaaattgtattccttgtagtacgcatagtaaaacaaagttcacatgttcttttacaattggttttctaacattttagatttcattttaaactaaagaaaaagggtttttcgatcccaacaatttttaaagtatgtttttgaatttcaacaaacgactagtactgatatatacatcaatgcttacaaaaatcaaattatctatctcaacgtttacttttgtacgtaattacaagtcaatattaacaaatattagtcaactgtaacggttgttgactcaattgatacgtgtacgtttaggtggcatgttttttaataaaataattttgttttatgttttgggattaaaaatatttacttttaaaaaactaaaccgaaaaactggaacccccaacctcacatattcatcaccatcgtatccacaaacattatcgagacataaataataatttatagatatatagcaacaaattggaattaaattaatcaaacaatgtcatttagaattggggaaatcctaaccgacgttatatgattaattttaattccaatttatgtatgtgtatatatctataaattattatttatatattgatgatgttcgtgcatgatggtaatggtaacctttaaaacttttgaatctcaaaacgtaaaacaacgtcatttggtttgaagaacatgccatctcgacgtacaagtgttagctgattcaacaaccgttactgttaattaccataactaacgttgactcataattatgtacaaaagtaagagttgaggtagataatttgaattttttaaatgttaaagtatgaacattactaattgtttgttcagatttataaaacacagtacctattttgatgtgttaaaatgtaatcgggaaaataggaattttcccaagaaaaaaaaatacactaaaattttgatgtgttaaaatgtaataaatacaagtacctatttctttctacaacaggtatcacatgatctgctcaatctcattttgaaggcaaggtcgaaccctgtttgtaactaaatattttacaaatacactaaaagttttgttttgttttcctcatgcagaaaaaagaaaagaaagaagaagaaaaaaaactcacaaaaacatacattgttctacaatatgttaaagtaattgttctagggtaataaaatccgtgtctgcctcttccacttcaataggaaagtgtaagtttttcgaatctttttggccagataatttaaaaccgaccgaggaaacttacttttgtaaaagtgaccatttgcacataggaagtagaaagttgataattggaaaatttataatattttatacaaaagaagtgtttaagaaccaccgcttggtctcaccactcaaattcgaacgtatggctcgtgggcacaaactcctgtaccaacctttagatactagcggcacgaggagacttctattttctctttgtttttaagtttttttatcgacttaaatatggctttttgcaccatttaatttcaaaaccaatgtctttctctcgaggaactttgtttttatttcttagaagatgaggggagatttactatctaaataaaattttaaatgtttgtaagtattatgagctcaacaattttgtcaatagtgccacaaatttaaacgtttgctttttgtcttctttgaaaaatcaaatgctgaaaaactgttacatctctttttcttaaaaactcttgtctctctccttttccttctgctgaggtaattgaatgctgcaaagagaaagagaataacttaaacccaaaattacacttaccgccagaaaaaaaaaagagttcagtttaatctaacatattttatacaatacaattgaattatattagtaaaaaaaaaacttccatataaatcatggaacaaactggaacacatgggctctcttattttaatttattttcttttttgagggatttaaccatgtttattatatagttttataaatatatatataccatctctccataatttataaaatgaaagaaagagagagtcttcttgttggagtaaacccaaacggttttagattacttattagctgttcatcagttcttcctctctaaaagagtaaaacctaaacatctctctctgttctattagaaccaaagaccaatctttgtgaacaaaacacatctcgtatacttcagatctagactcgaaaattttagacctctttacaattggtctttgttcatctgaagttggagaaaatagttagcttaggtcggatcttttcatatgctttggatcctccttcgtctcttttgtataattttaaccttatcaagagttctttttgaatctcaaaagattatatagtagtatagaaggtttatatgtatatgtatagccagatagtttatgt

SEQ ID NO: 6621 - DNA, 4074 bp, Arabidopsis thaliana
  Arabidopsis ABI3 (AT3G24650) Promoter
catgttaagttttactagatacgttctcatctaactagatacgacctaaaatacgatatttgtggttttagttgttagatgttgtgtcacacgagagaaagaggtcgacgaagaaaaaaacaaaaagaagaagtaaaacgtagttattggcggacaagggataaagattgctttgaagtcagaaatgctgacacgtggcagcatatgaagacaacccgccgcttaaaaccacgaatggtgacgaaaggcttctttgtttgcatgtgcaaccaatctctctctttctctctgtctttactaattttggttgttcgtagaaaatgaaatatttgaacgaagaagataaaggttggtgatgtacgtatgactctaaattagagtttgataatttgtatgtaagattagatcggttttgttatttgcttgatccaatttattgaagtacatgtgaataatcgtgatatatgtcaatatatatgtgctataattaaatctattaacaaatttctttttatcgatttagttacaccatctttaatatatttctattttctattttaaactaaagcatagtttctccaatatattaatttatatatttactctaggatagaattagattcaaaaactagaatagagaatatagatgctctaaatagacaataattctattacttactctattttagagtaaaacatatagtgatgctgacaaaaatattattttataatagagtttagaaagaaaagaaaaaacaaaaaaaacttgaagatgctggaactattaaaaattaaagaaaaagtttaaaatgaataatgctttttattcttagttttttttttcttttttttcttttagttgatgttaaagttttagtcaaatctccaaaatttgcaaaaaagatacattagttacggacggatatatattaaataaattaagtcacaaatatcatatatatatatatatatattaattttttgcctagttttgttccaaataaaattttcaatttttagtgtacaatatttttcatcgtccaaatacacaaacacaacaaataataataccactaatttatttgttttctaatataattgaaccttttctaattttattaaataggctgaaaaccataaattatttggagccaagattaaattatgttacataaatccttttctcgtcatcaatactcaaatttaaatttttttattttcatagatatttttgggaatttaaaatccttccaaataaatttgggaaaataatagatgttttaaaatatttttgttattttcgagtagtttacactgattttacatcactttatggatcaagaccataaaatttaactacatttattataacttatttgaaaagacatgaaactttcattagagtttaggaaaatacggcaaactattagattatcaccctcttgtgactaatgttaatactatttggtaaagcaaataatcccataactaattttattttgatttgttcactatcaattgtatcatagacgatccgatgattaatgtacctaaattttgatttaaattgtattccttgtagtacgcatagtaaaacaaagttcacatgttcttttacaattggttttctaacattttagatttcattttaaactaaagaaaaagggtttttcgatcccaacaatttttaaagtatgtttttgaatttcaacaaacgactagtactgatatatacatcaatgcttacaaaaatcaaattatctatctcaacgtttacttttgtacgtaattacaagtcaatattaacaaatattagtcaactgtaacggttgttgactcaattgatacgtgtacgtttaggtggcatgttttttaataaaataattttgttttatgttttgggattaaaaatatttacttttaaaaaactaaaccgaaaaactggaacccccaacctcacatattcatcaccatcgtatccacaaacattatcgagacataaataataatttatagatatatagcaacaaattggaattaaattaatcaaacaatgtcatttagaattggggaaatcctaaccgacgttatatgattaattttaattccaatttatgtatgtgtatatatctataaattattatttatatattgatgatgttcgtgcatgatggtaatggtaacctttaaaacttttgaatctcaaaacgtaaaacaacgtcatttggtttgaagaacatgccatctcgacgtacaagtgttagctgattcaacaaccgttactgttaattaccataactaacgttgactcataattatgtacaaaagtaagagttgaggtagataatttgaattttttaaatgttaaagtatgaacattactaattgtttgttcagatttataaaacacagtacctattttgatgtgttaaaatgtaatcgggaaaataggaattttcccaagaaaaaaaaatacactaaaattttgatgtgttaaaatgtaataaatacaagtacctatttctttctacaacaggtatcacatgatctgctcaatctcattttgaaggcaaggtcgaaccctgtttgtaactaaatattttacaaatacactaaaagttttgttttgttttcctcatgcagaaaaaagaaaagaaagaagaagaaaaaaaactcacaaaaacatacattgttctacaatatgttaaagtaattgttctagggtaataaaatccgtgtctgcctcttccacttcaataggaaagtgtaagtttttcgaatctttttggccagataatttaaaaccgaccgaggaaacttacttttgtaaaagtgaccatttgcacataggaagtagaaagttgataattggaaaatttataatattttatacaaaagaagtgtttaagaaccaccgcttggtctcaccactcaaattcgaacgtatggctcgtgggcacaaactcctgtaccaacctttagatactagcggcacgaggagacttctattttctctttgtttttaagtttttttatcgacttaaatatggctttttgcaccatttaatttcaaaaccaatgtctttctctcgaggaactttgtttttatttcttagaagatgaggggagatttactatctaaataaaattttaaatgtttgtaagtattatgagctcaacaattttgtcaatagtgccacaaatttaaacgtttgctttttgtcttctttgaaaaatcaaatgctgaaaaactgttacatctctttttcttaaaaactcttgtctctctccttttccttctgctgaggtaattgaatgctgcaaagagaaagagaataacttaaacccaaaattacacttaccgccagaaaaaaaaaagagttcagtttaatctaacatattttatacaatacaattgaattatattagtaaaaaaaaaacttccatataaatcatggaacaaactggaacacatgggctctcttattttaatttattttcttttttgagggatttaaccatgtttattatatagttttataaatatatatataccatctctccataatttataaaatgaaagaaagagagagtcttcttgttggagtaaacccaaacggttttagattacttattagctgttcatcagttcttcctctctaaaagagtaaaacctaaacatctctctctgttctattagaaccaaagaccaatctttgtgaacaaaacacatctcgtatacttcagatctagactcgaaaattttagacctctttacaattggtctttgttcatctgaagttggagaaaatagttagcttaggtcggatcttttcatatgctttggatcctccttcgtctcttttgtataattttaaccttatcaagagttctttttgaatctcaaaagattatatagtagtatagaaggtttatatgtatatgtatagccagatagtttatgttgtttaaagattcgatgatagccaagttgggttaactttctttttccttgcctccttactcacatacaaaccctatctgtccgtacaaaatactaaaaaccctaacttt

SEQ ID NO: 6622 - DNA, 1700 bp, Arabidopsis thaliana
  Arabidopsis (AT1G69120) APETALA 1
ttagactgatttctctatacactatcttttaacttatgtatcgtttcaaaactcaggacgtacatgtttaaatttggttatataaccacgaccatttcaagtatatatgtcataccataccagatttaatataacttctatgaagaaaatacataaagttggattaaaatgcaagtgacatctttttagcataggttcatttggcatagaagaaatatataactaaaaatgaactttaacttaaatagattttactatattacaattttttctttttacatggtctaatttatttttctaaaattagtataattgttgttttgatgaaacaataataccgtaagcaatagttgctaaaagatgtccaaatatttataaattacaaagtaaatcaaataaggaagaagacacgtggaaaacaccaaataagagaagaaatggaaaaaacagaaagaaattttttaacaagaaaaatcaattagtcctcaaacctgagatatttaaagtaatcaactaaaacaggaacacttgactaacaaagaaatttgaaacgtggtccaactttcacttaattatattgttttctctaaggcttatgcaatatatgccttaagcaaatgccgaatctgttttttttttttttgttattggatattgactgaaaataaggggttttttcacacttgaagatctcaaaagagaaaactattacaacggaaattcattgtaaaagaagtgattaagcaaattgagcaaaggtttttatgtggtttatttcattatatgattgacatcaaattgtatatatatggttgttttatttaacaatatatatggatataacgtacaaactaaatatgtttgattgacgaaaaaaaatatatgtatgtttgattaacaacatagcacatattcaactgatttttgtcctgatcatctacaacttaataagaacacacaacattgaacaaatctttgacaaaatactatttttgggtttgaaattttgaatacttacaattattcttctcgatcttcctctctttccttaaatcctgcgtacaaatccgtcgacgcaatacattacacagttgtcaattggttctcagctctaccaaaaacatctattgccaaaagaaaggtctatttgtacttcactgttacagctgagaacattaaatataataagcaaatttgataaaacaaagggttctcaccttattccaaaagaatagtgtaaaatagggtaatagagaaatgttaataaaaggaaattaaaaatagatattttggttggttcagattttgtttcgtagatctacagggaaatctccgccgtcaatgcaaagcgaaggtgacacttggggaaggaccagtggtccgtacaatgttacttacccatttctcttcacgagacgtcgataatcaaattgtttattttcatatttttaagtccgcagttttattaaaaaatcatggacccgacattagtacgagatataccaatgagaagtcgacacgcaaatcctaaagaaaccactgtggtttttgcaaacaagagaaaccagctttagcttttccctaaaaccactcttacccaaatctctccataaataaagatcccgagactcaaacacaagtctttttataaaggaaagaaagaaaaactttcctaattggttcataccaaagtctgagct

SEQ ID NO: 6623 - DNA, 1096 bp, Arabidopsis thaliana
  RootP Promoter
tcagatgaagaaggcggcttttgcacgatttcataatggctacgtatttggcagataaagttattgtgtatgaaggagaaccttccgtggattgcacggcatcttctcctcagtctctacgtagtggaatgaatttgttcttgtctcgtttgaacatcactttcagacgagatcctacgaatttcagaccaagaatcaataaactcgattcgatgaaggatagtgaccagaagcttgcgggatgttattactacttggatgattaagagagagatgacattgagagaatctttcaccggagaaaacctgaagtagtgagaaactcacgttttgatctttcctagccccttcaatctattataagatctcttgaattttattagatccatctggagtttaatttttgagaatatattatggtgtttgaattcggtttgtttcaatcgttcccatatattagactagtttttttcttcacacatgagaatctcaaaccgattgcgtagaagaagaactcgcattcatctgtttttgtctttagttgagaatgaatgaccgttgtaatgtcatgggcttcttttggtttgggtctgaatcacttaagcccaacacaatctcttcttaggttgaaacactgttgtttttgctgttttgtctgacacaaggcatcggatgatgtcgattgtcgaatatgcttcctcattcggagtgttctcagacatcttgagcttctcattagttaggcggtgcgctcgaaagtcgaagccgtgttgacatatcaaaacattgggaccattcaattttgtacaaatgtccaaacattatttcggtttgataacaataaacaaataaagaaagagttttttattggattcacttggcaacagccaacaacgaatcaaataatctatatacataattatattagaagctgtgaatgtgcctccgagtagacaaaagcacatgcaccataaatgatcaaacccatgaaacttccatctctctttttcccctatataaactaatgtcacttacctcaatattccatcaacaatatacatctgagatatcaaaactcctagagagatctaataaa

SEQ ID NO: 6624 - DNA, 2432 bp, Arabidopsis thaliana
  arabidopsis ATTPS-CIN (AT3G25820) Promoter
atgtcaattttcatggcacatcgaggagaaactgtttccttgtggtaatcctttataatctctgttgctaggaggagatttttcattaatagtctatctttcacaaaggcagattgatttgaagagatgaacttgggaagaatgattttgagtctgtttgcaagaatcttcgatatcaccttatagagaacattacagcatgatatcggtctatagtccttcatcatcacagcttcttttctcttgggtatcaaggccaaaatagtggagtttactcctttgggtaggaagcctgtcttaaaaaaagattggatggctaccacaaaatcgtttcctactatcgaccatgtctcgttaaagaactcacaagtatatccgtcagggcctggggatttatttgaaggcattgagaagagaactttccgcacctcctctgcagtgacttctagtgtgagcttgtcttgtcattctcatcacatctataatccagtagagtttccagttcctcccgcgaccaatccacgtagtctggcggtttgagcgttaaaaagtctctgaagtatcgaactgcctctgcttttatttgctgctgatttgatgcaatatgtccatcatcacacttaatctctctaacattgttacgaacctcccgaatctttgcagcattgtagaaagttttattattttggtctcctatcttcatccaatgcagttttgctttttgcctaaggtagctttcctcaatacccgacagccttaaccacttctcatatgcgtccgcttcagctaccactgcctgtgaagatggccttgtcatagtttctgcttgcttttcacataaagttttataggcttcttttgctttttttgagatatcaccaagtaactgcttccccatctttctgaaatgtggcttcagaccttttaatttttttgataagcggtgcatggctgaggtagaatgaaagagaggctgagttgtcttccaaagctcttctgtctcacttctgaaatccgaatacgaaattaaagcatttataaatttaaaaggcctcttgactcgttgttcctgctccataatatagaatcgacatcttaggtgatctgaacaaccgcctgattcaaagacgctgtaggactgttcatactattgcatccattgcttgctaatcagtaccctatccagcttcttacatattactccttcctttctcttgttacaccatgtgtatctctggccttggtagctcatatctgttaattcacaatgtctgattaagtcttgaaaatctctcatcccttggagaacgaatggagatgattcatagagtgaatggtcctctccttctaatatctcattaaagtctccacatattaaccaagctttgttatagaacaaaggggaatcatgatgatatttaatatcactccacaaatcctttctttctgctgcaaaatttgatgcataaacaaacgacacaaagaactcttcttgtcttccttctaataagacagagcaagtgatgagttgtgacgtcttatatattggagatacacgcacgttatcttctattatctttcaatagtaatttgatataaattaagataatgtgcagtgaacgagtggcgattgttaagccaagtgaacattatatactttattttatactttctccaagcttcgaatggagaatttatttccatacgactaactctacctaaaagggccatgtttgtttgccaacataacacgacgatcacgagatacacataacatttagaatttggagaagatacattttgtttgacttcactttttgtgcgaatggctgttctacctgaaggggccattagtataatttttttgtacataataacgtcaccaaatataacacgagaatcacgaggtacacaaatcatttaggcttggacattatctaatcaaataagctatgatatcaaatttacatacatatagtggcctcgtgggtataattacacaaggagcttttggagaaaaagaagtgtgtgatttaaatgacaattatacaaatgtgtacaattatcagatccaaagttcatgttttaaatcatcaaaaaaataataattgatgagttaaatgatatttttttcatttagatttagttagattagttgtacggttgtaccattatttaataatttaaaagttgaaatgattataatgtataaaagttgaaaatattgtaacagatatagattaagcatttttgcggtcaatatattataaaagcttttttagctattaattgaaaaatattttacacccttagatcttttgatctcctaattatataaaatattttcttctaccgtttgtctatataaccatatgtgttgtctagtgcatgtattcagccacgaataagagaatagtctactaaatcaatgg

SEQ ID NO: 6625 - DNA, 277 bp, Agrobacterium tumefaciens
  NOS TERMINATOR
gagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattc

SEQ ID NO: 6626 - DNA, 538 bp, Cauliflower mosaic virus
  35S pEBbVNi Promoter
catggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggact

SEQ ID NO: 6627 - DNA, 555 bp, Streptomyces hygroscopicus
  Streptomyces hygroscopicus (A10) Bar Gene
atgagcccagaacgacgcccggccgacatccgccgtgccaccgaggcggacatgccggcggtctgcaccatcgtcaaccactacatcgagacaagcacggtcaacttccgtaccgagccgcaggaaccgcaggagtggacggacgacctcgtccgtctgcgggagcgctatccctggctcgtcgccgaggtggacggcgaggtcgccggcatcgcctacgcgggcccctggaaggcacgcaacgcctacgactggacggccgagtcgaccgtgtacgtctccccccgccaccagcggacgggactgggctccacgctctacacccacctgctgaagtccctggaggcacagggcttcaagagcgtggtcgctgtcatcgggctgcccaacgacccgagcgtgcgcatgcacgaggcgctcggatatgccccccgcggcatgctgcgggcggccggcttcaagcacgggaactggcatgacgtgggtttctggcagctggacttcagcctgccggtaccgccccgtccggtcctgcccgtcaccgagatctgatga

SEQ ID NO: 6628 - DNA, 562 bp, Artificial Sequence
  BAR_GA
agcagccatgagcccagagaggcgcccagccgatatcagaagggctacagaggccgatatgccggccgtgtgcaccatcgtgaaccactacatcgagacatccaccgtgaacttcaggaccgagccgcaagagccacaagagtggaccgatgatctcgtgaggctccgcgagagatacccatggctcgtggctgaagtggatggcgaggttgccggcattgcttatgctggcccatggaaggctaggaacgcctacgattggaccgccgagtccacagtgtacgtgtccccaaggcatcagagaaccggcctcggctctaccctctacacccatctgctcaagtcccttgaggcccaaggcttcaagtctgtggtggctgttatcggcctcccgaacgatccatccgtgaggatgcatgaggctctcggctatgccccaaggggaatgctcagagctgctggcttcaagcacggcaactggcacgatgtgggcttttggcagctcgacttcagcctcccagttccgccaagaccagtgctcccagtgaccgagatctgatga

SEQ ID NO: 6629 - DNA, 33 bp, Artificial Sequence
  Primer
aaaaactcgagaagtttccagttgagctcctcc

SEQ ID NO: 6630 - DNA, 33 bp, Artificial Sequence
  Primer
aaaaactcgagacaaccagcacacctaatctcc

SEQ ID NO: 6631 - DNA, 33 bp, Artificial Sequence
  Primer
aaaaactcgagaccagcataaccatcaaagacc

SEQ ID NO: 6632 - DNA, 33 bp, Artificial Sequence
  Primer
aaaaactcgagagaataaacacccagcatcgac

SEQ ID NO: 6633 - DNA, 33 bp, Artificial Sequence
  Primer
aaaaactcgagagctccaagtaatttccccttg

SEQ ID NO: 6634 - DNA, 33 bp, Artificial Sequence
  Primer
aaaaactcgagagtaaccgtgcacctaatcacc

SEQ ID NO: 6635 - DNA, 33 bp, Artificial Sequence
  Primer
aaaaactcgagatggtacagagggtggtagcag

SEQ ID NO: 6636 - DNA, 33 bp, Artificial Sequence
  Primer
aaaaactcgagcacgctaaagaacatgaaatgg

SEQ ID NO: 6637 - DNA, 34 bp, Artificial Sequence
  Primer
aaaaactcgagcaggtttcatcaggctacaaatc

SEQ ID NO: 6638 - DNA, 33 bp, Artificial Sequence
  Primer
aaaaactcgagccacctacctaaggaggaaagg

SEQ ID NO: 6639 - DNA, 33 bp, Artificial Sequence
  Primer
aaaaactcgagccactgtctaccagtaccagca

SEQ ID NO: 6640 - DNA, 33 bp, Artificial Sequence
  Primer
aaaaactcgagcctaacctctcaccatgtcagc

SEQ ID NO: 6641 - DNA, 33 bp, Artificial Sequence
  Primer
aaaaactcgagcctccttcctagatctctgctg

SEQ ID NO: 6642 - DNA, 33 bp, Artificial Sequence
  Primer
aaaaactcgagccttgtctgagctgttacctcc

SEQ ID NO: 6643 - DNA, 35 bp, Artificial Sequence
  Primer
aaaaactcgagctaccctgtatatggcacttgcac

SEQ ID NO: 6644 - DNA, 33 bp, Artificial Sequence
  Primer
aaaaactcgagctactgcgttggaggatctttg

SEQ ID NO: 6645 - DNA, 36 bp, Artificial Sequence
  Primer
aaaaactcgagctagaacattagaggctgctgcttg

SEQ ID NO: 6646 - DNA, 36 bp, Artificial Sequence
  Primer
aaaaactcgagctagcatgtcagcttgaatagatgg

SEQ ID NO: 6647 - DNA, 36 bp, Artificial Sequence
  Primer
aaaaactcgagctatggaacttcttctgaacactgg

SEQ ID NO: 6648 - DNA, 33 bp, Artificial Sequence
  Primer
aaaaactcgagctctgaaccatgatgactccac

SEQ ID NO: 6649 - DNA, 33 bp, Artificial Sequence
  Primer
aaaaactcgagctgccgtaaaacctaaagcaag

SEQ ID NO: 6650 - DNA, 33 bp, Artificial Sequence
  Primer
aaaaactcgagcttgcagaaagagcagtgtgtc

SEQ ID NO: 6651 - DNA, 33 bp, Artificial Sequence
  Primer
aaaaactcgaggaacaccacccaaatctacctg

SEQ ID NO: 6652 - DNA, 33 bp, Artificial Sequence
  Primer
aaaaactcgaggatcatcagagctactgcgttg

SEQ ID NO: 6653 - DNA, 34 bp, Artificial Sequence
  Primer
aaaaactcgagggaggaaagggtacaaggatttc

SEQ ID NO: 6654 - DNA, 34 bp, Artificial Sequence
  Primer
aaaaactcgagggcacggaataactcaatagtcc

SEQ ID NO: 6655 - DNA, 33 bp, Artificial Sequence
  Primer
aaaaactcgagtccaacagctaagagttccagc

SEQ ID NO: 6656 - DNA, 33 bp, Artificial Sequence
  Primer
aaaaactcgagtccacaaacagaatttgcagag

SEQ ID NO: 6657 - DNA, 33 bp, Artificial Sequence
  Primer
aaaaactcgagtctcataaatcatgccccaaag

SEQ ID NO: 6658 - DNA, 34 bp, Artificial Sequence
  Primer
aaaaactcgagtctctgcctcctatcacactacc

SEQ ID NO: 6659 - DNA, 33 bp, Artificial Sequence
  Primer
aaaaactcgagtctgcgatctgttgagagtgag

SEQ ID NO: 6660 - DNA, 33 bp, Artificial Sequence
  Primer
aaaaactcgagttctacacattctgggagttgc

SEQ ID NO: 6661 - DNA, 33 bp, Artificial Sequence
  Primer
aaaaactcgagttgcatttacttctgcttggac

SEQ ID NO: 6662 - DNA, 33 bp, Artificial Sequence
  Primer
aaaaagaattcaacatcagttgccagatgactc

SEQ ID NO: 6663 - DNA, 33 bp, Artificial Sequence
  Primer
aaaaagaattcagtacacctgtgggcaatgaac

SEQ ID NO: 6664 - DNA, 33 bp, Artificial Sequence
  Primer
aaaaagaattcataacacatccattgtcacctc

SEQ ID NO: 6665 - DNA, 33 bp, Artificial Sequence
  Primer
aaaaagaattcctaacccaactccacttgccac

SEQ ID NO: 6666 - DNA, 36 bp, Artificial Sequence
  Primer
aaaaagaattcctactcattcacgagaaaccatctg

SEQ ID NO: 6667 - DNA, 35 bp, Artificial Sequence
  Primer
aaaaagaattcctactgacaatcacccaactccac

SEQ ID NO: 6668 - DNA, 33 bp, Artificial Sequence
  Primer
aaaaagaattcgaatgcacctcatctgaagctc

SEQ ID NO: 6669 - DNA, 33 bp, Artificial Sequence
  Primer
aaaaagaattcgtggaatgaggagcataaagtc

SEQ ID NO: 6670 - DNA, 33 bp, Artificial Sequence
  Primer
aaaaagaattctacaacaggtccctccttgatg

SEQ ID NO: 6671 - DNA, 33 bp, Artificial Sequence
  Primer
aaaaagaattctcttggtaacttgcatcgtcag

SEQ ID NO: 6672 - DNA, 33 bp, Artificial Sequence
  Primer
aaaaagaattctgccttgccttaacaataggtc

SEQ ID NO: 6673 - DNA, 33 bp, Artificial Sequence
  Primer
aaaaagaattctgtggtttcccaggactacaag

SEQ ID NO: 6674 - DNA, 33 bp, Artificial Sequence
  Primer
aaaaagaattcttagttcgtcccaatcaagcag

SEQ ID NO: 6675 - DNA, 31 bp, Artificial Sequence
  Primer
aaaaggcctaatgaagagcgcacgatagaag

SEQ ID NO: 6676 - DNA, 29 bp, Artificial Sequence
  Primer
aaaaggcctactggcatgctcacagctac

SEQ ID NO: 6677 - DNA, 33 bp, Artificial Sequence
  Primer
aaaaggcctccactcgtgtaacatggttacact

SEQ ID NO: 6678 - DNA, 36 bp, Artificial Sequence
  Primer
aaaaggcctctacgccaatttcaatttatttgagtg

SEQ ID NO: 6679 - DNA, 36 bp, Artificial Sequence
  Primer
aaaaggcctctagccaagtacacaattacagaatgg

SEQ ID NO: 6680 - DNA, 31 bp, Artificial Sequence
  Primer
aaaaggccttaaccgatcttcttcaggttgg

SEQ ID NO: 6681 - DNA, 30 bp, Artificial Sequence
  Primer
aaacccgggagaagatgcatgccaaaacag

SEQ ID NO: 6682 - DNA, 35 bp, Artificial Sequence
  Primer
aaacccgggatacacataacaaacacacacttcca

SEQ ID NO: 6683 - DNA, 26 bp, Artificial Sequence
  Primer
aaacccgggatccagcttcggcttgc

SEQ ID NO: 6684 - DNA, 41 bp, Artificial Sequence
  Primer
aaacccgggctactccgttactatctgtacaacagtttagc

SEQ ID NO: 6685 - DNA, 36 bp, Artificial Sequence
  Primer
aaacccgggctattcagaagtccaaatagagcacag

SEQ ID NO: 6686 - DNA, 43 bp, Artificial Sequence
  Primer
aaacccgggtagctgatacatagatacatgtctatattgtagg

SEQ ID NO: 6687 - DNA, 31 bp, Artificial Sequence
  Primer
aaactcgagaaactgaaataatcagggcacg

SEQ ID NO: 6688 - DNA, 31 bp, Artificial Sequence
  Primer
aaactcgagacaaatgccaatacaccgattc

SEQ ID NO: 6689 - DNA, 31 bp, Artificial Sequence
  Primer
aaactcgagagagggacaaatgccaatacac

SEQ ID NO: 6690 - DNA, 31 bp, Artificial Sequence
  Primer
aaactcgagagtctgactgatttcacccacc

SEQ ID NO: 6691 - DNA, 31 bp, Artificial Sequence
  Primer
aaactcgagagtttgtttcaccaccaggttc

SEQ ID NO: 6692 - DNA, 31 bp, Artificial Sequence
  Primer
aaactcgagattattgggagcgacaacaatg

SEQ ID NO: 6693 - DNA, 31 bp, Artificial Sequence
  Primer
aaactcgagcaaagcttatttggtgctgagg

SEQ ID NO: 6694 - DNA, 32 bp, Artificial Sequence
  Primer
aaactcgagcattaatacagcagtttcggtcg

SEQ ID NO: 6695 - DNA, 31 bp, Artificial Sequence
  Primer
aaactcgagccaaacaaaggcagtctaatcg

SEQ ID NO: 6696 - DNA, 34 bp, Artificial Sequence
  Primer
aaactcgagctaataattaagcgcctcgttgagc

SEQ ID NO: 6697 - DNA, 28 bp, Artificial Sequence
  Primer
aaactcgaggagcctttgcttcctggag

SEQ ID NO: 6698 - DNA, 31 bp, Artificial Sequence
  Primer
aaactcgaggcatattcaggtagggaggctg

SEQ ID NO: 6699 - DNA, 34 bp, Artificial Sequence
  Primer
aaactcgaggctctcactcagagactcatcagac

SEQ ID NO: 6700 - DNA, 26 bp, Artificial Sequence
  Primer
aaactcgagggagcgtcaactggtgc

SEQ ID NO: 6701 - DNA, 31 bp, Artificial Sequence
  Primer
aaactcgaggtcattgcaacttccaggtctc

SEQ ID NO: 6702 - DNA, 31 bp, Artificial Sequence
  Primer
aaactcgaggtttcggtcggatttcaataag

SEQ ID NO: 6703 - DNA, 31 bp, Artificial Sequence
  Primer
aaactcgagtacacggaatgcagcatagttc

SEQ ID NO: 6704 - DNA, 31 bp, Artificial Sequence
  Primer
aaactcgagtcaacgacagactagcacatcc

SEQ ID NO: 6705 - DNA, 31 bp, Artificial Sequence
  Primer
aaactcgagtgtactgctggccaatgtctac

SEQ ID NO: 6706 - DNA, 27 bp, Artificial Sequence
  Primer
aaagaattccccaataaaccccccatg

SEQ ID NO: 6707 - DNA, 31 bp, Artificial Sequence
  Primer
aaagaattcgaggtgtgcatgttcatagtgg

SEQ ID NO: 6708 - DNA, 30 bp, Artificial Sequence
  Primer
aaaggatccaaaaccactgaaccaatctcg

SEQ ID NO: 6709 - DNA, 30 bp, Artificial Sequence
  Primer
aaaggatccaaacatcccaattcccatttc

SEQ ID NO: 6710 - DNA, 35 bp, Artificial Sequence
  Primer
aaaggatccaaatcctaaattcttagtgtgccgac

SEQ ID NO: 6711 - DNA, 32 bp, Artificial Sequence
  Primer
aaaggatccaatcaacgatgtacaaggtagca

SEQ ID NO: 6712 - DNA, 28 bp, Artificial Sequence
  Primer
aaaggatccacacacacatcatggccac

SEQ ID NO: 6713 - DNA, 28 bp, Artificial Sequence
  Primer
aaaggatccacatcatggccacgtcact

SEQ ID NO: 6714 - DNA, 29 bp, Artificial Sequence
  Primer
aaaggatccacatttcgggtctcagcaag

SEQ ID NO: 6715 - DNA, 32 bp, Artificial Sequence
  Primer
aaaggatccacccaatctaatccaatccttcc

SEQ ID NO: 6716 - DNA, 27 bp, Artificial Sequence
  Primer
aaaggatccaccttcggaaccccaatg

SEQ ID NO: 6717 - DNA, 31 bp, Artificial Sequence
  Primer
aaaggatccactcttctccaacttcaggcac

SEQ ID NO: 6718 - DNA, 30 bp, Artificial Sequence
  Primer
aaaggatccagcatggtgtgccaattactc

SEQ ID NO: 6719 - DNA, 31 bp, Artificial Sequence
  Primer
aaaggatccagggtttagagcccaacttctc

SEQ ID NO: 6720 - DNA, 32 bp, Artificial Sequence
  Primer
aaaggatccagtagcagtttggcatagggttc

SEQ ID NO: 6721 - DNA, 29 bp, Artificial Sequence
  Primer
aaaggatccatccatcgagcaccaacaag

SEQ ID NO: 6722 - DNA, 29 bp, Artificial Sequence
  Primer
aaaggatccatcccaattcccatttctcc

SEQ ID NO: 6723 - DNA, 31 bp, Artificial Sequence
  Primer
aaaggatccatctcagaaccaaatcacgacc

SEQ ID NO: 6724 - DNA, 31 bp, Artificial Sequence
  Primer
aaaggatccattcaaagccctattccagacc

SEQ ID NO: 6725 - DNA, 31 bp, Artificial Sequence
  Primer
aaaggatcccaagacttcaaccttcctttcc

SEQ ID NO: 6726 - DNA, 30 bp, Artificial Sequence
  Primer
aaaggatcccagatatgaagcgaactgcca

SEQ ID NO: 6727 - DNA, 28 bp, Artificial Sequence
  Primer
aaaggatcccagcacatcttcctcgcag

SEQ ID NO: 6728 - DNA, 32 bp, Artificial Sequence
  Primer
aaaggatcccagcagcagaagaaatgagtacc

SEQ ID NO: 6729 - DNA, 30 bp, Artificial Sequence
  Primer
aaaggatcccagccacttccgtctctaacc

SEQ ID NO: 6730 - DNA, 34 bp, Artificial Sequence
  Primer
aaaggatccccaacaatttactccagttgagaag

SEQ ID NO: 6731 - DNA, 28 bp, Artificial Sequence
  Primer
aaaggatccccagccatctctcctctgc

SEQ ID NO: 6732 - DNA, 27 bp, Artificial Sequence
  Primer
aaaggatcccccaacaccttcggaacc

SEQ ID NO: 6733 - DNA, 31 bp, Artificial Sequence
  Primer
aaaggatcccccaacttctctcttcacatcg

SEQ ID NO: 6734 - DNA, 33 bp, Artificial Sequence
  Primer
aaaggatcccccatattcttccttgttccatac

SEQ ID NO: 6735 - DNA, 30 bp, Artificial Sequence
  Primer
aaaggatccccgaatcgaacaaggaaacag

SEQ ID NO: 6736 - DNA, 32 bp, Artificial Sequence
  Primer
aaaggatcccctaaattcttagtgtgccgacc

SEQ ID NO: 6737 - DNA, 33 bp, Artificial Sequence
  Primer
aaaggatcccctactctcctccatatttccaac

SEQ ID NO: 6738 - DNA, 27 bp, Artificial Sequence
  Primer
aaaggatcccctgttcggtgctcgaag

SEQ ID NO: 6739 - DNA, 31 bp, Artificial Sequence
  Primer
aaaggatcccgaccgtaccactttattcagc

SEQ ID NO: 6740 - DNA, 29 bp, Artificial Sequence
  Primer
aaaggatcccgagaaggttgagttcgtgg

SEQ ID NO: 6741 - DNA, 31 bp, Artificial Sequence
  Primer
aaaggatcccgcacgagtcttcttcttcttc

SEQ ID NO: 6742 - DNA, 26 bp, Artificial Sequence
  Primer
aaaggatcccggcgatgaacaccacc

SEQ ID NO: 6743 - DNA, 29 bp, Artificial Sequence
  Primer
aaaggatccctactgctgctgcttccacc

SEQ ID NO: 6744 - DNA, 30 bp, Artificial Sequence
  Primer
aaaggatccctagatcgctccgctctcttc

SEQ ID NO: 6745 - DNA, 28 bp, Artificial Sequence
  Primer
aaaggatccctccacctcctctccacac

SEQ ID NO: 6746 - DNA, 32 bp, Artificial Sequence
  Primer
aaaggatccctcccttcaaaccttcatcaaac

SEQ ID NO: 6747 - DNA, 30 bp, Artificial Sequence
  Primer
aaaggatccgaagaaccagtcgaggaggag

SEQ ID NO: 6748 - DNA, 27 bp, Artificial Sequence
  Primer
aaaggatccgacgccgaaaattcgaag

SEQ ID NO: 6749 - DNA, 34 bp, Artificial Sequence
  Primer
aaaggatccgagagagagctcaatttcatctcaa

SEQ ID NO: 6750 - DNA, 31 bp, Artificial Sequence
  Primer
aaaggatccgagagagagggagaaactgtgc

SEQ ID NO: 6751 - DNA, 31 bp, Artificial Sequence
  Primer
aaaggatccgcagtgcagagtaccacatacc

SEQ ID NO: 6752 - DNA, 27 bp, Artificial Sequence
  Primer
aaaggatccgccagaagccaaaaccct

SEQ ID NO: 6753 - DNA, 28 bp, Artificial Sequence
  Primer
aaaggatccgccgcttacaacatccatc

SEQ ID NO: 6754 - DNA, 31 bp, Artificial Sequence
  Primer
aaaggatccgcggagctttcagtctcaagta

SEQ ID NO: 6755 - DNA, 28 bp, Artificial Sequence
  Primer
aaaggatccgctcgatggcgttcaacta

SEQ ID NO: 6756 - DNA, 31 bp, Artificial Sequence
  Primer
aaaggatccgcttgtcaccttcgacaagttc

SEQ ID NO: 6757 - DNA, 32 bp, Artificial Sequence
  Primer
aaaggatccggaattcaagagcttagcctttc

SEQ ID NO: 6758 - DNA, 32 bp, Artificial Sequence
  Primer
aaaggatccggcatagggttcataaatcttgg

SEQ ID NO: 6759 - DNA, 31 bp, Artificial Sequence
  Primer
aaaggatccggctcacatctcagagtcacag

SEQ ID NO: 6760 - DNA, 30 bp, Artificial Sequence
  Primer
aaaggatccgtttccgaattcaccaactcc

SEQ ID NO: 6761 - DNA, 30 bp, Artificial Sequence
  Primer
aaaggatccgtttctgcttgcttggaactc

SEQ ID NO: 6762 - DNA, 31 bp, Artificial Sequence
  Primer
aaaggatccgtttgcactgcattaccaagtg

SEQ ID NO: 6763 - DNA, 28 bp, Artificial Sequence
  Primer
aaaggatccgtttggagaagaggggctg

SEQ ID NO: 6764 - DNA, 33 bp, Artificial Sequence
  Primer
aaaggatcctaaagcgttttgtttggagaagag

SEQ ID NO: 6765 - DNA, 31 bp, Artificial Sequence
  Primer
aaaggatcctcacgtgttctcagttctcacc

SEQ ID NO: 6766 - DNA, 35 bp, Artificial Sequence
  Primer
aaaggatcctccatcttacaggaagaagaacacag

SEQ ID NO: 6767 - DNA, 31 bp, Artificial Sequence
  Primer
aaaggatcctcctcctgtaatgtttggaagg

SEQ ID NO: 6768 - DNA, 31 bp, Artificial Sequence
  Primer
aaaggatcctctctaaccctacagcgacgac

SEQ ID NO: 6769 - DNA, 28 bp, Artificial Sequence
  Primer
aaaggatcctgcagagatgggggagaac

SEQ ID NO: 6770 - DNA, 26 bp, Artificial Sequence
  Primer
aaaggatcctgccggatgtctggaca

SEQ ID NO: 6771 - DNA, 31 bp, Artificial Sequence
  Primer
aaaggatcctgtgttgggtgattgttaaagg

SEQ ID NO: 6772 - DNA, 32 bp, Artificial Sequence
  Primer
aaaggatccttagttcagcacagcacatcttc

SEQ ID NO: 6773 - DNA, 34 bp, Artificial Sequence
  Primer
aaaggatccttcagcctctctatagcataggacc

SEQ ID NO: 6774 - DNA, 31 bp, Artificial Sequence
  Primer
aaaggatccttcgcttcctcctccttatacc

SEQ ID NO: 6775 - DNA, 31 bp, Artificial Sequence
  Primer
aaaggtaccaactcccatgtcagcaaatctc

SEQ ID NO: 6776 - DNA, 32 bp, Artificial Sequence
  Primer
aaaggtaccaggaatcgattacacagttcgtc

SEQ ID NO: 6777 - DNA, 31 bp, Artificial Sequence
  Primer
aaaggtaccatagaagcaaacaaatggcctg

SEQ ID NO: 6778 - DNA, 31 bp, Artificial Sequence
  Primer
aaaggtaccatgtgtgcatttcttccatgtg

SEQ ID NO: 6779 - DNA, 34 bp, Artificial Sequence
  Primer
aaaggtaccctaaatctccatgtctccaagcaac

SEQ ID NO: 6780 - DNA, 32 bp, Artificial Sequence
  Primer
aaaggtaccctacgcgagtactgtctggaagg

SEQ ID NO: 6781 - DNA, 30 bp, Artificial Sequence
  Primer
aaaggtaccctagtgcacgatcgcgagtac

SEQ ID NO: 6782 - DNA, 35 bp, Artificial Sequence
  Primer
aaaggtaccgaactgtaatcatggatacctacacg

SEQ ID NO: 6783 - DNA, 31 bp, Artificial Sequence
  Primer
aaaggtaccgacggcctcacaatttcatatc

SEQ ID NO: 6784 - DNA, 29 bp, Artificial Sequence
  Primer
aaaggtaccgcaacaaattacgacctgcc

SEQ ID NO: 6785 - DNA, 28 bp, Artificial Sequence
  Primer
aaaggtaccggtcgtttctggagcaaca

SEQ ID NO: 6786 - DNA, 33 bp, Artificial Sequence
  Primer
aaaggtaccggttcgtaggaatcgattacacag

SEQ ID NO: 6787 - DNA, 31 bp, Artificial Sequence
  Primer
aaaggtacctcagtgacggagatggtacaac

SEQ ID NO: 6788 - DNA, 31 bp, Artificial Sequence
  Primer
aaaggtacctcagttgacagtttgacggaac

SEQ ID NO: 6789 - DNA, 36 bp, Artificial Sequence
  Primer
aaaggtacctccttcaataaagtcaaagagtgagag

SEQ ID NO: 6790 - DNA, 31 bp, Artificial Sequence
  Primer
aaaggtacctgcataagaaatggcaacaatg

SEQ ID NO: 6791 - DNA, 30 bp, Artificial Sequence
  Primer
aaaggtaccttcctgctaccgttacacagc

SEQ ID NO: 6792 - DNA, 32 bp, Artificial Sequence
  Primer
aaaggtaccttctcataacaacatccaccacc

SEQ ID NO: 6793 - DNA, 30 bp, Artificial Sequence
  Primer
aaagtcgacaaaccactcatcgttctctgc

SEQ ID NO: 6794 - DNA, 31 bp, Artificial Sequence
  Primer
aaagtcgacaaatctctcttgtgaagcgcac

SEQ ID NO: 6795 - DNA, 32 bp, Artificial Sequence
  Primer
aaagtcgacaaccctagcgagctctctctctc

SEQ ID NO: 6796 - DNA, 33 bp, Artificial Sequence
  Primer
aaagtcgacaaggtagtagcctcttgcactctg

SEQ ID NO: 6797 - DNA, 29 bp, Artificial Sequence
  Primer
aaagtcgacagctgagaggtcaggctcag

SEQ ID NO: 6798 - DNA, 31 bp, Artificial Sequence
  Primer
aaagtcgaccacccgcctattagtctccaac

SEQ ID NO: 6799 - DNA, 29 bp, Artificial Sequence
  Primer
aaagtcgaccacgaggcaaattcctagtg

SEQ ID NO: 6800 - DNA, 30 bp, Artificial Sequence
  Primer
aaagtcgacccctattaaaccaccgagctg

SEQ ID NO: 6801 - DNA, 31 bp, Artificial Sequence
  Primer
aaagtcgaccgccgatatgttttttccatag

SEQ ID NO: 6802 - DNA, 27 bp, Artificial Sequence
  Primer
aaagtcgacctcccatggcgaagaagg

SEQ ID NO: 6803 - DNA, 28 bp, Artificial Sequence
  Primer
aaagtcgacctctcttcacccgcaactc

SEQ ID NO: 6804 - DNA, 28 bp, Artificial Sequence
  Primer
aaagtcgacctcttgcactctgccgaag

SEQ ID NO: 6805 - DNA, 29 bp, Artificial Sequence
  Primer
aaagtcgacgagctcacaccactcacctc

SEQ ID NO: 6806 - DNA, 28 bp, Artificial Sequence
  Primer
aaagtcgacgcatccatgggatgagagc

SEQ ID NO: 6807 - DNA, 34 bp, Artificial Sequence
  Primer
aaagtcgacggctagatgaactttcctcttcaac

SEQ ID NO: 6808 - DNA, 26 bp, Artificial Sequence
  Primer
aaagtcgactagagctgcaggcgtgc

SEQ ID NO: 6809 - DNA, 35 bp, Artificial Sequence
  Primer
aaagtcgactgctttctctcctaagctctagtcac

SEQ ID NO: 6810 - DNA, 26 bp, Artificial Sequence
  Primer
aaagtcgactggctcatggcgtcatc

SEQ ID NO: 6811 - DNA, 29 bp, Artificial Sequence
  Primer
aaagtcgacttatttcatccacgctgctc

SEQ ID NO: 6812 - DNA, 28 bp, Artificial Sequence
  Primer
aaagtcgacttcaagcggctatgttttc

SEQ ID NO: 6813 - DNA, 27 bp, Artificial Sequence
  Primer
aaggatccaggtgtgaccgaacgatgg

SEQ ID NO: 6814 - DNA, 34 bp, Artificial Sequence
  Primer
tttaggccttcaaggattccctcactttttctgg

SEQ ID NO: 6815 - DNA, 28 bp, Artificial Sequence
  Primer
tttctcgagcccatccatctctgcaagt

SEQ ID NO: 6816 - DNA, 31 bp, Artificial Sequence
  Primer
tttctcgagtcagagctgagcttagacgccg

SEQ ID NO: 6817 - DNA, 35 bp, Artificial Sequence
  Primer
tttctcgagttaagttgcatcatcctaattcaagt

SEQ ID NO: 6818 - DNA, 31 bp, Artificial Sequence
  Primer
tttctcgagttacgaccgatgcaacagaatg

SEQ ID NO: 6819 - DNA, 34 bp, Artificial Sequence
  Primer
tttgaattcggttcgcaaagcaaaacaactatac

SEQ ID NO: 6820 - DNA, 32 bp, Artificial Sequence
  Primer
tttggtacccaacactctatgcaacctgtctc

SEQ ID NO: 6821 - DNA, 29 bp, Artificial Sequence
  Primer
tttggtacccctcgaacttgaaccaacgc

SEQ ID NO: 6822 - DNA, 39 bp, Artificial Sequence
  Primer
tttttctcgagtcatctctacctgaactttctgattggt
